United States Patent 7,482,117 (GENETIC POLYMORPHISMS ASSOCIATED WITH MYOCARDIAL INFARCTION, METHODS OF DETECTION AND USES THEREOF) - sequence listing, part 5

SEQ ID NO: 17643 - DNA, 118356 bp, Homo sapiens
  misc_feature (1)...(118356): n = A,T,C or G, or insertion/deletion polymorphism (see Tables 1-2)
atgtttaatgatgaagtcaaagtccacagagtcagcaagcaagtgtaaaaacctcaggagtctaaggacagtctacatttctccccagaaatggcctccctatgtactgttgaagggagagggtcctttcaaggggctccaagacgcagaagcaactgggctgcagctcgaaataaagatgtcctttctacctgcaggttccacgaagcctcacaggcaactttggtgatctcacctgagctaggaattcggttttttgatgtgggttctctttgagccattgtgtgagctttaaaatgtgatgtggagattttgctatactggtgtttccttgccggaatttgacatccatggtggctctggcttccctgtctggtcccaggaggaaatggagtgtcctgcactttttttcagcttcgctttgtgtaggaaggatcaggagacctggagtcagggcttcctccaatctcactctcctccataaaacagtgtctcctaagctttctgggggtgagggccttgacaccgtgctgttctgatgaatataactgtcccagctcctgaaataaaagcacaggtgcacaaaataccgactgttgcaagcaatgcctaggtggggatgtttcctaggcgccaggtttagcactttgactttgtatgtacacacacaggggccaggcattgtggtttatgcctgtaatctcagcactttgggaggctgaggcatgagaattgtttgaagccagaagttcaagaccagcatgggtaacaaagcaagacccagtctctacaaaaaaaaaaaaaaaaaaaaagggtatatatatacacaaacacacacacacacacacacacacacacacacacacacactgggtgtggtggctccagtctgtagtcccagctactcgagaagctgaggtgggaggattgcctgagtccaggagttggagcctgcagtaagctgtgatcaggacactgcagactgtcagagtgagaccctgtctcaaaaacaaacaaacaaaacaaaaatacatacacacacacacagccagagccagcgctgagggagaggctggactcaggggcggggtcacaggcgtttctcaggtccttctcgtggtctttgtctctttttcctggaggtgggggactctgtacttcatgaggagaagttgtctgaagaaggtgggagatactcaggagcagggtccagagagggaaaaggatgaggaagtggagacaaagcagagggggcaggacaagaggagagcacgcaaggaatggggatggggaggaccttccagctgtcagaaaggtcacccgcagaatttggctcttggtttttctgctttatcaggatggatttgggaaaccagccggagygggagataaggagtctactttgcaaaggacacrtgtgagcctcctcctagtttgaactcatgagtagcagctaacagccaggacccttgtgtsgggcacgtgaggcccctttgcaaccagggcgttttctgcaccccaccagccacccctcctgggaccacgctggttccctccaaccctaacagggagagaaggaaggagaggtctggagggtttgggtcctcccttgtgctccttcttcctctgccatttattccctgagtgtcctcgcctttcctccgctacctggaccccactacagtaatgcacactggcctggactccctttgtaaccaccaagtgggttcatcttgccggctacctagacgaagccgatttatcaagacaggagaattgcaacagagaaagagtaattcatgcagagccagctgtgcgggagaccagagttttattactcaaatcagtctccccaaaaactctcatcagtttttaaggataatttggtggataggggggccagtgaatcgggagtgctgactggttggctccggtatgaaatcatagtgagtggaggccattctcttaggctgagtcagttcctgaacgtgggggccacaggactggttggcaggtccagatggggccctccagctgttaaaaatacaaaaacctgaaaagacatctcaaaaggccactctgaggttcacaatagtgatgttaccttcaagagtaactggagaagttgcaaatcttatgacctctggaataatggctggtaatattcagaattccagcccctctcatcctaacttaatggccggtggcctttcttcgttttacaagaacagtttccctttaaactataaactaaattccttcccaaggctagttcagcctacgcctagaaatgaagaagggcagtttagcggttggaagcaagatggggtcagttaggtttgatgtctttcactgtcatcatttccttagttataattttgcaaaggcggtttcaccttggcttcagccccacccatgcagtaacactgtgccctgtccttccaatcactgccactaggtggaagcagagcgtgcatcgcccagatgggctagattctcacaggctcactgctagaacgaayattcttgagactttagatctgaaagtcagcctgatttctgaaagccttggaccgtttccaaaatcaaatcaatactccaggaacaagatctgcctcgactttgcctctacccaaggacgctatggcaacgcagttttcaaacgtgctttgagaataaatggaacagggtcccctgtgtccccactcatttgcgttttcctttttattacagccaaccgcttttgtaaatattgttacacatctctctattccactgaaaacatctctttcaaatgcactttaagaaagattcaatgccatgaaaatatgaaggatcctcttgaaagagagtttctggtggtgggttttaatgaacattttcttttttaaaactctgtaactatttcgttgtggggcttagcttcatattttcaaactgaaatattctcttccttaacctccacataaatccaagtttataatttttattattttaaaattttatttatttttctgttttggggacagggtctcctcctgtcactcaggctggagtgcaatggcacaatcatagctcactgcagcctggaactcctgggcttaagcaatcytcctgccttcgattcccaaagagctgggattatagtcatgaaccactgcaatccacccaaatccaagtttacactaaaagataaaattccaacattgtaggggattggtcaggtggtgggaataattataaagataaagttataggaaatagacacaaaccttcttggaaggtggaaagttttgcaaaagcctcaggatagggttatagctgaaagcagcctaatccccttaccttgagttaatagcttcgagtaagtacaaagacatgtaagagagtttatctaaagagcatgtttacctttgatcatttgtaggactgctctctccgggggactgcgaccagattaattacccacaggtgtgttgactcaaagcctttgtcattaaatctgtgctgaataaaggcccacagggccagatagtcagggcacgcagctgccacaaccctttctgtgagtggcctggccctctggtgcactctttcactgaatatcggtgtctgagtacattattcatccatcgtgcagcctgggtctgccggtcagaccctggcacaacatttaagaggaaatgaaagtcacaaagttatcccagtctctggagtcactgtcaaaactttggtgaggaatcttccaggttttcccctacttcaaatatatattaatattatgtaagtgatattagtggcattttcgcccaggctggaatgcagtggcatgatctcggctcactctaacctctacctcccagattcaagcgattctcctgcctcagcctcccaaacagctggaactacaggcacccaccaccacgcccggctaatttttgcattttcagtagagacagggtttcaccatgttggccaggctgatcttgaacttctgacctcaggttatctgcctgccatagcctcccaaagttctgggattacaggcatgagccactgtgcccagcctccttaaccttttaaaaaaggttaaaagtatgctgggcacatcttttcatagcaatacttaaaattgctcttactctttttaatgacaacatagaattttatcgtgtagctgttctttgggagacgattaaaatcttctttatcttcactgtggtagtggagatgtgggtgtgtacaacagctaaaattcaacaagttgaacattttaaatagatgcagtttattgcatgcaaagtatgtcccaataagatgatttaaaaatattatcctctttgagacttgtactttgcttatgtgaaacaaaacaaaacaaaaaccctgttcttgtgcccaggagacacaccctgacwcatctggaggtagagggtcatgctgtctgcaacttaccctcacaggctctgaaataacaataatagcagcatatttacagatttagagagagagaaatttgtggtaaaaatgttcataagtaaaactagataaagggcaaaaataaaagaaataatgaaactacgtcttttaaattttctctctccggccgggtgcggtggctcacgcctgtaatcccagcactttgagaggccaaggcaggcagatcacgaggtcaggagatcgagaccatcctggctaacacagtgaaaccccgtctctactaaaaatacaaaaaattagtcgggcgtggtggcaggagcctgtagtcccagctactccagaggctgaggcagcagaatgccctgaacccgggaggcggagcttgcagtgagccaagatcgcgccactgcactccagcctgggcgacagagcaagactccgtctcaaaaaaaaaaaacaaaaaacaaaaaaactctcctttactttttctctccccttttcttcctatctcttccctcatttcttcaacacgtccccccatccttccctcttttctccattctctgcatttgatccccggtatattccagcctccaggccaacaaacttctccgcgtccgccgggagcaggtcagggaagggacgcgaggcggcgctgtcaccgcattctgagcgccgcagctccctgggccccttgtatcatttcagtgaaggtcactccagtctttcatggaggccaaactaagggtgtaaattaggatcctcactgaagtggcgggaccctaagaggctttttcctggccccttagttgtgggttttcctgcgggcggcgcagccggtttccatcagaaccgcccagaggcggacgctgccttcstggggtgacggagcagcaggaagcgttttcggatcctggaatacgtgggcggcccgtgggaggggctgaggcgcagtttcctactcacccggatccgaatcctccgcggtgctgtttcaagagagccggattccagatcgcgctccagcccggactcggaattcctgccctgcgggtctgcattttcataacgggcaggtgtgagtgccctgcagctggagaccagaagcctgaaggcagctcggccctccccagcccacagcgccgttattccgtttctatatcagtaaacacatttcattttccgtagaccagggcggggtgacgggtgatcccagtcctcgcagtgaattccgggcagcaaaattcaaaacacatgcggccaaggccgggcacggtggttcacgcctgtaatcccagcactttgggaggtcgaggcgggcgatcacctgaggtcgggagctcgagaccaacctgaccaacatggggaaatcccgtctctactaaaaatataaaattagacgggcttggtggtgaatgcctgtaatcccagctagtcgggaggctgaggcaggagaatcgcttaaaccttggaggcggaggttgcggtgagccgagatcgcgccattgcacttcagcctgggcaacaagagggaaaactccgtcgcaaaaactttcgggggcggagcggagccmcgccctgggttatgtaagcgaccgcgctgggccgtttctctttcttttccggaccctgcagtggcgcctraagtctgagagagggaagtcgcctctgtgctsgtgagtgcatggggtataaggcaagtgctgagggagaaaacgtagttratggggtagagcagacggggttggaggtggggtggagggggagrgctttggacagaagacctgggaggcttggtgggggaggggcgcccaggcctgggcactaagaaacaavtcccctggagctcaagaccatctcggcctcccctagcccaagagaggactggcttcatgactccctgaaaccatttctaaatgccttagaacaaaccttgcatattcattattgttattgaactattaaaagtcttttttgggggcgagctgaatcagatcctttgctggagctggcacacggaggaagtcctggagggagggtagacaccgtggaggtaagggcttgggacctgtgtcaggagagctaggtccatctccctcycagtctctcactaggcttatgatctttagcagtgaaaataatctctctaaggtggggaaaggaccccggtccctgctgtgctcaataaattatgaggatcaaaataaattatcagtgaatgtgaatgggaaaactaagaaattgttaaarttctcgaatacattacattttcatccacagaaaagtrtaggctagggatcatgggggaatagttagtaatgacagggatagtkgaacttaaaaaaaaagtttgtgaggctgacaaagaagaaacggacacatttcctgatcttggagggttcatagggtagaagatggtagatgacagctgggtgtggtggcactcgcctgtagtcccagctactcaagaggctgtggtgggaggattgcttgagcccaggcattcaaggctgcagtgagctataatcatgccactgcattccaactgagtgacacagcaagactcctctcttaaaaaaaaaaaaaaaattcatggcagggcacaatgagtactatcaggaaggttcaaaccacgggctaaatcagtagttctaaaacttgactacacatcggaatcaccyagggaactttaaaagatactaagatttaggtccaacctgggtttactgatttaacaacctaggttgtggctgtggcctgggaacatggatattaaaaactctccaggtggttctacrcagtggctargtttgatgacctctgcctagatgtcccaacgactaagagatgtgcgttggggacaaggcaattctcttagtagaaagaggctttcgggacagcattcttattattgagaattgagaattcatatgccacacaatttatccttttaaagtgtgcagctcagtggcttctagcgtaatcacaaggttgtgccaccgtcaccactgtctaccctggaagattttttttcctttttttcttttttcttttctttttattttaaaggctagtcaagtgaaacagtgggagtgaagaagaaacaaagacatctataactggttgtgatcaattagttgtamacactgcactcagaccagcctgggaagattttaaggatatggtgtggtctgatgggttccaaggcagaggttacaatagcctggaagagggagactgcttaggcagtggcatcctggtgggatagggtgaggagatcccagagcccacgtttactgcaaccctggggagatgtcaccagagaaatgggggtggtgccagacagcagattgtggcagctgaggttttccacggtagagtagaagcatccatcatgtgtgacattcagcagatggggcgctgtgggtggcttggagcactctggttgtaactgaggcaggcaccgtgtttaggaaggctgtgcagtaatctaggctgaaggraggggaaagcctagactaagattgtggctgtgggattgaaatagcgttgaaggagctgactttgactcccggagatgatggggaaagaggaaatcagaagggaccaaggatggtgatgttcttaagagaaactgaggaggaagagaggatgatatggtggcagacgtatagagagtctttgtagatctctcacattggaggggactatggtcggaggtacagatgtcctaaggcaggctggaaaagggagtctggagagagcttggtgttgtagtgaaccacagggagccgcctccttggccctgtgatcacccagggactgaatagagaggcggccctgggagacttcagacacttagaggatataagggggtgaaaggggggcctggctttgagtcaaagggaggagaaggagattataaagctgaaacgtctaagagagtttgtggtctgagcggttctactgcggcaggtgcttctgagaggcagaggtggctgagatctggaaacaggtctgcaaatctggtcactggtctcattgccagtaacgctgtgcgcggttgagggagtgtgttgggagaatagccacgcgttgtctgtcctggaaggaacaagccagtgagagccggtttaatggggcggccggcgaaaggggcttggtgaggcccgcgctcctcggggtgggggcgcggggatgggtggtcgcgatgccgggagggcaggcagggccctggccgtgcttatgaagttggagctgtactctcagctactcgaagctggtccctgctttaggctgcgctcccgcgtgctccccattttctgggccccaggtcccgccttctaaatctccccaggtctccagcccactggaattttctcttccaagcgtggccccgccctctccgctcgtgattggccctaagttccgggccccagtttcattggatgagcggtcgggggaccgggccaggtgastaagtttccgcgrcgccttctccccggccactgcttgagccgctgagagggtggygacgtcggggccatggggctgggcccggtcttyctgcttctggctggcatcttcccttttgcacctccgggagctgctgctggtgagtggcgttcctggcggtcctcggcggagcgggagcagygggacgtttccgggggtcgggtgggtagcggcgagcgctgtgcggtcagggcggggctcctgtgcsctgtcggtggcgcagggagctggacgcggcccgttaccgccacacttcagccctgcttccccgtcacttttcagtcctcctcgggatcgcgcatcacctgcactttctggtctcctcctgctctttctctcctcgcgtctcctccgcttcctctcacttttcggacaaaccagtccttctgaggcccatgggttcccgggctgcctccggggctgctcctgtgaatggcattcgagtgcccttccagcgcggccactgaagcagccacaacccccggtgctcggggcggctctcaggtccctgaagtcctgtcctctcccggagccgacgtgttctcagctcctgggccgcagctcctggagtaggggccctcctttctcgggacccggagctggtgcttcctgctgctgtggggactgtggggggtcctgactctcaagctgaggggttggagtctgcaggctccgggcagaggattcttcctgcgacttctctcatccccagctcattctcccctcgcctctggctccgagggtcctctcctctctctcatcccacccctactaatgaccagtgatctaaggacaccagattccctctcacctcctccctgcccatctcagggcccgctgagtcctkttgccctcccagctccctgctaccccttcctgtgtgctgttctctgatccatttctagrgtgtcctctgccctcatcccctgtccccgccaccgaaggtccctcctgcaccccttatgggcctttcctacaagcagccttcacccagtgctgcccctatgcctccccgttcccaaatgtccctgactctaactttctggtgctgccttttatccgggggggtcttccctccatcccactcccctccagaccccyaaggggaaccctgatgctaatggcagttgggccttaggcagggcgcagggcagcgcagatgccccctcccctccagtgcagatgcctgytctggaccctgcctcatkgtggccccttccccactccttcatcctcagcctcaccctcttgaggacsccaccctccagcccacaggtgctggacyatccctccctggtccctccgcccctctccaccttgggaccttgtgctgctcctrtctcttgcccagctgccttgggccctcagcamgttctcatctttcagtgggaaagtgggagtgctggagcatatgacagtgctgagmatctttcccaagccccaccctcccccagagcaccctcccctcctgtcctcaccctaccccaagttctcccacagtcactcctgccccatgctcatgccgccctccagttcttgctctgcccatctcccctccccaacccagacctaaaacaggctgttgggccaactgttccttgaccttccttcttttcttttggttccttgaccccagtgggctctcactccccacaccgcatatctaaaatctgttttgcctgctcttggggtgccactgctccccctccagcattactccttttggcaggtccttcctcaggctgagaatctccccytctaccttggttttctctctctggccagcacccccacyccttgctttgtttttaatttttaacttttgtttgggtacrtagtagatatatatgtatatatttatggggtacatgggatattttsacacaggcctacaatatgtmataatcacatcagggtaaatgggttatatcacaacaagcatttatcctttctttgtgctacaaacaatcccattatgctctttcagttatttttaaatgtacaataaattattgttgrctgtactcaccctgctgtgctatctactagatcttattcattctaaytatatttttgtacccattattaaccatccctgctcccccactccccactacccttctcagcctctggtawtcatcattctattgtctctccccatgaggtccattgttttaaattttggctgccacaaataagtgagaacatgcaaagtttgtctgtctgggcctggggcttatttcacttcacaggatgacctccagttctttgcaaatgacacgatggctgaatagttctccacatacacatgtacaccacattttctttatccatgcgtctgttgatggacacttagattgcttgcagatcttggctactttgaatagtgctgcaataaacatggaaaagtagatagctctttaatataccratttcctttctttggagtatatgcctaacagtgggagtgctggagcatatgacagctctattgtatttttagtttttggaagaacctccacattgtttcccatagtggttgtactagtttacgttcccaccaacagtgtacatcctcaccagcattccttatttctacatcctcgccagcattccttattgcctgtcttctggataaaagccagtttatctggggtgggatgttatctcgtaggagttttgatttgccttcatctgttgacgaatgatgttgagcaccttttcatatacctgtttgccatttatatgtcttcttttgagaaatgactattcagatcttttctcatttttaaattggattattatattttttttcctatagttgttcgagctccttatatgtttcagttactgatcctttgtcagatgaatagtttgaaaatmttttctcccattcttggatggtctcttcattttgtttattgtttcctttgctgtgcagaagcctttttacttgatatgatcccatttrtgcaattttactttggttacctgtgcttgtggggtattactttaaaaatctttgcccagtccaatatcctagagagtttccccaatgttttcttgyatagtttcatagtttgaggtcatagatttacatctttaatccactttgatttgatttttgtatatggtgaaagacagggtctagtttcattcttctgcataaggatatctagtttccccagcaccatttttgaagagactctcctttgccaatgtgtgttcttggtacctttgttggaaatgagtttactgtagatgtatggaattgtttctgggttctctattctgtttcattggtctgtgtgtctgtttttatgccagtatcatgctgttttggttactgtagctctgtagtataatttgaagtcagataatgtgattcctctagttttgttcattttgctcaggatagctttatctattctggtttttttgtggttccatatgcattttaggattatttttattatttctgtgaagaatgtcattagtgttttgatagggattgcattgaatctgtagattactttgggtagtatggatatttcaacaaaactgattcttccaatccatgaacgtggactatcttttccattttttgtgtccttcaattttttgcatcagtgttttttgtttttggtttttgagatggagtttcactcttgttgcccaggctagaatgcaagggtgtgatcttggctcaccgcaacctccgcctcccaggttcaagctattcttctgcctcagcctcccaagtagctgggattacaggcatgtgccactgtgcctggctaattttctatttttattagagatggggtttctctatgttggccaggctagtcttgaactcctgacctcaggtgatccacctgcctcggcctcccaaagtgctgggattacaggcatgagccaccacgcccagccacatcactgttttatagtttttattggagaggtctttcacttcttcagttaggtttattcctcagtattttattttatttgtagctattgtaaatgggattcgtttcttgatttctttttcagattatttgctgttagcactgatttttgcatgttgattttgtatcctgcaactttactgaatttgttcttcagttctaatggttttttggtggagtctttaggtttttccaaatatcagaccacatgatctgcaaacaaggataatttgacttcttcttttccagttttaatgccctttctttctttctcctgtctgattgctctagttaggatctgcagtactgtgttgcataactgtggtaaaattagtcatccttgtcttattccagatcttagagaaaaggctttcagttttcccccattcagtatgttactagctgtgagtttgtcatatatggcttttattatattgaggtctgttccttgtatacttagttttttgagagtttttatcatgaagggatgttgaatttatcaaatgctttttcagtatcaattgaatgatactggcttttgtcctttattctgttgatatgacgtattacattgattgatttgtgtatgttaaatcatccttgcatacctggaatacattccacttgctcataaagaatgatcttttttaatgtattgttgaatgtggtttgctagtatttccttgacgatttttgcatcggtgttcatcagggatataggcctgtagttttcttttttatgatgtgtctttgcctggtttttgtatcaggatattcctggctttgtaaaatgagtttggaagtattccctcctcctctatttttcagaacagtttgaataggactgacatatgtygttctttaaaagtttaattgtggtaaattatacattacatamattttactgttttaaccacttttaagtgtatactcggtggcattagatacattcacatttttgtgcaacccaaaactctgtgcccattaatcggtaactccccattcctccctacctctggcccctggtaaccaccattctactttttgtttctatgaatttgaccactctaggtacctcatttaagcagaatcatgtaatgtttgtctttttgtttctggcttatttcacttataatatttttgaggttcggtgggcacagtggctcacgcctggatttccagcactttgggaggytgaagcaggtggatcacctgagtttcggagttcgaaaccagcctggccaacatggtgaaaccccatctctactaaaaataataaaagttagccgggcgtgatggcgggtgcctgtaatcccaactacttgggaggctgaggcaggagaatcgcttgaatccgggaagtggaggttgcagtgagctgagatcaggccactgcactccagcctgggcaacaagagtgaaattccatctccaaaaaaaaaaataaracaataataataataatatttttgaggttcatccaagttgtagtatgggtcagaatttcattccttttaaggatggataatactcattatatgtatgtaccacatcttggttatccatccctcagacaayggacacttgggttacttctaccttttggatattggcaaatatttcatttcctttgggtatrtatttatttcctttgggtatttcttttgggtatatatccagaaatagaagcagtacacaggggcttcattttctctgtctctttgccaaccttgctctgtgtgtgtgtgtatgtgtgtgtgtaggtgtgtgataacagccatcctgattggtttcaggtggcatctcattgtggtttggatttrcattttcctaatgagtgctgatattgagcatcttttcatgtgtttgttgatcatttgtaattttctttgaagaattggccatttaagtcttttgcccattttttcccccacatagcttctcttatcagatatatgacttgcaatatttatttcatttcggggttgattgctttttcactctgattgtgccctttgatgcatagatgttttgaattttcatcagtctactttgtcagttctttctattctatctgtgctttggtgtcatatccatgaaagcactgtcaaatcctatgtcatgaacattatccccaatgtttgcttctaagaaatttttaggttttagttcttgagtgtagagtttaggtctttgattcattttgagttaatttttgtatatagtgcaaattaagggtccaattttattttaacaccccctgcccccagaactatttgctgaaaagatcaactgactcttkgtcacctgctcaccccagtggacactagctgttccatccaattgctgtcctggggccttgtcatgcyactcttccactttgracccaagcccacaccgttcgttgctcccctctgggatactgaccccactataaacttctctrgggctacaaccttcctacccyttgtgcctcatgaccaccccctcccttgtccccgccatgcccatgatgagtctcttctcraggcagctcsccttgcctccatctcaccctcagcctatgcaccacagccacactggacatgggtccctctgagcctgagtcccttcccattcccacyatcycctctggcaagaccttccttccaccaccttcatgctcctccctygcccctgcagggcagcctctccccttggcccctattcccttagggggcttgtggccacccagtccttgcacctggcctacaagtttgccatcttcattcccccttcttctgttcatcagccccctcctctatcctcccaccctcacagttttctttgtatatgaaatcctcgttcttgtccctttgcccgtgtgcatttcctgccycaggaaggttgggacagcagacctgtgtgttaaacatcaatgtgaagttayttccaggaagaagtttcayctrtgatttcctcttccccagagccccacagtcttcsttataacctcacggtgctgtcckgggatggatctgtgcagtcagggtttctyrctgaggtacatctggatggtcwgcccttcctgcgctrtgacaggcagaaatgcagggcaargccccagggacagtgggcagaagatgtcctgggaaataagacatgggacasagagaccagrgacttgacagggaacggaaaggacctcaggatgaccctggctcatatcaaggaccagaaagaaggtgagagtcggcaggggcaagagtgactggagaggccttttccagaaaagttaggggcagagagcagggacctgtctcttcccactggatctggctcaggctgggggtgaggaatgggggtcagtggaactcagcagggwggtgagccggcactcagcccacacagggaggcatggrggagggccagggaggcrtacyccctgggctgagttcctcacttgggtggaaaggtgatgggttcgggaatggagaagtcactgctgggtgggggcaggcttgcattccctccaggagattagggtctgtgagatccatgaagacaacagcaccaggagctcccagcatttctactayratrgggagctcttcctctcccaaaacstggagactraggaatggacartgccccagtcctccagagctcagaccttggccatgaacrtcaggaatttcttgaaggaagatgccrtgaagaccaagacacwctatcacgctatgcatgcagactgcctgcaggaactacggygatatctaraatccrgcgtagtcctgaggagaasaggtacsgacgctggccaggggctctcctctccytccaattctgctagagttgcctcacctccmagatgtgtccagggaaaccctccctgtgctatggatgaaggcatttcctgttggcacatcgtgtcctgattttcctctattgttagagccactggataaagacagwgggtcagggactggaccatccagtgttgtaatcagggcaagtagaggaccctccgacagaatcctgagcctgkggtgggtgtcaggyaggagaggaagscttcagggccagggctgccccctctgcctcccagcctgcccatcctggagagttccctcctggccccacaacccaggagtccacccctgacatccccctcctcagcatcaatgtggggatcccagagcctgaggccacagtcccawggcccatcctcctgccagcctggaagaactgggccccagagtgaggacagacttgcaggtcyggggtcccrgagggcttcagccagagtgagaacagtgaagagaaacagccctgttcctctcccctccttagaggggagcagggcttcactggctctgccctttcttctccagtgccccccatggtgaatgtcacccgcagygaggcctcagagggcaacatyaccgtgacatgcagggcttcyrgcttctatcccyggaatatcayactgasctggcgtcaggatgggstatctttgagccacgacacccagcagtggggggatgtcctgcctgatgggaatggaacctaccagacctgggtggccacyaggatttgccraggagaggagcagaggttcacctgctacatggaacacagcgggaatcacagcactcacsctgtgccctctggtgagcctagggtgaccctggagagggtcaggccagggtagggacagcagggatggctgtggctctctgcccagtgtataacaagtccctttttttcagggaaagtgctggtgcttcagagtcattggcagacattccatgtttctgctgttgctgctggctgctgctatttttgttattattattttctaygtcygttgttgtaagaagaaaacatcagctgcagagggtccaggtgagaaaagcgggcagtttctggagatggtaaggcccytgtctgggcagtagggtcccytcattgctcctgcaaagataggcatgttggtgacaaggcttcyrtaacaggggatgaaagttggggaatttgggamgggaatgggggcarcatctccatctacacccataagtgctgcccaagcragggtcaaacgcccagctgtggcatcytcctgctgcaggtgaggagtgggcagcagggagggctgcggcgcctgctctgtccccatcccggtctctgtgtctcttgractcactagggcgcatccaggtggggtgagctgggaatcacgtgctgaatgctragggcctggatgatcacggcctcagagggagcaaatagtaaaggcagctgtgatctggggagggccagaaactggagaggaatctgaggagaggcggtgcccctattcccttcctctctgcatccccctcccctgtttctccagccatcggggcggacaccgagaaaaagacctatgaggcccagcctgggggccctgcctgtgtagccctttggagacccctwgtaacagggagggtcctgagcacacatggccatctctgtccactktgcagctccccatgcacctcctccaggagctttcttggggttgtygtgtcctctgcaccattcgaggccctactctttccaggttcccacggcctggcctccctgagtttcttgcagatgacatggatgagtagataagcagatgtccctgggccatttgaggagtggggcccagcccctcatcagggcagwtgtggtccctgttttcatcctacctccgagtgttttcttctccagtccctgagggacacagtcctcagggcccatgtttttggggatttaatctgtgctctgtggcctcaccttgccytccctgagccaatttccctttctaaaggtggtcactgcctggtaagtttggagtaagggacggtcagaatcatttcccctacagtcaggttgtttgatgggggatgaaaagagacagcaggaagttttgtgtttctgcaaagacagaagcagttcaggcgacagtaagaggctggggtgtccaggaggrtgtgtctggcagtagggtcgctggtttctcatccttgaacctaattgcactgtcartcggcccctcaggcctgagcagatgggaaggtttgtcccctgccctgcagcaagagggccctgtccaggaggcacccacaacagrggcagtgcaggtctgtggtcactcctrctctcacctgtggcgtctcccgtagagggattgtcagttctggttccctgtgggcaggaatggtttcctcataggtcactggagttttggccaggaaaagagtatgaagttcatgtgscagtttctcaaaattcctgctttcaatgttgatgtccagtaaagatattcgtaatttcagctctataatcttaataggatttcctctaatattgtgaagcatattatatgaaacaggaacacaaatttctcaaaattcctgcgatgtccaataaagattttcataatttcagctctgcaatcttaataggatttcctaatactgtaaagcatattaaatgaaacaggaactcaaatttggagccccctctccaggaggttctgtgtggagatggtggctgtggcagtggcagttcccaggtgcagagggtgggcagaggcagcctcaggctaaggggtctcccctactccacatggagaaaatcccttgtaggttgcaagggcagtggccgggtggaatccctgctagggacagagcaggaaggcctcgcagcctcaccaagcagcagcyctggggtggagctgcgtttccagggttaagcggaccaggcaggagtagcggttactcaagagcaggtcacaggcttgggttgtgagggtcaggagaggccaggcctcctcgagcaaggtgggggtcccagggtcaggtcaggtgcagatcctgtggcagccacgtctttccatgctgggcctgctgggccccccaggcttyctgatggggtccccagttaggagctgcctgctcagggctgggaggggaggagcactgagctgcagatagagggcagagcccacagtgggcagggcctgccctggtgtgtaggtgcctctgmaggagaggagggcctggggactgagagcaagggtcagggcctctctttggggaggcctctcactgtaacaggactggtcaggcctgagaggagggcactgggttccctcttgggtcttgtcctttagtcttggggccctttccctccctgcacgatgagtggtgggcacagggcacgggctgatgttgatggagtgatgggagggaactggcaggggctgggaaaagcaaggagggaggaagaaaaaagtgggggcctcatcttccctcagagaaagggcaaatctggttttggagcaactgaagagwgaaaagtccccagggaataaacacaacactgcacccagtggagcatttacccatttccctcttttctccagagctcgtgagcctgcaggtcctggatcaacacccagttgggacgagtgaccacagggatgccacacagctcggatttcagcctctgatgtcagctcttgggtccactggctccactgagggcrcctagactctacagccaggcggctggaattgaattccctgcctggatctcacaagcactttccctcttggtgcctcagtttcmtgacctatgaaacagagaaaataaaagcacttatttattgttgttggaggctgcaaaatgttagtagatatgaggcatttgcagctgtgccatattaattggtgtcattgtttttgttgttttcgtattattattttttttttttaagacagagtctcaggccaggcacggtggctcacgcctgtaatcccaacactttgggaggccgaggcgggcggatcacaaggtcaagagatcgagaccatcctgatcaacatggtgaaaccctgtctctactaaaaatacaaaaaattagctgggcctggtggcgtgtgcctgtagtcccagctactcaggagctgaggcaggaaaatcacttgaacctgggaggtggaggttgcagtgagctgagatcacaccactgcactccagcctggcgacagagcgagactctgtctcaaaaaaaaaaaaaaaaaaagacagagtctcactctgtcacccaggctgcagttcagtgacatgatctcagctcgttgcagcctccgcctcccgggttcaagcacttctcttgcctcagcctcccgagtagctggggttacagacatgcaccaccatacccggctaatttttgcatttttcatagagacaggattttgccatgttggccaggctggtctcaaactcctgacctcaggtgatctgcctgcctcagcctcccaaagtgctgggattacaagcatgagccaccatacccggcctattttattacattttaatttattttattttattatatcatccaccatgtctggcctattttattatattttaagatattttaatatattacgtgtgttgtaattggattatcatcggtgagctttgtgagtgagtgtcttggagatgactcctcctgaccagcccaggaccagctttcttgtcaccttgaggtcccctcgccccatcacactcttacgcattactctatgtctactgttatgggtgtgtaattttataccatagatgtttactctttaaacagacacttctagtctgttttatttcatgtgtctgggagcggataaagtgtgaggttcagggagaaagagaggtctgtctcaatgccttggcacggcatgaagacaatctcccctccttgtcccctttccctgctagctcctgatgactgacagattcacagcagaacagaaaggactgggaagggatggaggtgggacatctggcactgaccttcaggggctgaccctgtgggggaacatctgccctgaagagttggagccttcaygtgatgacacagagctgaagtgtgatattcgggaggggatagagagtgcttggaggtyttctgattttgaagaatcccagtcagtcaggttctggcgtaaagtgactgctggggaggtgtggactgaatgaatgaagaataaatgaaccaggaaagtggacatgcaagaggtgggttattcctcaccctatttcttgatrcctcctgactgctggtgttggggcacacagatgggtgatgcacttcttggtcaaggcaacctcagccccacccacgtaaggtggtcatggcagagagtgtaagggtgacacctgtgaaaaagacccaaggcagggatgggagcccttcttgcagcaggagtggatgcaggacctgcctggaagcaagagaaggacgagggaccctggctgggccctgtttcctcccactgcctggttcacaaagcaaccagtaagggagctggagtagggaattcactcatgtgctacttactgatccagagatgtgttcgttgacattttcttttatgttttcaggttgatgtcatttacacattcatgcatttatgttgtgtatttattagtcttgtttattttagttagcaagtgtcacttgttgaattctgttctcattaggtataaattttcatattcattgaagtttttataatcaaaatttaattgtccatgattttaaaagtcaaatatttgcataggatttctctagagaaatgagtcctctctgcatcttctcaatttctgccttcctagaggcaaccattttcaacatttttagctaagtctttcaacttttacttccatatgtctaaatacaattccttcattaatactgcttgatttttccgttgcagtcattatctgttgcacagcacagtggtgaatgcaatagttaattgtacctgttccctttcactcttcccattctttcatcttcccgatgtatttctgtagtaattatgtttggttcagtcgttccttgtttccttttccatgactaattttctcatatgtcagcttgaccacttttcacttcctgaacatttgttcttcctgtagttaatacttgcctttgtttttgtttattttataaatagcactcattaacgttgatatttcttctatttgtattactcctttttttgggatggagtctcactctgttgtccaggctggagtgcagtggtgygatcttggctcaccacaacctccgcctcccaggttcaagcrattctcctgcctcagcttcccgagtagctgggattacaggcactcaccaccatgcccagctaatttttgtatttttagtagagacggcgtttcaccatgttgkccacaatgatgtcgatctcttgacctcgtgatccacccacctcagcctctgaaagtgctgggattacaggcgtgagacatcgcgcctggcctttttttttttttttgagatggagtctcgctcttgttgcccaggctggaatgcaatggcacaatcttggctcaccacaacctccacctcccaggttcaagggattctcctgcctcagcctcccgaatagctgggattacaggcatgcaccaccacacccggctaattttgtatttttagtagagacagtttctccgtattggtcaggctggtctcgaactcctgacctcaggtgattcacccgcctcggcttcccaaagtgctgggattacagaggtaagccactgcacccagccgtattactcttttaagaaattacagactttggatattccactttaccttcttggaaatgtccctcytgggcccttctcgctgctcccatctggaytggaggcttctccctgtggarcagagtcactgtcctaggatctccctccaccgccatctggggcagtgctttacatgcagtggagccacctggggtccagccaaaatgcagactgattcaagatgtcaaggctgaggcatatgagcctttctgtctagtttcatgagatgctgattctcctggttcgtgtgtgtgtgtgtgtgtagagagagagagagagaaagggaattttgctctgtcagccaggctggagtgcagtggtgccatcatggcttactacaggctcaacctcataggctcaagtgaccctcctacctcatcttcctaggtagtcaggaccacaggccacatcctaatatatttttaattaactgatgcagtttctttctaaattagtaagagggctgagcattttttcattgtggcaaaaaatacacataaaatttactatcataactatttttaagaatacagtaccattggccaggtgtggtggctcatgcctgtaatcccagcaatttgggaggctaaggcaggaggatcactggaggcctacagttcaagtcaggcttggggaaagtagtgagaccctgtctccagccaaaaaaaaaaaattaaattaaaatatactgtactataatagtgttaattgtaagcacagtgtagtgcaaccgatctttagaatatttcaccttgaaagctgaaactctgtgcccctttcacaaaaatccttattacctggaagttttacctggcagccaccattctaccttcacattcatcaagtttgactgttttagacacctcatgtaaatggaattatgcagtacttggagttttttttttttttttgattggcatatttcacttagcaatgactttaaggttcatatacgttgtagcatatagcaagattttcttcttttaaatgttgaataatattccattgtctgtatataatcatattttcttgatctattcatctgttggtaaacatataggttgcttccatatcttgcctgttgtgaataacaccattatgaatayggatatgcaatctttcttttcacttttgtatcccccctcattttggtgcaactaatcttctagtagcttttcctgaaagcacgtgcttaaagtacatttgtgtgtttcaacatatctactatcattttgcctctctccaggaagaggaaagaaatgtattaaggtgctctttggcacagcatttaatggtaaagaaagaaacagtataactggccrgtgctgggtttcagcatcctgcaatttcagaactactgtgaatacaaaagaaagaaaggtcctgcccaggatgggagtcactcctatatatggtggccctgggacagcagacctttcctgtcacacctcttccatgagggcccttacttcagtgactgtggtgctttccttctctctatggtcyatctatctatctatccagttggttgggtttctctggagaaccctaatataccaatggacagtaagcaaataaaacctagtattaccactaattgccattgagaaaaatatgcctaggccagaagattggtgatggtgggaatagcagggacatagtttagacaaggtcattgagcaagacgtttctgagaacttgaccactggttatctgagaagagacctgaatcgtgtgaggagtgagtcatgtgaatccctggggagcaggtacatgtgggagtcagagcatgggtaggtggcagaaatagggcagagcastgacaagaggctggtgtgagtggagacaagtgagctgggckgagaggagtgggatgagcccagagttgacagaggggccctgtgttgaggggcttstaggaaatggtgagacattggggtttcattgcactaagaggggaagaagctagagtggctttgggatgtggtggtgatgatgtgcyctaattcccgtttgaaaggtttactctacctgttgtgtgggtgatggacagcggcgtgaatgtctcttcatgtccattacccatttttgaatggcgttgtttttttaatggatgagttgtagttttttatgtattttgaatattaattcttcatcagatrtatgattggcaaatagctcctcccattctgtgcattttctttccactcttttaataatgtcacttgttgcaaaaaagtttttaaatctgataaagtctaatttatcatttttctttaattgctcatgctttgggtcatccagccaagaaactactaccaaatccaatgttcacaagactttcctcaatgttttcttctaagggttttacaggtttgactcttaagcttcgttgtttgatacattctgagttaattgttgagtatggtgtagggaaggctatgaattgtgtccaacatcattcttttgcatgcggatatccagtttctcagcaccacttgttgcagcaccatctgtggaagtgaggctgacacatttgcaaaatgcattgagcactagtacaccatgcatttatttacttttctttactccacagttgttttgaggaggcttccagtgacaaacacaacagaaatgaaaatacatgaattcttataaaatcaatatcaagtagaattataaactttaaaatgttaagagtgaggcaaggctagatcattactagacaagctgaaacatagactgaaatggagggtttacggttttccttgctacaaattttgttggcccacaatctgtcatgcttactgcataagggagccagccacagggtgggttgatagctcacataaccagtccctggtttcctgcttcagaaacaagttcagattctctccacttacagtaaaaaagtgaattgcaggatgttcaaagtgaagttgacatctacaaagtcaacaaataagtagtaagtgtagacctcagaaatttaacaagattctactttttcccccaaaaaaatgtcctcacaatttcctgctgaaaggagagggttcattcaggggaccacatgatgccgttcttctgctgcagttctaaattaagttgtccttccctctaactacaggtctcacaaacccttgcagccagcttcaatgattttagcttgactaaggttttgggtttttgatattgtttgtatttgagctgcagcctggggcttagaaatgtgacttgggtattttgccaaaatggtatgtttttctatagaatttgacgttgtggagaccctgcttttctgccaggtccccagaggggatacagtgctttgtacctctttttagtacttcattagcagtgatagaagatttggagtgagggcctccctcaatctctaccctctgcctagtgcagaggatcatggactgttgcagttatggcaacaaaaaatttctccagacatagctcctgtcctctggtgggaaaatctcccctggatgagaacactagtttgagaggtagagacactcaggagctgggcttggacaggggaagggaagaggagacagacacaaaacggagtggggctgggaaacaggcaaagggagttcaggcctggagggacctggcctgatgaggcacatgaggaatggggagagtggcaggatctcctattgccagaaaatcgtacttgtacccactgcattcccagccctggtgtatgcatctctrggaaatcagaatgaatttggctattatggtgtcagaaagagccctgaagagcctcgtgtgcctgtcaatgtaatgaaagtgcaggtgacagcccctcctggaaatattgttgccaaatgtttaacccagatctgcctcggtctttaggaaacacagcagagagaagagcaaagtaaaaggcatcaggggaamtaatatgataaattcggtgtggagagcatgctaaagttatttggcctgcaataagtaatgctgttctaaaagaaaaaaggattagtggattgttgtagattacaggtaactaaaggacacataatcaaaggcaatgagtggatattttatggaaccaagttataaaaatgtacaaagaatagattgaagaagtgaagatacttgaatatgaaaggactttagataatatggaattattgtttattttctttggtgtgataatgtaggtttttactcttaggagatgcacgatgaggtgtttagtggtgaaatatcatgggtctagcaagttactttagaatggttcagtcaaaaatcttagtctcttcattctgtctctcttcatacatacacacacacatacactcacatatacacactatacaaacacatayagctgaagcagcataaaacctagtttctagtagagggatgcaaaaagggaggagaattggtaagttagagttttttggcaaaggactgacaatgcgccacatggataggacttctattccgctagctggtgctgttgaccttgaaactccatgtgcactccagaccaagggcagagagagatgctcactgtggcgggtaggggggatgtgytcctagaaaatcacaatgacattcccctgagctatatccctggttactacagcatttcctgatcttgcctaacaggattacttccctgaactgtaaaattcctgcagcattgtatacagagaaagaataggagacatggcaatcatggacaagaaaggaggaaatcgtgataggaaagttagagatcctgttgccaacacccagtcaggcattcggaggctggggtcagtctagaagcctttcataatgccacgtggtagctccatccagaaatcctcagttgctccctgacttcttccagccccaggtgatggctagatcctccatgaaaggaaactggttcaaacacggccaatatgcccagcaacccatgggtaatgggggattctccatgttctccccaggaagcctgtctcccgtcttgtaatgctgggagccacactaatcatttttaaatggctgaaggggacccagtatttggtttgatttgattctaaaaatggaggccaagagcctcaaaataaaaaaacagagtggaggtctgctcctgtactcaccattctgatgaatgtaccttgggatcctgaatgagcaccaaaaataaagcagcacctttgtctggggtgatacctgagatgcattgcctcatgccaagaaaattaaggacacagacacacacaaggagtgagtttaggagtagaggtttaataggcaaaagaaaagaaagagaaagaagaatagctctctctcctgtgagagaaggggcacgcaagtgggaaytccagcccatggcagagtgcactggattttatacacaggctgaaagaggtgtctgatttgcacagggcccacagattggttggaccaggtgtgatgtttacatagtgcatggggaagctgaccaccccaccctaatcttcttatgcaaataggctttccacttggctgacaccatgttgtctgctccctgctgcacacgtggttggaaaggaaaagwgaagatggagccgccatttgaacatgcctagtcccaggtagccttttcctattggcacaactgctggcattcactcaggcaagcttccagcttgcttgtctatgtctgcagctcaattttacaggctgctctttgttagaaagaaaatgatttgggggctgcttttcattaaaaggaaaaccttaccaaggacttctttactctcactatctgcctaaataatttctttttaactcctctatcagttacaaaatcagttttaaagcacatactgttctgtgatattgggatatctggacattttgttgtcataggagtttatccttgcaggtattaccaaactgcttccttagctatcaacatcctaggaccatgggtcatgacaagcaaggaatgtaccctgctagtttaaagataaacttgatttgcggggagggggtggtttttagttacatgggtaagttcttttgtggtggtttctgagattttggtgcatccatcatctgaggagtgtacatgtacccaatgtgtagtcttttctcccgcaccatcctatgaccctaccctctgagtccccaacgttcattatatcattcttttgcctttgcatgcccatataagtgagaacacatgacatttagatttcaattcctgaattacttctcttagaataatggcctccaacgtcrttcaggctgctgcaattgccgttatttcacttctttttgtggctgagtagcattctacggtatatatatatatacaccacattttcttttttttaattacactttttattttgaggtaatcatagatccacatgtaactgtaagaaatagtaaagagggcaggcatggtggctcasgyctgtaatcccagcactttgggaggtggagagagcaggatcacttgagaccaggagctcaagaccaacctgggcaacacagcaagaccctgtgtcttaccaataaaataataataataatawagagaaatgtcatacattctttacccattattcttcaatgacatgttacaaactacagcataatatcacaagggacactgacattgatatggtcaagacacagaacagttctaccaccacaaggagccctcatgttacccttttataatcacactgacctttccccgcttccatgcctaaccsctggcaaccactaayatattctctacttctattaaacttgtcatttcaagaaagtgatatgaatggaatcatgcagtatgtgttcttttgatattggctttttttttcactcagcrtgattccctaaagattcaaggattcatttacattcttggatgtatctatcaatagattgttggtttttttgtttttttkttgttgttttttttaattatactttaggctctagggtacatgtgcacaacgtgcaggtttgttacatatgtatacatgtgccatgttggtgttctgcacccattaactcttcatttacattaggtatttctcctaatgctttccctccccmctcttccctcccccaaccccacgacaggccccagtgtgtgatgttctccaccccgtgtccaggtgttctcattgttcaattcccacctatgagtgagaatatgcggcgttcagttttctgtccttgtgatagtttgctcagaatgatggtttccagcttcatccatgtccctacaaaggacataaactcatcctttttatggctgcacagtattccacgatatacaccacattttcaktttccactcattgattgacggacatttgggctggttccatatttttgcaactgtgaattgtgctgctataaacatgtgtgtgcaagtatctttttcatataatgacttcttttcctctggtacatacccagtagtaggattgctggataaaattgtaaatctacttttagttccctaaggaatctccatactgttttctatagtgattgtactagtttacattcctgccagctgtgtaaaagtgttccctttttaccacatccacaccaacacctattatttttttatttttcaattatggccactattrcagaagtaaggtggtattgcattgtggttttcactggcatttccctgataattagggatgctgagcatttttttatgtttgctggccatttgtatatcctcttttgagaattttctattcctgtacttagccttctttttgatgggattattcattttcctcttgctgatttgttwgagttccttgtagattctggacatcagtcctttgtcaaatgcatagtttgtgtatatgttctccctctctatgggtcgtctgttaactctgttgattatttcttttgctatgcggaggcttttttgctgaattaggtcccatgaatttatttttgtttttgttgcatttgcttttgggttcttgctcatgaagtcattgcctaaaccaatgtctagaagggttttgttcagtgttatcttctagaatttttatggtttcaggtcttagatttaagtctttgatccatcttgagttaatttttgtatacggtgagacataggatccagtttcattcttctacatgtgagttgccaattatcccagcaacatttgttgaatagggtgtcatttccccactttatgttttcatttcctttgtcagagatcagttgactgtaagtatttggttttatttctgggttctctattctgtttcattggtctacatgagtctttagggttttctagctgtacaatcatatcatcagcaaacagcaacagtttgactttctctttgccaattcggatgccctttatttctttctcttgtctgattgctctggctagaactttcaatacaatgttgaagacaagtggtgaaagtggacatccttaccttgtttcagttatcgggggaatgatttctaatttccctcattcaatataatgttgcctgtaggtttgtcataaatggcttttactaccttcaggtatgttccttgtatgccaactttgttgaagcttttaatcataaagcaatgctggattttgtaaaatgtttgtcaaatgttttttgtgcrtggttaatactaagtgtcaacttgatttggattgaaggatacaaagtattgatcctcggtgtgtctatgagggtgttgccaaaagagattaacatttgagacagtgggctggggaaggcagatccacccttaatctggtgggcacagtctaatcagctgccatttaacataaagcaaacagaaaaacaagaaaaggagagacactggcctagcctcccagcctacatctttctcccatgctggatgcttcctgcccttgaacattggactccaagttcttcccttttgggactcaggctggctctccttgctcctcagcttgcagacagcctattatgtgaccctgtgattgtgtaagttagtactcaataagcatatatatatattatatattatatatgttttatatatattatatattatatatgttttatatataatatatattataatatatattattctattattatattattctgttaatattaaatactaacataatatatattatatataaaataatatatatataacgtactaacttacattttgtgtgtgtgtgtatatatatattctatatatatattctatgtatatattctatatatatcctatgtatatatcctatatatatatcctatatatatatcctatatatatatcctatatatatatatcctatatgtatatcctatatatatcctatatgtatatcctatatgtatatcctatatatatatactatatgtatatcctatatgtatatcctatatgtatatcctatatatatatcctatatgtatatcctatatatatatatcctatatgtatattctatatatatattctatatatatattctatatatatattctatatatattctatatatatattctatatatatactatatatattctatatatatagtatatatattctatatgtatatattctatatatattctatatacatatattctatatatatattctatatatattctatatatatattctgtatatatatattctgtatatatatattctatatatatattctatatacatatatattctatatatatatattctatatacatatatattctatatatatattctatatacatatatattctatatatatattctatatacatatatattctatatatatatattctatatacatattctatatatatatactatatatatattctatatatatattctatatatatattctatatatatatattctatatatatattctatatatatattctatatatatattctatatatatattcttatatatatattctatatatatattctatatatatattctatatgtatattctatatatatattctatatgtatattctatatatatattctatatgtatattctatatatatattctatatgtatatattctatatatatatatatatattctatatatatatattctattagttctgtccctctagaaaacctgactaatacagattttggtaacaggagtggttctagaggaacagaatattaaggatggagttcttttgttagtttaggggtttctggagttggttgcttaatatgattagacccaaaaatgctaaggactctacttctaatagtgtggagaatgctgatagtccctggcatgaactgtttagagagtaacgcaaaataaatgcatttcacactattcactgctcctgagaggcaagtttagtgactctaacctaataattttgaccatatgtagagaaccaaggaacataatgaagctggttggttgctcctaagttcagtggacaaagtgataaaagaagataatgaactcagggattctgtctcccagcttcagaagcagatactgagcytcaaatctgctaagattgccccatgagtgacagtcttatctcctgtagagaaagagctgaaattgtggaaaaacagacaaaagctcctatcatgtgagtagctgacctgcgatgaaagatgcatacacagcctcaccaagtgtctactgttaaagtgagggcattgatcagaaaagaatgagaccctgcaacttggaatggggatatgtgggaggatcctaatgaagctggggacactaagtgtgtaaattatgatgaaactttttttgctagaagaatcagcttccccgtccctagtattggcaacatcccctccccagcccatgctgtcatcagcctttccacctttatctgagaagacaaaccctgcactgcctgaggcaacagtgatggcctgccctgaagcagttgccaggcaagataatgttgattctcctcaggagccacccctaacacctctgtttgcttctagacctatgactagactaaagtcccagcggtcccctagaggtgaggttgagagtgtgacccatgaggaggtgcactacactcaaaaagagctgtttcagttttctartttatrtcaatagaaatgtrgagaacaggcatgggaatggrtattacaggtatgggataatggtgaaaggaacatasagttggataaggctgaatttattgatttgggccattaagtaaggactctgcttttaatgttgcagctcggggagttaaagaaggtygtaatagtttattttcttggttagctgaaatatggattaaaagrtggcccactgtgagcaagctggaaatgtctgatctcccttggtttaatgtagaggaaggaattaaaaagcttagggagattgggatggtggaatggattagtcagtttagacytactcatcccaactgggaaggtctagaagatttacccttgaccagtgccttgtgaaataggtttgtgagggcagcacctgcatctttgaagagccctgtaattgctcttctctgcatgtcagagctaacagtgggaatcacagtactcaactataaaatttaaatacaatgggaataattggatcccgaggtgtcaggggccaagtggcagcattcaaccatcaaaggcaaggtgagtgtagctaccataatggacagcagaggcaaagtggcagtcataatagtccaactcatgcagagctctggcattggctaattaatcatggtgttcctaggaatgaaattgataggaagcctacttcattcctacttaatttatacaagcagaaaacttctatgtgcaatggacaaaagactaattttaatcataaaaacaaagaatcatggcccctcagtcaatttccagacttgagccagtttacagacccagaaccccttgaatgaaaaggaagctgggtctccttgaagaaggaccccactacattactgacaatttatgcagtgaatcttcttccatccttctgtgaggagacctccagccttttaccagggtaactgtgcactggggagaggaaaatgattagatatttcaggaatacaggacactggctctgagctgacattgattccagggaacccaaaacatcattgtggccctccagttaaagtaggagcttatggagttcaggtaattaatggagttttagctcaggtctgacttacaatgggtacaatgaatccccagactcatcctgtggtcatttccccacttaatgcattttcccaattaattttcccaattaatgcatcatttccccaatgcaatttccccaattaatgcataattggcataggaatagttagcagctggcagaacccccacactggcatgctgactggtagagtgagggatattatggtgggataggccaaatggaagccatcggagctgcctttacctggaaaaatagtaaatcaacaatgtcacatccctggaggtacagaggagattagtgccaccatgaagaacttaaaagacacaggggtggtgattcaaatcacatccccattcaactctcccaaatggcctgtgcagaagacagacagatcttggagaatgacagtggattattgtaagcttaaccaagtggtgacgactccaactgcagctgctgcaccagatgtggtttcattgcttgagcaaattaacacatctcctggtacctggtatgcagccattgacttggcaaatgcctttttctccattcctgtccataaggcccacaagaaacaatttgccttcagctgcaacaatatgcgtttactgtcctgcctcaggggtatatcaacaatccagctttgtgtcataatctgattcaaagaaaccttgatcactttccgcttctgcaagatatcacactggtccattaccttaatgacattgtgctgattggatccggtgagcaaaaagtagcaaacacactgsacttattgatgagacatttgcgtgccagaggataggaaataaatctgactaaaattcagggaccttctacctcagtaaaattctaggggtccaatggtgtgggacctgccaagatattccttctaaggtgaagaataagttgctgcatttggctcctcctacaaccaagaaagaggcacaatgcctagtgggccgatttggattttggaggcaacacattcctcatttgggtatrttactcyrgcccatttatcaagtgacctgaaaggctgccagttttgggtagggtacagaacaggagaaggctctgcaacatgtccaggctgctgtgcaagctgctctgccctttgggctatatgacccagcaaacccaatgatgtttgaggtgtcagtggyagatagggatgctrttggagcctttggcaggcccacatagttgartcacagcagaggcctccaggattttggagcaaggccctgccatcttctgcagataactactctcctttyragagacagctcttagcctgttactgggctttggtagaaactgaacatttgactatgggtcatcaagtcaccatgcaacctgaactgcctatcatgaactggatgctttgtgactaatctagccataaagtgggtcatgcacagcagcattccatcatcaaatggaagtggcatgtacatgatcgggctcaagcagatcccgaaggcacaagtaaggtacatgaggaagtggctcagatgcccagggtctccactcctgccaccctgctttctcttcctcagcctgcaccgatggcctcatgaggagttccctatgatcagttgacagaggaacagaagaatagggccttgttcacagattgttctgcaygatatggaggyaccacccaaaagtggacagctgcagcactacagcccctttctaggacatccctgaagggcagcagtgaaaggaaatcttcytagtgagcagttcacctggttgtgcagtttgcatggaatgagaaatagccagatgtgcgattatatactgattcatrggctgtagccaatggtttggctggagggtcagggacttggaagaarcatgattggaaaattggtgacaaagaaatttggggaagaggtttgtggatggacctctctggtcaaaacccacaaagwtatttgtatcccatgtgagtgcccaccaatgggtgatctaagcagaggaggattttaataatcaaataggatgaccygttctgtggacaccactcagtctgttttcccagccactyctgtcatcgcccaatgggccaatgaacaaagtggctatggcagtagggatggagggtatacataggcttagcaacatagactttcactcaccaaggctgayctggctayggccacttctgagtgcccaatttgccagcagcagagaccaacactgagctctcaatatgacaccwttccttgggcgatcagccagctacctggtgacaggttgattattggacctcttccattatggaaagggcagaagtttgtcttcactggaatagacacttactccggatatgggtttgcctatcctgcatgcaatgcttctgccaagactaccatcatggagtcacagaatrccttgtccacccttatggtattccacacagcattgcctctaaccaaggcactcacttcatggctaaagaagtgcagcagtgggctcatgctcatggaattcactggtcttaccatgttctccatcctgaagcagctggattgatagaatggtgtaatgaccttttgaagtcacaataacaatgccaactaggtgacgatactttgcagggctggggcaaagttctccrgaagactgtgtatgctctgaatcagcatccaatataggatagtgtttctcccatagccagaattctcgagtacaggaatcaaggattggaagtggcagcactcaccatcacccctagtgacccactagcaaaatttttgcttcctgctcccacaacattatgttctgctggcctagaggtcttagttccagagggaggaatgctgccaccaggagacacaacatcgatttcattaaactagaagttaagattgccacctggatactttgggctcctcctacatttaagtcaacaggctatgaagggagttacagtgttggctggcgtgattgacctggactatcaagatgaaatcagtctactactccacaacagaggtaaggaagagtatgcatggaatacaggcgatccattaggatgcctcttagtattaccatgccctgtgattaaggtcaatgggaaactacaacagcccgatccgggcaggactacaaatggcccagatccctcaggaatgtaggtttgggtcactccaccaggaaaaaaaaacacaacctgctgaggtgcttgctgaaggcaaagggaatacagaatgggtagtagaagaaggtagtcatcaataccagctatgcccacgtgaccacctgcagaaacagggactgcaatggtcatgaatatttcctccttcttttgctaaaagtcatgtttgtgcatgtatacacttggactaagaaaatacctttattttatttccttttcctttatcatgtgacataagatttattgacttcatgtcagcatttaagttttattaactttatgtaatagtacttggggattggtgcgtttctggttgtacgaaggatcattgtattatgttggtgtaattatgaccttattattgtctttgtttgaagattatgtatgatctcaggagatgagtatgggttcaagttgacaaggggtggacttgtgatggttaatactgagtgtcagcttgattaaattgaatgatacaaagtattgatcctgggtgtgtctatgagggtattgccaaaagagattaacatttgagacagtggaccagggaaggcagatccattcttaatctggtgggcacagtctaatcagctgccagcaaatataaagcaagaagaaaaayttgaaaaggagagagactggcctagcctcccagcctacatctttctcccatgctggatgcttcctgccctcgaacatcagattccaagttcttcagttttgagactcgaactggctctcctttctcctcagcttgcagacagcctattgtgtgaacttgtgattgtgtaaattaatacttaataaactcttatatatatatatacacacacacacgtatatgtgctattagttctgttcctctagagaaccgtgactaatacatgtatctatygagataacaatattatttttgtttttcattctgtttatgtgatgtatcacatttattgacttgcgtatgttaaaccatccctgcatccctggtatgaaacccacttgatcatggtggattatctttttgatatgctgttggatggattaaccagtattttgttgagaatttttgcatctatgtttattagggatattggtgtgtagtttacttttttggttatgtcttttcctgcttttggcttcatagaatgatttagggaggatgccstctttaccttttgaaatagtttcagtaagattgagaccaattcktctttgaatgtctgatggaattcagctgtgaattcatctggtcctggactttttttggttggcaatttttttttattgctctttcaatcttgctacttgttattggtctgttcagtttctgttttttcctgatttaatctggagggttgtatatttccaggaatttatcaatatcaatctattctagattttctagtttgtgtgtgtaaaggtattcatggtagccttgaatttctgtggtatcagttgtaatatatcctgtttcatttctacttcagctcgtttgggtcttttcttctcttggttaatttcactaatggtctatcaattgcttatcttttcaaagaaccagctttttgtttcatttatcatttttcatgcttcaattttatttagttctgctcagatctttgttattttatttcttatgctgggtttgagtttggtttgttcttgtttctctagttccttgaggtttgaccttagattgtctttttgtgctctttcagacattttcatgtaggcatttaatgctatgaactttcgtcttagtacttcttttgctgtattccagggttttaatargttgtgtcactattatcattcagttcaaagaatttttaaatttccatcttgattttaatgttgactcaaagatcaytgaagagcaagttatttaatttccatgtattcacacagttttgagggttcctttggagttaatttccagtttcagtccactgtggtctgagagagtacttgatataattttgattttcttaaatgtattgagacttactttgtgacctatcatatggtctaccttggagaatgttccatgtgataatgacaaaaatgtatattctgcagttgttgggtagaatgttctgtaaatatctgttaagtccatttgttctagggtatagtttaagtccattttgtctttgttgactttcttgatgacctgtctagtgctgtcagtgaagtattgaagtcccccactattattgtgttgccacctatctcatttattagatccagtaataattgttttataaatttggaacccctagtgttaggtgcatatatattaaggattgtgatactttcctgttagactaatccttttgtcattatatagtgttcctctttgtctttttytttttaaactgttgttgctttaaaggctgttttgtctgatataacaatagctactcctgctcacttttggcttccatttgcatgaaatatttccacccctttaccttcagtttatgtgagtccttatgtgttaggcattctcttgaagacagcagatactcgattggtggatttttacccattctgccaatctgtatcttttaagtggagcatttagattattgacattcaacattagcattgagatgtgaggtactattttattcatcatgcaggttgttgccttaataccttgttttttccatttcatagtgttgttgaagagtgatggctaaatgtatccagcataaytcrcctacacttagttttctagataattgagttgggtggccccattttaataatgacaaacatgaaattctaaatgcaatatcatcttggagagattatttgattttttcctataggaattgtctccaaactgctttctagacagcctcacaaagcatctagaatgtataaatttgactttcataatgcattaatgatatggtttggctgtgttcccacccaaatctcatcttgaattgtagttcccataattcccatgtgtcatgggagaaatgtagtgggagttaattgaatcatgggggcagatcccccatgctgttctcatgatagagtgactctcatgaaatctgatgcttttataagcatctgacatttcccctgattacactaattctctcttctgctgccatgtgacaaggtgccttctgccatgattataagtttcctaaggcctccccagcaatgcggaactgtaagtcaattaaacctctgttgtttataaattacccagcctcaggtatttcttcatagcagtgtgagaatggactaatacagtaaattagtaccaggagtggggtgctactataaagatacccaggaatgtggaagtgactttggaactgggtaacaagcagaggttgggacaggttagagggctcagaagaagacatgaacatgtgggaaagtttggaacttcctagagactcagagggctccgaagacaggaagatatgggaaagcttgaaacttcctagagacttgttgaatggttttgaccaaaatgctgatagtaatatggacaatgaagtccaggctgaggtggcctcagatggagatgagaaacttgttgggagctggaataaaggtgattcttgctacgctttagcaatgagactggcagcattttkcccctgccctagagatatgtggaactttgaacttgagagagatgatttagtgtatctgccagaagaaatttctaagcagcaaagtgttcaagaggaagcagagcataaaagtttgaaaaattcgcatcctgatgatgcaatagaaaataaaaacccattttctggagagaaattcaagcccactgcagaaatttgcatcagtaagggggagctcaatgtcaatcaccatgacaatggggaaaatatctccagggaatgtcagagactttcacagcaacctctcccatcacaagcccagaggtcatccttaagtgaaaaaatcaaccacaggagatgacatgataataggcttattacagtagaggaaggtacaaagtgtttctcatcattggtgtgtttgttaaaatggggaggggttactgagtgagtgggcagtgggtggtggtggtgacaaccacattctctcactgtggcccaacacttttgaagcagtttcccatttctccattagatgtgtcttctccacatgcagaaaatgtagtctcatagcttccctattgggtgctggactgttggcatttcattattttttttaaatcaaagacatggatatcttttttcttagttgatttctaggacttcaaggttatttgggggaagaagttgcttgaggagkctcctgggtggaccayrgagtccctcctagggatttatttggtgcycctggtgtgrgtgactatctccctgagtcccaaaagacagcacattctgccgggtacccagaggtggggacagatgctaacagstccatcttataagtgcaacatgaaatttaaggtcagggaatctcttaacttttcttgaaggacctcatatttagcttcttgactcaaaatcatttgtggatttgaacaggtttcctctgcaatgtactctctggaggggaatacattgaaaatacagttcattttcagatactcaatgggattgaaaagttgaattgtgtgctttcttgcagtgagcacagaggaatttgctgtcccatgccactggracatttttaggagcaccattctcttccagagggcttgagtaaggtcagtgaggaattaacatgtagcatattggcaactccagggttgagcagggagacacacatgtttttctgatgtgtgaagttctgagggcattttccaaagtacttgttcactgagcaggtgtttccactacttkcattaagtcaggggatatggaagccacttttccagcaatcaaactcaatgagaagatgaacaagaagtgttctgaaagtaagcagaaaaggccctttccatgaattttcctaatttttagatttctcttaaacaacatgcctgaagttacaaccrcatccttctctagcagcttctaaatgagaaaatcatcaaaagggtatttagtactcaagtggtggacacaggataaatgctgaaaatcagtgctcgattcgaagatagtgatgttccaggatgttggagtctctcaggtgtcagtagggaggcgggccgggaacttctcccagtaaccagaaagaagagcctcagggagatgaggatgtctcacagccagggacgggacagtaaagggccccatgtgagtgcatcacagggatctgttcctgtttagactccaatgctcagtacccagtgcagaacatggcaagacttcagcaaatacatcagtcagctggatgaaggaggmaggtgtgagccagcaaaaaaaagcttgtgattttattggagcatgaatttaaaagtgttgatgtggctgggygcggtggctcaygcctgtaatcccagcactttgggaggccgaggtgggtggatcacgaggtcaggagtacgagaccagcttgaccaacatggtaaaaccccatctctactaaaaatacaaaaattagccgggcatggtggcagacgcctgtaatcccagctacttgggaagctgaggcrgagaattgcttgaacccaggaggcggagattgcagtgagcygagatcatgccactgcactccagcctgsgtgacagagcgagactccatctcaaaaaaaaaaaagtgttgatgtacctaccttgcaaggaggtagataggtagacagaagcatggatagatggatggatattctttttctgtgtttttctatttctgttctttctctgtgttttgtctctttctcttgctctgtctgtatcttccactgttccttcataatcatgtcttagccatcatcagtgacatcttttatctggtcttataagatcttgtctgtctgttgtattagtagccacaggacagaaaaaggaaaggagtcgtgaaaaacaagataaggaaaaagatgctcctgacatggggcatcgggaggatgtgtggccctgaggctcccgggagacaggggctgcgcctcactgcagagtccatcctgctgaacacagaggggaaaagcgccctgacagccccgtccgtgctgctcagaaaagacggctccgtctccagatccttctctctatgtccttcagtcttggctctctaggtacaatttactgctatgaaaagggatttgagaattcccagaggagsctttcagcctctttgcatggctctttctggcctttcaaaagcgccagagacatcagaaatgaaatcgtacacacttattcggagttttccacaatcattgaaatttctgtgagtgccaaagttaagtttttggcaaccccgtcaaagccgggtgtgcccaggacagtcaactcaggcgctggactctcattctggttggattttatgacagccgtattcgccataagaattctagagccagaccttgttacttcacaattgcctcacgttgcaggacaagcaaatctagcctgagtcctgtggattccagggctgctcaggagacgcctccatcctggcgtggatgacctcaggatcagccccgtctgccccactcagcccgcagyctggtccccgaaagcgctcagtcagaatccgagagcastgtggcggcgcccccgtgtggccacaggactgaagacaraggaccccgctcccctttctccccagccaggacgtcccaggctctccccctgttccccgcacctggacgggactctgcacagaagagagtctcccggtctcgtgtcaggctctgagttcatccagcttcccaaaatccatgttgatatgaacgttttctcccacaactgattgactggacttttgtctcagggcagagggaggcctccagaccaaaacagcaggatcaggtctggagctgactcaaccccaaacccttgmtaatgcacgacccagtcccccagcctccaggatgggaccttggcctcctgtcccctcccttgttcctgccactgctcctgcaggtggaggctgctcatcccaggaatcagtctgtgagctccaaccttggggcctcggtccaggaaggagggaggctccagagagcagaagggagatgaaatggatcataagagaagaaggaatcayaccaaacactggaactgtaggtcaattaaacctttttctttataagggggggggaggaagaggaggaggaaaaaggaggagggtgaaaggagtcagggaggagagaaaagtgggaagtgtttctttagaaggggtgtgtgtgtgtgtgtgtgtgtgtgtgtgtgtgtgtaggtgtgtgtaaagcaggagggagttcctaggatcctgaagaaaagagagtgaaggacaggggctaaggggcccagccctggtaggttgagggccccactttctgtgctcgggccttactgtcctagcagagtccagccccgggaagcctggggtcacagcactcgkcttgctggatggctgcctcttcattgtctttgacagcaggagctaccttgccaggcccagtggccacagggtcacaggcagagagcaggtccctctgctggcagccaaggagatgctcttggaggatacgtgcacaacttagctgggagtctgaagatggtggtgggttacaaagagctcagcgatgarcctggcccaagattctgaccccttgccctggatcctgagggttccacccttycctattcccaacaggtctcaagaattcttctgttagtctcctgccctcttgggacagccccgcacttccctcactttgataccctggtacccaggcatctgyctccttcattctcctccagctacccaagcacccccaggccctgctctctgccaaccctgatccctgaactccagcactttccaaacccacccccgaattgctggataatatagtggttctatttttagattttytaaaactctccatactgtcttctatagtggctgtactaatttaaattcctatcaacagcgtayaagagttcccttttctccacatcaccagcatctgttattttattttattttatttattttatttttgtcttttcagttgtggctattctatctggggtaagatgacatctcattgtggttttgatttgcatttccctaatgattagtgatgttgaacatttttttatgtatctgttggccatttatattcttcttctgaaaaatatttattcatgccctttgcccactttttaataagattgtttggttttttaattcttgagtwgtttgagtttcttatagtattctggatattagtcccttgtcagataaattgtttgaaaatgttttctcctgttcagcagattgtctcttcactctgtcaattgttttatttgctatgcagaagcttttttagttattatagtcctatttgtctggttttatttgtgttttctatatttttgaagtcttagccataaaacctttgcccggaccactggcctagaatgtttcccctgttttcttccagttgttttatagtttcaggtctttcattttatttaagtcaacttgagttgatttttaatagggtgagagataagaatctaatttcattcttctgcatacgggatatccattttcccagcccttttactgaagagggtgtccttttcccaaatgtgtgttcttggcacctttgttaaaagtcagttggctgtaaatatatggatttatttctgcattctctattatgttccattgattggcatgtctgtttttatatcaataccattctgttttggatactatagccttgtaatgtattttaaagtcaagtagtgtgatggccctagctttgttctttttgctcargatttctttggctatttggactttttaaaaatgttttgggtccatagaaatattagaattattttttctaattctgtggaaaaataaccttggtatttttgttggaattcccttgaatctttagattgctttgggaactatggtcattttactaatattaattcttctgattcatgagcatggaatatctttccatttgtttgtgtcctcttctttctttcatcagtgttgtatagatttatttttaagagatctttgacttccttgcataaacttattcctaggcatttttttctagttatcgtaaatggaattgcttttttgatttctttctcagctacttcattaataatgtatagacattatactgatttttgtatgttgattttgcatcccacaactctactgaatttacttatcatatctaatagttctttgatggagtcttcagatttttctagaaataggatcatttcattggcagggaggggagagaggctgaaggttaagctgatggccaatgatttaatgaatcatgcctaagaaatatgacttccatcaaaacccaaaagggcagggtttggagagcttctggatagctgaacacagggaagctaacaggaggtgaacaagaactcagccatgtgccagagagggtggcgcatcccaaccccatgggacagaagctcctgcactggaaacccttctsaccttgccctatgtgtctgttcatggggctcwttgtgtcttttaaaatatctttttaaataaactggtaaatatatgtaagtgttttcctgagttctgtgagccattctagcaaattaatcaaacctgagaaacrggttatgggaacactgatttaaagcaagttagttagaaacacgggcaaaatggcttgagactggcatcaggagtgggaggcttgagactggcatcaggagtgggagggggacagtcatggggactgagctctcaacccatgggatgcratgctatctccagggaaagagtggcagaattcagttagaggacacccagctggtgtccatcacagaactgattgcttgtttgttggagaaattccctacatttggtcagagaagtcttctgtgttgatagttgttgtggtgtgagagyagtggaaaacaaygtgagattttccacactcagagtggatctaaatgttgagttgcttttaaatttgacttagtcgtggcctgactaaacaggattagatgtgagaaattttttggtataatgtataggaaggaactaaaggctgatgaggatgggagtgttggaatagatgttctgtgcatgagtacccccttcatcctctctgtctcccaagaaccaaaaaatactctctctgcagctttaacaaatactggtttggaagagagtgactgcgtttttcaaagttctaaatggctatgattgcaggacctttgtgatgctcaggaatgtcctgatgtcagcggagatgaaggaaaaccagagattcaaaagtcaaaggaaagggccatttaccataattcatatcatacatatttcctggaaaaaaaagaaaaattccttggggaaaaagcatcaaaatcatcaggaagtcttccacacagaaatgacttcattaatttgatctctgtcattctttcttttcattcatgtattattatccatagagatttctatcctgtgggttttttatttaatttttgtttgtttggttttttcagacacagtgagaccctgtctcaaacaaacaaacgtcacaggctgcagtgcagtggcacaatcattgctcactgcagcctcgacctccctgtctgaagcaatcctccagcctcagcctcatgagtagctgaaactacaggaacatgccaccatgcccaactaattttttaaaaaattttkttgtagagatgaggtrtcactatgttgccgaggctggtctcaaactcctgggttcaaacaattcacccaccytggctccccaraatgctgggattacaggcctgagccacgtacccagcctctatcccatgttttgattcatcatcatctcctaagccctttcccagcatcgatagtctactaaacatgccatgattaaattatatctctataccttgatataaacaaaaaattatatgagcagtaaagacaaatatgaaaaagtaaaattactgccaaagttrttaggaggataacctaaattatttgggtaggaaaatctttcttttttattttatttttttttccagccagggtctcattctgtcactcaggctaaattacagtggcccgatcatggctcactgcagccttgacctcccaagattcaggtgatcctcttgcctcagccccctgagtagctgagacaacaggcatgtgagacaatgcctggctcctttttatatttttagtagagatggggttttgccatgttacccaggctggtctcaaacttctaggctcaaacgatccacccacctcagcctcccaaagtgctggkattacaggcatgaggcactgtgccagccttttttttttttcacatctgctggaatggaaaatatttcttaaatgagacacaaatgtatcaaattgaaaatgtttaaacttcaaaggacttacatacatatacagtcattcttcgctcaatggtgagatagcttctgagaaatgagtccttaggtgattttgtcatgtgtggacatcatagagtgtccttacatgaacctagatggtataacctacttcacacytaggctacgtgataagcccattgcttctaggctacaaattatatagcatgttaccgtatggaacattgcagccaattctaacacaatggtaagtatttgtggatctaagcatgtgtaaacagagaaaaggtacagtaaaaatgtgattaayaaaaagatctttaaaatggcgtatctgtctaggacacttaccatgaatggagcttgcaggactagaagtgccctgggtgagtgagtgagtggtgagtgaatgtgaaggctagggcattactgtacactacttagactttataaacttaggctacactaaattgattttaacattktctttctttaataataaattaacttattaataattaactaataattttattatttatttattaacaattaataactaattaataattagttaccatagctttctgtraccttttgaacttttttgttttattattatactttaagttttagggtacatatgcacattgtgcaggttagttacatatgtatacatgtgccatgctggtgtgctgcacccattaactcgtcatttagcattaggtatatctcctaatgctatccctccccyttcctgccaccccacaacagtccccagagtgtgatgttccccttcctgtgtccatgtgttctcattgttcaattcccacttatgagtgagaacatgcggtgtttggtgttttgtccttgcgatagtttactaagaatgatgatttccaatttcatccgtgtccctacaaaggacatgaactcatccttttttatggttgcatagtattccatggtgtatatgtgccacattttcttaatccagtctatcattgttggacatttgggttggttccaagtctttactattgtgaatagtgccgcaataaacatacgtgtgcatgtgtctttatagcagcatgatttatagtcctttgggtatatacccagtaatgggatggctgggtcaaatggtatttctagttctagacccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgggttttgatttgcatttctctgatggccagtgatggtgagcattttctcatgtgttttttggctgcataaatgtcttcttttgagaagtgtctgttcatgtccttcgcccacttttttatggggttgtttgtttttttcttgtaaatttgtttgagttcattgtacattctggatattagccctttgtcagatgagtaggttgcgaaaattttctcccattttgtaggttgcctgttcactctggtggtagtttcttttgttgtgcagaagctctttagtttaattagatcccatttgtcaattttggcttttgttgccattgcttggtgttttagacatgaagtcctttataaactttttaaacttttctactcttttgtaatagcacttagcttaaaacgtcaacacrttatacagctctacaaaaatatttttctttatattcccattctagaagcttattcctatttaattatctttaccttttaatcttttttggtaaaaataaagacatacattagcataggctgacacagggtcaagaccaacaatatcaaccatcttcagccttcacatcttgtcccactggaagattttcaggtgtaataacacscatggagctgcatctcctrtgataacaatgccttcttctggaatacctcctaaaggacctggctgaggctgttttaatttttttatatatatagaaggagcacactctaaaataacaataaaaagtatagtaaatacataaaacatagcatagtcatttattatcattatgaagtrttatgtactgtgcatagctgtatatgctagactttttataggactggcagtgcagtaggtttgttgacagcagcatcaccacaaacacatgattaatgcatcrtactatgaggttatgatggcttcaatgtcactaggtgataggaatttttcaggtccattmaactctcatgggacgacagtcatatatgcaattcatcattgacccaaacatcattatacaatgcatgactctataacacagtggggkgtgtgtgtgtgtgtttgtattttgtgtgtaagattaacactgaaattgaggtatcaactaggcaccaaggtaaaaacatattaacttttcctgtgaggtgtcaaattaccccatgcagaatttgaaatgcaaacgaccattggaggcttagaggtcttcgggttcaaaccrtcagagaatagctcattttaaactcatcctccmacrgtaaacaagtataaaagtcacaaaaaacatacaatgcagttgtgcagccacaaaacagcaaccagcacaggactatcaccttttggagaatggaagttcctgaaagggagattcacatccttatcagctttctttccagaagcatttgccaaaatacaatgaagagaaatggaacccaagcagagaaaatcagtctcrtcggcaaaggaaacagagatcagagttcaggcttggcacattgactgggatttaggggtagggtgctgagggagggagttacagacaagaaacccccaaaatctgcactcctgagctgcatatgctccagatgacactctaagaagcccactggagaacagcttcttggagattgcatgctaagtagaaatgtcacaggctccatagtgtgaggagatgttggaatttcagccctgcaaaacctgygttgagacatcaggatggggaagccrygtaagtgaggaccgtgaccttggagtaagaaccacactgaaatagrctcaccctagcaaaggctaaaatcaagagkaagcagaatcaaagtgggtctgatttttactaaaggtgattctttgataattacctaactgtcaaactattaccagtctttggaggaagataacaaaacccagakcytctaaaatccatcatgtagaatatgtgccatgccaagcagcagagagaatgcagcaactaaagaagaaataatcaacagaagccaactcaaagaygatctgaatattgaagtcagcaaacaaggacattcttcaaaatatttatgattaatatgttaaggaaaatagaggaaaagatgggcaaactatttcaaaattcccagaaagattaatcataagaagagaraaaamacaaatgaacactatgagaagggacattataaaactgtagattttattaaaacaaaaataagagaaagttagacacaacttcatggaaagagcttttaaaatttaggtatagtgacatgagttcttgaaaaagacggttgaacaragccaacagaaaactaagtagaaaatataaataatcctatatccattmagaaattgagttctaaatacattccttcccaccagagaaactccatgcccagayttcttcacctgtcaattctttcaaaaactttttaaaaggcatgtcagccttatacagtcttcctctggtaccttttgggatgggttctagggcacctgtggataccaaaatccatggatgctcaggtcccatatataaaatagcctagtatttgcctattagctatgcacatcctcccatatactttaaatcatctctagattacttataattcctaatgcaatgtaaatkatttgtaaatagttgttacactgtattgcttaggaaataatgacaagaaaaatgtctrtacatcttcagtacagacmtaaccactgtaggtactcctaactacagagtatacatcagcarcaacataacattttcaatcctaaggttgttgaattcacagatgtggaactcacagacatgaaaggcagactgtgtgctatggtttgkctgtttgcccacccaaatctcatcttgaattgtagttatcataatccccacgcgttgttggagggactcgatgggagacaatttaatcawgggggtggttcccctcatgctgttctcatgatagtgtgttctcacaakacttcatggttttataaggggctttttctgcttcggtttggcacttctccttgttgctgccatgtgaggaaggatgtgtttgcttcctcttctgccatgattataagttwcctgaggcctccccagtcatgctgaactctgagtcaattaaacctctttccttttaaattgcccagtcttgagtatgtctttattagcagtatgataacagattaatacactgtcttatattttttagataataaagagtaaacaccttccaactaattttatgaggcaacataagtcagayaaggacctaaacatgacaattatattacaagaaaaataaactcatcatcraaatgatctgatgaacatagccwccaaaattccaattaaaatattagtaaatagaaccaaataatatatgaaatggataacacataatgaccaaatgggatttataagagaaatacatggtagatttaacttcaaaatgtcagaataatctaccccaaraatagagaaaagtaggacaacatgtggttatatcaatagatgcaggaaaaccatttgataaagttcagtaggcattcataataaaaactaaataaactagacataaaagggaacttccctaacagaatacagttatttacaacaaagaaatacaaagaaatacctaaatctaaagtcataattaaygaagaaatattaaacactcctctgaggtggggacaagagaaggatgtccactatcatcacttttatttaacattgtactgtgtgtccaacagcaaaaatagattacataagatatatgactgtcttcttcaaggaaaacattatcgtgtatgaagaaaatttaagaagctctatgaacagactattaaaaataagtgaatttggcaaggccagtataaagcaaaaagtaacatttctatacgtgagtaataaacagtgagaagaactgacattctttaaatagctctatgtacaataccacaaagaaacataaattgtagaaataaatataaaagttatacaaaatctcatcattcagaattacaaaacattgctgagacaaattaagtggatagttatttcatatatatgargaagacaatattgctaagataccgtttatccacaaagtgatccatggagtcaatgcaattgtaataaaactcccaasagttttttttgtgggaattgacatgctycttctaaaatgtatacaaaaatgtgaggagcttaaaatagccagaacaatattggaagagaacacaattggaggacttaaactatcagatatcaacagatatttgaaagccayagtgattagaaaagtgaagtatttgttcagggataaacaaacaggaaaaaattattaaaatagagccctctctattttcttctatgagttttataatttagcccttacatgtaggtctctgatccattttgtgttgatttatacatatgctgtgaggtagggtttcaacttctttgttttttttcttttgcagagacagtgtctgtgtcacccaggctabagtgcagtggtgcaatcagagctcatggtaaccttgaactcctgggyccaagcaattctcctgtctcagcccctcaaaatgctgagattgcaggtggagtcaccacttccagcccctcaacttcatcctttagaatgtgggcatccaggtgcccagctccattagatgaagagtgtatactttaacacattgagttgtcttaacacctttactgaggttctttgcatatatctctttatgtgtctctgagctgttgtctagkgccctttcattttaatctgaatgactcacattagtatttcttataggaaaaatctactggcaatggaatctktcagttagttgttaattaactrgaaacatctcaatttctccttcatttattttaatttattaattgtgataaaatgcacataasataaaatttaccatcttaaccatttgtagtrgtagtgttcagtagtgctaagaacaytcacactgttttgcaaaccaatctccagaactcctttcatattgcaaaactgcatattttcatttttgaagaataagtyttctagatatagaacttttggttgacagctttatttttgtagcactttaaacatgtcataccaytctgacwttcctcagtgttttctggtatgaaattggctgttaatctcaatgaggwtcccttgtacatgatgcattatttgtttcttgctgctgtccaagttctctctgcttctatttcaacagtttggttataatgtttcttggtttggatgtctttgagtttattctgcttggtagattcacagatttttatcaactttggcaaggtttcacctgttaccctatatttttactctctctttctatctctcctctactttgggaactcccattatgcatctgtcagtccacttgatgctgtacagaggtgtcatagcctctgatcatttccctttatttttttttcttccygctcttcagattgcataatcgtaattggcctatcttcaatttgctggttcttctgcctgctaaactctgcatatattagtcagcatggcrgtgtcccacaagtcccttaggctctgttcactattttttgttccttttttcatttctattyctcaaagtctatgatttaagatgacttggcttcgagtttgctgattctttcttctacctgttcaagtctgctattgaacatctctaatgaattttttttcagtaattatattttcccttctagaattgctgtttccttattatatttttaatgagtctttatttggtgagatattgttcttctggttcctttacatatatacatatatatatatacacacacacacatatatgtgtatatatatacatatatatatatatttacatatatagagagagagtccacggtcttttttatctatttgagcatatttaaactattggtttaaagtcttggtctagtaagtccaatgacttggcttccttagggacaggttctgctgatgtatttttttctgcaaatgggccactttcttaaacttytaaatacctcaagaattttcrctgaaaactgaacactttgaatacaacaatctagtaactctggataccatattctttccactccccagagtttcttgttgccacttgaggatggagttgtttcttagtgacttttctaaactattgttaagctgttctwtgtcatgtgtggtcactaaaatctattctgttagcttcatggtcagctagtgatttgacagaggtttccttaaacagctggagccaaaaaaataaataattaatgccctcccaggytttgcagatggactctgagttgggacacttcttcaacacttaaccaggcagtttagacgtccaccttaaccttcactggctgcttacttggaggctaaagatcacccagaggtaaaagcctaaggtcatctcaggtctttttaaagartgtgggcatccagggctaaatatccagtgtttagccctggccatgtatgtgacattctgatttcctcagtatatgcgggatattttgaaagccatattgccttatgtatctccatctccagcctctacctccctaggcttttcagtctgtctgctgttaacccatccatcattccatgccccaggcatctgtgactagtatttgcctttaaatgcttttgacaaacattgctatggagacctctccaatcttaataaagttccaagaggagtgaagcaaagaccagcctctaagctgatctttttgggggctatcatrcatgtcaaaggacacaaacacaattctttgaaaagaaagttcattttgccttttctggcatcaggaaactacaccaggaatgtgggacaccgtccccatggctgcctcatagctgagggtgtgggggtgggagtgagtaggtggctaaggaatagtggcacatgctctcctaccaaaatctagagctcctttttcattaagcactactttggttgttgtaaaaaaaaaaaaaaaattcatagactccagagtacagaaaaacttaattttgatagtttttttccaggttaatagttgctttagttggggaatgtgttgttggagttctctaccatttttggtgaaggcattacagttgtcttttaataagattttaaaattatgaaaaaatcttatgtatctacccatgtgcttaccatttctggtgctcttcattacatatttgcttttggtataattttctttttgcctgaaggactgaaacayttattacagttcgtgtctgctggttatgtattttttcactccctataagtctaaaatccctttttttatagatatctttagagtctgttaagtagcttgatgcaatcattacacatggtatacatatatcagtacatcacacagtacctcatgaatgtattattatatgtcaattaaaattatacatatatatatgtttttaaaaggttttttttctggaaatagaatctagtttgacagcagttgtctttcagaactttagcgatgttgstcatctgtccctcatttgcattgtttccaatgaaataactgctgtcatctttattattcttcttatgtgttgtgttttgtgtttttcatttttgctttctgctttttcaattttctctccttctctggttttgaacaaatacrtgttactctcactcacaactataaagcgaacttaggaaacaatctatagggagagtttgttgatgattggttatacattttcagaaacagttgtttattccttcctttacaaaggctaatttccttagaatattattgtattgaagaatgtcataaataattttatttgtcacctggacctggtgccaagatacgtggtcaagcattattctggatgatytttttaggatgtttcttggatatgattaacatataaattgctatactttgagtaaagtagattgacctctataatgtggacaggcttcattcaattcattgaaggtgtaaattgaatgaaacactgaccttccccaagcaagatggaattctgtcctgggatttgaactgcagtatcagtcasctgacccataaagagctggttggtttgtgtacagcatttgcaagatgaatggacaacaccctgtttggaagtctacccytttgatcaaagaagataaaaacasaacagctcttgtgggctgaattgcagggtgttttcttagcagtgatggaagaattgaacaaygataaaagctcctatgttttagttttactgacttatgggcagtgactgatggcctggccatataattaattaagaaagcagtggaaaactggcctatgaaaagaatgcccatatgagacacagtcctrtggaaatcactatggtaatttgaggggtgcattaacgtaagacwtgttgatgcctgatatagattggatgttgtccccacccaaatctcatgtcgagatgtaattcccagtgttggagttggggtctggtgggagrtgactcaatcatggggtggtttctcatgaatggtttagtaccatcccctcagtgctgttcaatacccatcagaataactcccttccaggtttggaaggtgattgaaatcaacaagcatttatctctaagtgcttgccaggtgcacctgtagtcccagctatgasagtgtctgaggcagaaggatatcttgagtacaggcatttgggtttagcctgagaaatatttgagtctagcctgggaaacatatcaagaccacatctcaaaaaaatttacatttgcttgtgaagatcaccggggtctacgaaataagtagacactgaggctgtagcaatgcagagatgggctgaatcaagacatactccccttgcatcccccacctctaataagcacaaaatactcagtaaaactgttctttttaacaagactgggcacagtggctcacacctgtaatcccagcactttggcaggccaaggtgggtagatcacttgagatcaggagtttgagaccagcctggccaacatggcgaaaccctgtctcaactaaaactacatcaattagccaggcatggtggtgcacgcctgtaattccagctactcaggaaactgaggcaggacaatggcttgaacctgggaggcagaggctgcagtgagccgagatggcgccactatactgcacccagggcaacagagcaagactgtgtctcaaaagaagaaaamaaaagaagtattctctttaacaagaaaagagacagagacagagaccaaaaaaaaaaaaaaaaaaaygtgaatgggaggtattgccaccatgtggaccactgagccacattacactaggaaacacacttgcccagaatgtccaacaatggtcagagaaatttgttcctcagaagaagagtttcagagagaattaaaatagtcatttgaaacattgagtgtatraatcaggagcggggagacataagcatgaagggcgggcctatacaccttcatgagtgtgctcgctcttgacatgagtgtggacaaaggaatgtccccactagagagtgtcctctttttccctgctggatcagggaaaggtgctggtgtgattctacatacaattcttccctaaaaaataaataaataaataaataaataaataaataaaaacaatccttcccaaggccagaagacactagaattatgactatactttacctcaacttgcttttctcatacctgatgcagtrgtctcaggactagggatgcaaataaaagtccaggcacaggaattattcctgagcaagaaacygtwaayatatttaaaaaccattatgcaagactgcctaagggcctggagtagatgtgccttcactgcatctggcaaagttggagctaacattgaatgcagctgtattgcctggaagccagatagccaaccagttctctgcctgaataaccctaacctctatgaactggaatggactgatgggagacactcgctgttactagcatggtatagctccctgcataggccagcacagcaggaaaayctaatgtcccttccaaaatgagaaatatttggtataaatgcagaagaggaagaatagtagctgaggtgaaatgaatgaataaatggggtatgtaatgaggaaaatccaatataacatgatctcctcaaaagaggtataaacraatgatgayattgtcttttatctcatttttaccagatgtctgaaaggttgaagccrtatgttgctgagaccattgctatttttggactgcaatgggcgaattgataatgactaaacaggactctggtaatgggccagtatctttttactgctatgattcttctgctataggagatctgtggttggccaagcaaaggggctcacatttataatttcaccactttgagaggccatggtgggaagattgcttttgaggccaacagttgcagaacagcctggggcacataatgagactgcatttctacaaaatatttaaaaattagtcagccatggtggtgtgcacctatagtgccagctgctcaggagacttgaggcggaaggatcacttgagtccaagaatttgaggttacagtgagctatgattgtgccactgcattctaccctgggcaacagagcaagacattgtctctaaaataaaataataaataaataaatagaaattataagaagaaataatgtggttaaagaccaggaagtgatctgtgatccaataaatatatttggtctttgcccctagtccctgacaggcaggtcctaaaacgcttgcagtccctcagtgataagcatgattttaatatggcaatgagatgactatggggtgagrggctcctagatagtttcaggatggaggctgcttgccagaaacaccagctgtgattagaggattggaactttcactgccatccccatcctctggggaagaaaagggggctggaagttgagctcagtcatcaatggccaatgatttcaccaatcttgcctacacaatgaaacttccatagacacctctagacagtgagttttggagaacttcccagttggtgagcacatccgcatgtccacgtgctgggaggacggcacacctcatctccatagagacagaggcttctgcgcttatatctttctgtaaggcagacacccttgtttctaggagggacctagggtggactgtggatyctttctctggggcaaataaaaatgtagaatcagaaaattcaggcactttgcactcctcatgggacactccagcagcactcacrtgaccatcctgagaatggacaggacacctgaggtrgggaagggagcacagaaccyagacaccagcctggacacaggcacctgggataatctcctattccttggaaagttccagtatctgagggaggaacagtsacttctggtcctgacctgagtggagaccgagggactcagaagagctggaatcagacccccacacacactgagtatgagtcagagaacaaggcctgagagaaaaagtcacagtgcccaagactgctgcaggggtcaaaggggactgctgatcagtgttccagggatttgctccagattaatctgagtcatggaaaaactgcctttcttttgtttctraacaaatacctgcaaagacaaaagaccacataaatccccagrtgcacaactttttcagatttaaagaaaaaacaacccccgtctttccctccattcccaggagaagctcactctgtggcatcaagctgcctgggtgagctctcttctagaagagtccagggggacaggcaaggaatgggaggcaggaagtccagttcagggagggggattctgggatgaaaagtgaagggagagggactgagcccatgctgagggtttttctctggtttctcagacagctccggggccaagattcggggagacattgagacagagcgtttgatataaaagaagggggtaagagccaagtcccagggcccggrgcttggctctctgggcttcaggccccgaggrcggtgcctgggatgggccggctcagctttggggtttcccgagctcckctctctctcttccacctttcccaacctgtgtcaggtccttttacctggatactcatgatgcggcctcagttctcacttccattgggtgttgggttcctagatcagccaatcagtgtcgccgcggttcctggttctaaagtcctcgccggcccaccgggactcagattctccccagacgccaaggttgcgggtcatggagtcccgaaccstcctcctgctgttctcgggagccgtggccctgatccagacctgggcaggtgagtrcggggtcgggagggaaaargcctctgcgggaaggagcgaggggcccgcccggaggagtaaatctgcacatatatttaattacagattacaattacaatcaaggcagaaatgatctcatttttacattacaactctggaaaaggcaatagactgagatgcaagtgtgcccccaagtgatgggcagaaggagagaaggtgttttggatgcattctagaacacaggtaatctaaggagagttgatcaaggccgtggaagagtcctccagccactattggccatcaaaggagtcctctgtgtcccaggaatggtcctgctttggtgtccctggtgtgacccatyacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctgkggatcaggatctattacctgtgcctggagagraggggactcctcttctcacccgctggtctctggacacatactgtccaattcccctgkggcagctgtaatgtgtagttcaatgggcactcrtttgtcyccttttaagggtaccctcctttagaatccaggaccttctaccctgcagagtgtkgttttgggagagaagtgcaaaatcccacgacaggtgagttgaaggaatgggatatggagccacatccacttccaccccttggtatctggacccacgtgttcttcctactgagattacagaactgtagagatrtctttgatttttaaaatgcaccatgtcctgaaagatggcaccctcccacccgcagagtgcttcctgcaagctggcgttgagctgtgcctatagaagctcttttcaacattctttatggycagsagcccttggttggtgcagatggtgataggaccagtgggtcccacagcatggccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccatcctacccggcctgggctgacccatggggaaggctggctaatttcagtgcttstgcttggttgttcagggccatttcaggtttgggtgttttctggggatgttaacatgggattcaggctcaactcacaagaaacttttccatctcatgatggatgctgttgggcatgtccaatgtatgacttcatgagttayacagatgctaattcktaggggcacttggaatcacatggttgttttgtgtcccatggtcaagcattctatcttaycagggcctacagtaacatgccaaaagttgcttccaacatatttctctgctttggatggggcatatttctgtgctgtggatgacatggccttactccagaatcccaggccctccactgtgactctcctactggtgcttggttcagctccaccccaaatcttaccccaccactggcactttcagcaccagggggtctgaaggatggtgactgcrccatggcctggatctgctgcagtgtcctttcctgtggaggctccactcaaagctggcatcctcctatgtcacctagagtgtgggtcaaagcaatacacctacatgtagaatgtgatgtcagaactcaaacaggctcaccaggcagtgtgcttccttccttgcatgaggatgcaagatgcaacagtttgtctttcacattggaagggacacccctggatgcccctaaccactagacctgtaaaacttcactgcagtggccacttctgaatctctgtaaggtttatttatcttcaccctctggagagaagatgttttaccaaagcctctagtgtaccttcctcctcttactcatccatcccagtcaacatgatgttgtcaatgaaataaaggaatttaatattctatagtatatccaggttctccagatctcttaagactgtactatagaggcctggggaattataatagccctgaggcaaactatgaattaaagtgttgtggatcccacatgaatcactttatatccacttttgtgtgtgtgtgtgtgaggcagagtcttactctgtcacccaggctggattacaggtgcacaccaccatgcctggctaatgttttgtttttggttttggttttgtttttgttttgtttttggacagagtttcactctttttgcccaggctggagtgcgatggcatgatctcagctcaccgcaatgtccgcctcccaggttcaagttattctccttcctcagtctcccaagtagctgagattagaggcatgtgccaccacgcccggctaatttggtatttttagtagagagaggttttctccatgttggtcaggctggtctcgaactcccagcctcaggtgatccgccctcctctgcctcccaaagtgctgggattacaggcatgagccaccacacccgggctatatccacttctaattggaatggaagggaatgcactcaccacatccacagctgcacactgtgtgcctgaggccttattaatctgctctaccagatatatccagccrgcatgctagctgcaatcaggactcctacttggtcacatctggagtaatcccattcattccttagtaatcccattcattccttaggcyccatcaggcttatttgctaaattacatggagataataggcaaccccaacaccaccccacatcctccagctctctaatggtggtgctacccccacagcacttgcagtgccttccacaagattcaccctgggacwtaygatcatttttgatttggscagaatggaggcartttcagaggtttccctttggccttcagcacaatgagagcccttactccacagactagggatgcagtgtgggggtgactccagctgccagggcatcagtgtcaattatgcactaggagaatggggagataaccagggctgggtctgtggactcastgaccccatggtgagccgtgatgtgtccaggtttatttcgtggtctccgtaatccccaatgtgagggggtcatgatgatgctgtgggcctctgggcatcartgtcatctcacacccaaagtcagtactcccccaagttctccctatttccctttcccagggtacagtctctaaagtaaatggctgtaggtccctttgcacaatggctcagggaattgacccagcatacacttgccacagggttgcagggtccttcctcctaggaatatggacacctcctcygtcactgggttctgaatctgaagcttggctgagatctaggcactgagaatggatcatgattttgtattggttcaaacaccctcagcctcctgctcctcaattcttgctttcttatcatagataccaagcagtgctcttgctggctgcccttctgttctgaccctggracaccaccctctattaaccttacccacaactgcaggcaggtcaagccccctcggctgctcctctggggttgccatggtaaccgtgtcctctggcttttgcaggtcactgccaccacttgttctctatctcttcagggccacaccctctccrtggatattaatgagcccaactctgggacatcttttcctaccatcaccctcagccttcagagaacaatacaatgaaacttcttagtgatgcaggtccctgttgccagcacgttcctgaggctctggtggaaggtgggccccctgggtcctcttataaagcacggttccggtgggctttccggcctcacgtaatgtctccatcccacakgccaaattcccccagcctcattattccmtcttctacatgttccggggcaactaagtcaggtctagcttgtgagataccggcatcattttttcccagtctacatggatcaccccagcagtgggtttgccccatgccctggggtctttgaaaaacccatgtgatacggttggctgtgtccccaaccaaatctcgtcttgaatttccacgtgttgtgggagggaccaggagggaagcaattaaatcatgggggcaggtctttcccatgctgttctcatgatagtgaataagtctcatgagatctgatggttttaaaaggagaaatccctttcgcttggttctcattcttctcttatctgctgccacgtgagacatggctttcaccttctgccgtgattctgaggcctccctagccacatggaactgtgagtccattaaacctcttttggtaaattgcccattctggggtatgtctttatcagcaacatgaaatggactaatacatcatgscttgagaaagtgttcccaagtcaaaggatttttatytatctagcttgaaattctgtccctttgatcaaatgccctcaaattccaatcccagaagtgttccccaggatcctatgtggacatgccagctagttcctgcaaagctcctgagtggaattccygctgcattataagggtgaggcttctgcagcatcttccagcrtaggaagtgggaacyattactggaaaaggcgagccttctctgcatgcccagagggtactggagggcacccatctgataatgctgtcctagtttgcagaatctcatgtttccccaccagggccctgattttccacaacaggcctgccttggctgaatgtcaaacatctctggaggtctgtaaccctcacaatgatatcttcagctaccattccacactatctaccctttcgctacaggaaayaagggcctctccatgagacactgcagaggcctcacacrtagccagtgacagctgttagaatccctcagattctcattctccttttatagggcatcaacacagctgagcagtaaccagccagcttccctgttgtaggttttccctcccaccctgtcattattgtgtagaggcttctatcacaccacctgccatagcacccggkaaccagggcatcttctcaggtcsgtgctggggatatccacagcagctcagctgcaccttgtgccatggactttctctgtccccaaccaacgtggatggcattctyggcctgccaggcagtgggcaagctcagscccaatccccgtttttgtctgtgtctatgsaccactcctgaagccacttgtgttggttagcatcccctgaggagcagactgcaatacagaattaaatgtgccaggatttattaggggaaatagccatgaaagaaattggggagcaagacagaaaagactgggaaagccataagactgtgrygcaagtggcttttttatttttattttttgagcaatctcagctcactgcaacctccacctcccaggtgcaagtgattctcatgcctcagcctcccaagtagctgggattacaygcatgcaccaccaaacctggcaaatttttgtctttgtagtagaggcgggttttcaccatgttagctaggccggtctcaaactcctgacctcaygtgatctgcccaccttggcctcccaaagtgctgggattacaggcgtgagccactgtgcccaaccagactgcaatgcaagtttaaaccccagtgaaggagagagggaaggaagtttggctgaaagtatcctasacccagtgcaggttaagagaagttcagtaakggtgagccctggagcctcagtgggcctttaaaggagrgacaatcctgtctttgtttctcctsttctctcaattattgaatcgaagaagccaatggcaagtatggtctgagagcaaacgtagcaatagatttcaggcggcaacagctrgagcatcatcagytgtgcttcctctagctgaggggctgggatgtgcattctcaagactgccacaacaatccagtggggagaaaggacaaagggtaatgatcaaagagaaaaaaaggtatgaactgatgaactgatacctttaagtagatgagaaggatgatgtttgggacaccagtagagggactgsctctggctgggagygggaaggttaacccacaacaaccatccatgtggtagaagacccagcatgcagtgcagctgcaaatgcatgagcagatggaatctgtgaaattgtcttctagtgtgttcagttttctcagtgaagtaggaagcaaggtcatcagctgaagtaagaatgcagatagaaggttggatgtgtgagcagagagaaggtgtgtgagagtcacccagaccagtaggaggctgagggtgagccatgcttggagagggtgattgctggtcgtggtggggggtccccatgaggtttgggtcatgaagttagagagagaagtcagcatgctgtgtgctgctttccagcctccttcagctcatgggggcaggtgcagygtaggcagaggtggattccaccagctgtgtagttttgccaaacaagtatggcaacgcaagggaggggcaagggagggatggaaattatttacaatagaattcaaaatggctgaagagggaggagaggacatcaagggtgagggacagtgagtagatggcaggatcactggattgggaatcccagagtgggtggaaggattgttggaattgatgtactacagggmagactccaagcctggaaagcaggcacataggcaatgagtggttcactgatattacgtcacagcatatgataaaatgatagtataagtatcctcagagcctgtggcctccgtgcaaggggatgagtggaaagatggtcagagaatggraagtgtgagatagagagtatggaagggctggggttcttggccatgatgagacctaggactctttaggggagaacaacaamaaagcaacaggatcctggtgtcagggacagaccatggccatggcrggatgatagcagctctcctacraaataatgcttatatgacaagggcatgagattcaggcagasrgaggagaaggtcatggaggagaggagtcccagcatctgagaagccagagggcgatgcatcctctctgctctatgggtgtttattgctgccataaaaattaacacaaaacaagtggstttaaacagcatctctttatcatgtcacagtcatgtgtgttacaayttcaacagtctcatggggctaaaatcaaggtaaggggaggtctgtgttccttctgactctgaggaaaaatctactgtcaagctcattcaggttcttgtctgaattcacttccttgcagataggactgagatccccacttccttgctggctcctgtccaggggccacccttagctcctagagccctctctcagttcctcatacatatcccatgcaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcccggccagtattttcccttttgcctgtaatgcaacctactcgtgggtgcccaggtattgagattggatgtctttgggaaccattactcggcccatcacatctgagtatgttgaagtcaccgaggatcaaggagacagcactgctggagagggcgatagtgaaccaggaactacaagagtcaggactgagaggaacggcctggggcccacagggaatggctgcaatgaggggagtggggcctgaatctgatgacagctttgggggcttaggaaggaaggaggcasaaaggtctgagaaccacagtgaggagtgaggatgccaccccacctctgggccaagggtacaaggtccctgtgcaaactcccccatgtgggaggactttggaagggaccacatcctctggcagacacagacatcgctggagctgtgaggtccaggaacatcctgagacaggatgtggaggttttgctgatcatgggctgagaattccaaggggcacagcgggaagacttctggatttgggaatggggtatggggagacaaaataggggtgtgcagagccttgtggggatgtgaatgcagggtgtttgggggacccagtgtgactgacacaaacagggaaaaggcatgatgagctcagtcctggtggactcaaggcagatgatggtgctgaggctgtgggagacgagggaggaggctcaggggtggctttcacctgggctctgtccatggaggtgaggacagkgagatagttgggcctcagtgctgtgtggaccctttcttgtctccctgatgactggatggagggcctggaggaagaggggtcttagaggattcactcatgtccctgggggagggkgactcactccaggtctcaggtctgcactgacacatttgtttgtggcttggggctgmctrctataaactattgggggttcgtccattttggagttataacctaargcagaaactcagatggttcaaatgtcctyttcatgaagcaatgttatyagcgtatmatttagattgtcttgcaagagtctcatttgttgtttttctaaatgcctgccaatattgtttgaaaatytacaaatgtgataaatgtatcttcaaagttaactggttgcaggttgtttaaccttatatgtacagtttcacatatgtataaaaacagtagtttgggcctcttatattctaatrattaagactttaagctgtgtacacattgcaatgcaagtatgcgtcatgcataaccctagcactaagagtcaagagggaaagtacctctcccctaacattttacaaagtttctgkgttctttttccactgagtgggaacaagtcagctagtgaggaacatgaggcctttggcctcatctaaagwtactttagctaccaattgtgagaagcactgaccaccrggaaggcctccctgcctggttcctggacctctataccatggcagaggccatcttccctcctagtgcagagtgatgtcccagrtagtgacctggttagccattgtccactctcgggcagttttgccttctaagacatkggtttttctctgaggacctccctgttttcagatgatcaaaactgggkccatccactcccttctgaaccacctctgcccaktggcctgtkgctgtgcccycagtcacaacaggacacsccttcagaacacgctgcargaagccgacatctctacacaggctcacacatgcacagtgtgtgcacggagctttggttctagttcaggaagaatgggaggaggctcactagtccaacagagcttgagccctgtaccagtgtcatattccaggagccagagttacaagggatacaaagtgcccagacctaccagagaaggcaaacccctacagcatgcagggctagacaggggcaagaaacaaggtcattctgggccagcaagaagagggaaagggaaattacagtcatacttcagatatatgcaggtttggctccagaccatggcaacaaagcaagtcacacaaatttttcagtttcccagtgcatataaaagttatatttacacttgactgtagtctcttaagtgtacaatagcattatgtacaaaatgaactatgtacataccttaatgtaaaactactttattgctaaaaaatgctaacaatcacctgaggcttcagctaatcctaaccttcttgctgtggagggtcttgcctcaatgttaataattgctgactgatcagaagggtggttgctgaaatcgctgtggcaatttcttaaaataacacaacgaagtttgcagcaagattattctcctcacttggacacttakaggccattgtagggttactaatcggcctgccttcaatatttttgtgtctcacasaatagggaaggccgggagagagagagagagtcaagaaaccagccagttggtggagaagtcacaacatacacaacatttatcaataaggttcaccattttataagggtgtgggtcatggtgtcccaaaacagttacgagagtaacttcaaagatcactgaccacaggtcaccatacaggtgtaataatgaacaaggttgaaatacttcaagaattaccaaaatgtgacacagagacatgaagtgagcacatgctgttggaaaaatggtgccaaatagacctgcttgacacagggttgccacaaacattcggtctataaataaaaaagcaagaaaaaagaaagaaagatggaaagaaagaaaaagcaaaggaaaaaatgcagtgtcagcaaacagtaataaaggaaagcacagtggaaggtgcacctgcaaaggggaaatcagcactgaagcaaagtcaggaaaagctttcaagtcagatgggcctggacctgggcatgaaccctccaggtcctcccaccagccagctraagaggcctgagcacatctgacccagagctggccccgacagacacttgcccagtgagtgagtgctgaatgaaaccatctgagccagtttcctcatctgcaaaccagtgacataattcctgccttgcagagtttcagaagaataagtgagaaaagacacagtgccaagagaaacagacacaagacctgtggcgggctggacaccagggctctaaagcaagttctgcctaaactggcragaacatttttcaggtcaggaacaggagttgttctggattctgtctggggtcaggctgggagggagctgggggtggcagagtaggatgggggcaagggctgtggcagggcctggcactgaagtgaggccaaagcctggagagagtggctcctggtggcttttgggcagctcacgcaactccctgcctcacccactgtgtgagtcagcgttctctagaggagcagaactaataggatgtatgtacatatgtaagggagtttattaaggagaattgactcacacgatcacaaggtgaagtcccacgacagaccrtctgcaagttgaggtgcaagaaagccagtgatggatcagtccaagtcccaaaacctcaaaagtagggaagctgacagtgcagccttcagtctgtggccaaaggtgtttggctgcagattccaggacaggaccttyttgtcctctgcagtgaccccccacctcgcctgactatatctgtccaacttgatggtgccaccgagggttctgatgcagggaaggagctgtgtgctctgtgtgggaggatgccttctgcctttytagctgggcctcaggtcagggctwtsagcctgagcagggaraggagatggaagggagatggccttggagcaaacrtctgcccctgccagtgcatcccgtaggtatcatcccatccaccagtgccttggcaggaccccactcactcaaccctccccctggtggtagtccctggtggtgcctcctcaggacctcctgcctccagccgcacaaatccccaagaatggcacgtgggtacaagggtgttgggaagtgtcatcctccagtgctgacttgagtgtgtgtgtgtggctgcacacgtgtgtgcatgtgtgcacaagtgggaattggagtgtgtgtacacgtgtgtaagtgtgagtgtgagagtggagcatgaatgtgcaggtgcccacaggcagcagttggggtgccagtgtcctcactcctgcctgctttcctttctctccaaaacgtgaccacacagcaacttagtgactatctagatttaagtctatcaaacagaagggaaacacaactaggattcctgtagtgtagggaagggaaatgcctagcccagctctctgattccccttttaatgggtttgagctgcaatatgggtgcagaagagcctcccacagygccactggtggtggaggaaatagcccctctcattggcccattttcacgctgctgataaagacatactgggaagaaaaagaggtttaattggacttacaattccacatggctggggaggcctcagaatcatggcggcaggtgaaaggcacttcttacatggcagtggcaagagaaaatgaggaggaagcaaaagcggaaacccctgataaacccattagatctcgtgaghctatcacaagaataccacgggaaaaactggccccagtgattcagttacctccccctgggtccctcccacaacatgtgggaattctgggagataccattcaagttgagattcgaatggggacacagccaaaccgtatcactggatgagagcaattagattgatgtcatgatgtatatgggtccatgrgaacttgaaaaagtcttccccttccacctagtttaacaagataaacaggaaaggaacttcccttaagggaagatattgactctatccctgaaattaaatcacaagraaataagaaatgcatgagatctaaactaagccatttgggtaaactgtctcagaatttaaagcatcwgcagtcacaagctatcagtatcagtgacgattctttcactccatggtctagtccaacgagactggtcagggcttgccgcctgctcctcggtgctgtcctggtactttgaaagtatctgtgattctgtgaactgcaccsccagctgcccaacaacttccctttgctgatctgagccagactctgcttttatggcttacacccaaataattcaagttattttwaaaaaataataataaatcaagttattcatttatgagttatacagtcccatgtgggkaaagggaaggagagtgaggtaatactcaattttactacctgctatgcatttataagtgagatacttctttttaaagtcatatttttggattagaacaaactctggtatatttaagtaaattccctgaagaatgtgaacaccgtaagcaggtgagtgcattattctctgcttcccctccacagagctgtggttcactctcctccatcctgccccctgcactgggggcaccacagagacagcacggcctgtgctcctgcacmacctgcttctgcttgggtgtggatgataacaggcacctgcaggagatgggagcgtggggggagaagtaactcagggttttcacttccctcactccctttggacagctctgcggttctgtaatcattgccgtcctctacctacagccacaggcctgcrgggctgcccctagtgaaagctacagatttccgtgagttctggaaactgctccctcttccttgttctttcaactcagagatggaaacagtttcctgccactgatcatcccagggagcttcagcaccccttgtggctttcttaggcctgccagcacctctgtaatgtgtgtcttctttctttgtcatctctttcctgccaggaccctgactgtcccacagaagaagtgacaagaatttatttatgacatgacaataacacatgtattcatggtgttaattcgatttgtttcatagagacagsgtcttgctatgttgcccaggctggtcttcmactcctggcctcaagcaatccccctgacttggmcttccaaagtgctagcattacaggtgtgagccattgtgcccagcccttaacttgaaaatctgacagtataataaaagaaaaaaatagaagtattctggaaatggaagaggaaagaaggctaaggtggaaatcatcaatctgtgtcatctgagaagccccacgtgcagaggctgtcccgggactttaggggagaacaaaaacaaagcacccaggatcctggtgtcagggacagagcatggccacggcggratggtagtggctctcctatgaaataatgctcataaacatcccttgtgagaaggatcagatcaacatataaaaatatgccaaataaagtgaaactcaaggcaggagtgggactggccattctcagcccgygacctccatggacttggagaaaggctcagcctggagatgtgtgaggcctccgacctggagcagcacccgcccctaaagaccaggcacaaatcccagcacatggagggatccagacaaatacacaagagatgaccacagcaggagctttactgrgcacagagcgaggccrcacaccactcagctcctgcccctccacctgcccttctctccccacctgcccctgccccagcacagcagatcctcagaatccaaaaagagaacctaacttccatgttttattaatggcttataatattttatcacatcttcagaaaacactatgcagaagataactgtagagcaagacatctatttagggtgagtgagtcacagtggagatctgggagggagaccctgtaaccctttcattccaagaaaagaaaggtmgatccaaagaaggggaccccaggcctggatattgggattacatgaaaggggttctggggcatcaggggaatgggtccctctccctacatcctcccggggctgtgcttgggaggacagcagctgggggaagaaaagtcrgggtccacagagatataagggggctgagaactatctgtgtcttgctggtctgcacaaggcagctctcaaactgtggagaacatggtaatgaccagatycmgctcagccrctctcagcctttacacctagagcattatgggcagsccatcaccatcccctaccttcaaatccaaagatcsstacagcccaaagctgctccctggcctcaactcctgttggyatcaggccccaaggaagctgtgagcacgtctgcctgggaccctgtcaccatctggagaatgacaataaagrggacccagcagcctgcaggaggagactgtatttgaggcaggaccatgggatgggtgaggcacaggactgtggctccatcctctctatttgaggagttagagatgagctgcctctgccaccccttccatggtgatatttctagagtacacccctgtgctgaaattcttatgaggaaagagacctgatgagatgctatggtgaagaggggccataagggtcttgaataccaagttaattttgctaccagctgagattaggaagtgaarcccaggacccaggagaggaggaggaggagataacacaggaccctgtgatcactctcctggccatctgtgtacagtgagaygcttcccttcrgggttgggagcacccagtgtcatggtcctgagtgttgctaccctgctgttctcatctgtgaatgcagccagaccactttcttcctctgatataaataacttggaggatctgtcaccagacacctcatatctacatattaataaattctgtacrgtggtttggcttaatgttttatatgttataagaaataagcaaaacatagggatgatatttttagtaaaggtatttcagggtatatragaatcagattcctagggccctgkgtacctcatcttgctgtttaaagtcctcatggaggatcagtggagtgcagagcccagaaatcatcctgaaggctgaagctccctggtgaaaaggaccctctcctgcaccctggggctcagagggaacaacaaagctccctcccagggtctccagcctctggcctatactgtcagcctgcactttsttggccttcctggctgctaatattccagttcccagcagcctcctctctcacccttcacctcttctgactgggtgcgaatggtaactagaccaggcagtgccctccttgtcagtctgcctgtctgcctggytccctctcagagtttgtgtcttcactcggttcatcatccccagccccagcaggaacagggagaagtgacttggcaaatgccccactcaaaatgggatccctcaaccagagaccacttgtgaaagtcagttttccctgactaaagaaacaggacatttaccctgttagaagttgatgtctgccagagacctccacctgggaaatgctggttcatggcagggtctctcttttagtaaagggaaaaattcctggctaattgatagctaataagtcatttagaatccagttcatgtaaaaggattacctacttaaaggattaactccattataataaggacacacatcccacaccgcacatccaatgtcatttgtgagattgctttgattcgctcatgtagaatgttactctgctgctttgcagagaggcttgccacacatttcaaatctctgctcytcatttcacaccatctggctcatgaggtgaaggtgatgagaagtgtcttcagacaatactccgaggtttgtctatcagagtcatagtcatatattacatatagagattattttcttagaagttgtaatttattgatatgtattttactcatggcatagatagatactatccaacaattcgtttttattacctctacattacactgcttaggtagccactactggtacctctgcattttctttcttgtatgtgacattaaygtataagattgtatgtacatggtggcttggtttccaggaattgctgattaggtaatttagaccattccttccactgagtacaatgggaaaaggaggaaaacatacatatttgaaaaatctggttgagcaaatggwtgggctaacaaagcagtgaagatttgcctggccaggaaccaggagaggggagaaatccagaagagcaacttgagctgtggggctgcttttgtggatcagaggcagtaacacctgctccctggccagaagccaacttccaggattcaggactcagaattcagaacttagacrgtcccttggtctctctagaattcagtgctcatttagaccgggctaagaccctcacactcaatggctggaggatccragcttatggcatgactgcctctggagcatttcatgctagagagatcccaacaggtgtaggtaaatggtctagagggtactagccrggcttccatggaactctgtgtaaggcacttccctgtgttgttactcatgttggccatgtcctcgggaatttagtggaacggccatgtcgtcttgagtggaagtgaggacggtgaggkggtccctgggcagtcagagattttgtgtccctgcgtcctttccttccatctcaaccagagaccacttgtgaaagcccaagaacaaatgtcattaaatgtcygaggcgaatccaagaccaccgatccattgykcccaggagccttgggccatgtagcccagcagtagtgaggtctgtgaggccttggtcacccycaaagtgttgccccaagaggagctgccrctcgttgccatcaggcacctcaggagctggacatggtattcattataatttctgatgaggaactagagaggtctcatagcatatagaccttgatcaaattgggtcatggtggagtcaggcaaaactctgcaatgactcacaggtacctaagtataaaacaaagtytcaactcagagcatccatcagagcttcaggctcagtagtcattmctttatgctgttgctgtgtttgtactgtgataactggtgcttgaagggaggacatatagttacatgttgcgggaaaacacatgtcattagaaaacttggcatgatttagggacmattgccttttccatggtagatgtgggactctctgtcatcttcaccytgttgttccaagtgcagaagagaragcttcttcctgctttcagctgcgtgactgacaasggaagctggaattcagagaatcagtggcagcctctgtctctccaggccccaaccctgcaggtttaaggaatggacttaggtctctggcactttgttctcaacacacattttccttcactcattcagaaaaaaaawaataataatagaaaatgaaccaaaggctgcaattctcatggcacctagagaaytggagtacggaccaaggttgccacatgcctgtcattgctccaccacactcggttgccrtgtgacctcgggagaagctctctaccactagggacttttaaactcatctgtgaatcctggataaacacagacattccggtaaccttactgaaatgaagtgaggaccaatgagttgacaggtggagaaaaatttttttttttttttttttgagacrgagtcttgctctgtcacccaggctggagtgcagtggagcgatttcggctcactgaaagctccacctcctgggttcatgccattctcctgcctcagcctaccgagtagctgggactacaggcgctcaccaccacactcggctaattttttgtatttttartggagacggggtttcaccatgttagccaggatggtctcgatctcctgacctcgtgatccgcccgcctyggcctcccaaagtgctgggattacaagcgtgagcctccgcgcccggccgcagaaacagaaaaatttargtgatggcctttactcctagacagggcttttttaggaacatgcaccttaaaagtaggaggaaaacataatgccagcaacaccctgcctaaaagcccctttagtgatgataattatcattcatctttctataaaagyacagcaagactttctacctcaatatctcaaatcagttaaatatatctyctgatcatataccagtgtggacccacatgttytgctccaagtgaaaatgaaaaggaatgagaacatctccacctttgtgtggtgaccatgggaccacggaggcttggaagccagcctacatctgcccaaactctacatcacctgccattgtcaattttcaatctatccgttctatgctttggaatcctacrtaattcatactcttgaaaaatctcattttcatatgtagggcagggtagaaaaggtgatatctctgttttaatttgctaagacttccataataaagtggcacagactgggtaagttaaacagtagaaatgtattatctcccagttctggaggctacaggtccacgatggaatgtattgcagggctgaytgctcctgaggcctgtctctggcttacagatggccatcttctccctctatcttgtcaacattggcctcaaaatatgtgtacagggacacagtttagcccataagagtctgcgccatccttggcggtgcatattataagaaataaaagagaatacaaccctttggctggactctgttgatattttgaaatgttggtcttgcaataagaacaccaccaaaggccaggcgcagtggctcacgcctgtaatcccagcactttaggaggccgaggcgggcggwtcacgaggtcaggagatcgagactaccctggctaacacggtgaaaccccttctctactaaaaatacraaaagaaaaattagccrggcgtggtggtggrtgcctgtagtcccagctgctcsggaggctgaggcgggagaatggtgtgaacccaggaggcagagcttgcagtgagccaagatctcgccactgcactccagcctgggcracagaccaagactccatctcaaaaaaaaaaaaaaaaaaaagaacactaccaaaacaagggagccgaagtttagttttccctggaargtgagcactccctsagcctggccgccccagggcagcaagacccagtgctatgtagttctccaaagtcctatttactttagtgattctgattctgtatttttaactgggaaaaggattctctttcaggaaagcaaccacttctgatgctatttaggtattattctccttatacttataggagaaaaaattgatgttaatgaacaggaaatatttgccaaattatcacacaaataatttttgtatcattttaaaatactccttattgtactgagcttgttggtattttaataaaaattattggcayataatatttatacatactttggggtacacataatattttcatgcatgtgtagaatgtgaaatgatygagtcaggmtatttaggrtactcatcacctcaagcatttatcagttatttgtgttgggtgaatttcaaatccactcttatagctattgtgraatacacaatacattgttgttaactacagccagcctgctgtgctatcgartattagaatttattcctcctatttaactgtatctttgtacccattaagctacctcrttttatctcccagatcccccacacacccttcccagcttctggtaactattattctrctctccacctccataagatcaactttttttcagtyctcacatgtgagtgagaacatgtgatatttgtctttctttgcctggtctatttcacttaacatactgacctccagttccatccatgttgctgctagttattatgaggtagttytagctggaagaatagagaattaaaagaaatctttgtgaagcccctacccaggtttgtcaatttgtaacattttaatattattggctatatgtagtatasatagaaaataatagaaatatatgcagatagccctgattctccacagttctgttatgtatgtgtttccrckgaaacacatacagtacagtactctatgtactgtacagtactactgtactgagtactggactgccagtggggagwggcggatgtcttgaatttggtgaatgcctttatattgytacaaagtgtttttttttttttggttgkttgttttgagacggagtctcgctctgtcgtccaggctggagtgcagtggcgcgatctcggctcrctgcaagctccgcctcccgggttcacgccattctcctrcctcagcctcccragtagctgggactacaggagcccaccaccacgaccggctaatttttttgtatttttagtagagacggggtttcactgtgttagccagggtggtctcggtctcctgacctcgtgatccgcccgcctcagcctcccaatgtgctggcgtgagccaccgcgcccggcctacaaagttttttaaatcctttcrtttgacatgattttagactttgtaaaaattgttttttgttgaatgtatcattctgtggcttgctttatcgtttaatatggtctatgaggtgaacccacacacccatagaaacagttcatttgttttcagtgctggatagyatttatgagasgaatatcccacaatttatctcttctcctgtcmgcgacctttagcttgtttctgttacagacactgccacaatgaacatcctgggtcatctctctctggtcmcctgtgtgagttccccaagatacggatgtaggaatgggattactgtgcttttaccatgtgatgttataggatgtcaaattgttctctgaagaggttgtatcaactcccccctttaaaatcttctttgayattttacaggtcaagttatcttcctccccaactagctgctcmkcctcagtcccccttcaktggctccttttgctgtagatgctggagcactstggggttttactgcctcccaatcactcyagtgtcctccactcccaggrttttaaatatcgtctagacacagatggctcccaaatrtatatctctacatatttctataatcaaaaaactaatggtaccaaaacaggtactctgatatattgcagatgggcctgcaaactggaaatgttttcaggaaaggcagtayggcaatttctgtctaaattaaaaatgcatacacccagtagtcccacttctagaaatgtgtccaaaaatasacctgcattcctgaaaaatgactgtattcagaattatatgwtgcaaccctgtttgtaaaatcaaaaaggaaagaagaaagaaamtgaaagataaaagaaaaaataatccaaatrtctgtcactagcggactagttaaaaaagcattgcaagctgrgcacagtagcattcacctgtgaatacactctactccactctgggtaacatgaggaggcctccctaccttcctaagaaaacccaaacaagcactgcatatctacacrgcwgagtctacaaacatttaacacaaaagaagaaagacataggaaactcttgatattccctcatgggatggtctccatgatacattgttaagaagaaataaagcaaggtgtagaataacatatagagtctgctaaaatttgtgtgaaaagggacaaagagatatatatacacatttatatttgcttgcatatgcataaaatatatttggaagaataagcaagaagatatccctggttgcctgttggggatgagacarggtaagaaagagacattttaccttttgaayattttgaattttgaattttgaactatatcaagaaataaaagataattcctagggcaaccaaayaaaccccaaaaaaattcaaaatgmaaaaccttttaaaaacyaatagaatttttttacctttattaaaatamattttaaaaattttctaaatattatattattcctttaacraggaggtttacygccattttaattcagtacrttgttttctttttaatygcatgatctttctttacatctrtcttttttccattacaaggtaaaataacagcatgattaattaaatgcartttgtttggtgaakgaaattttgttcaaatcttggtctaagtgggaaagggwttctaggggatccagtgcagcagttatgggtttcagtatgctcacgacgccctccagtgtttgtgtgggctcatggatgccatatctagaaaacactggaattctcaagcacacgtgactgaagccatttgccaaatgttcaaggtcctattaatggcccatctgagtacttgtcatacgcrgtcaccctatctttggatcagaaggtacactcagagctcctagtgtcacatcccaggcccaacctgctgagattagtcgaggaaggtctggaggtcagtgtcgtgaggggtgggaagactgagggtgtgggggccagttgtggagtggcgggagccccaggtgctgtatgaagccgagcctctggatcaccctgtgaccccacatttggtcccttcctgggtgtcttccattcccaggactcccaggaaataaaatgctgcaagattggggtggggagctgtccagggtgggtcaggtgtggtctcactgatcctacacctctgcctcccagcccactcccagccctcttctgatattagaaaccaacacagattgccttagggtggtggttctcaaagtgtggtcctgggggaagcagcattggcatcacctgggaacttagatatgcaatcttcagggcctggcctggacctactgtatcagaaactctgcatttaacaagcccccagcagaattctgcttttcaaatcagatctctctctctctctctctctctctgtgtgtgtgtgtctctctctctctctctctctctctctctgtgtgtctctctctctctctctctctctctgtttcaagtctcaatattgagtagctgtgacttctggatagtcaggtgtcagacaccctttcttgccaggaggcaccaggctcctcaatcagcttagtctcattcttggcctggcccagggaaagatgttcacttcctggattctgagcaaagctctcctatcctgggtgcctgtggggctcccacttacaccacaaaacaaagctcaaataatattattttcttttatgagatttttggtattccttcattagtcagagctgaagatctacatatatgtctaccaagcaagtgtgcatgtcccactagccagtttgttagtcttgccaatgcaccacaacgtagcagcctctcagtctctccttgtgaggtgttacctggagttctttgtctcaccaccaagagaattaaggagcgtggatacaaagggtgaggttggagcaaaagtttaataagcaaaagaagaaagctctcccccacggagagggggcttggaagatggttgccatttttacagctgaatgcaaaggcttttacaagaaactgatgagggctgggtgtctcatttgcataaggcacgaatttccgktagctccaccccatcctcctagtgcccatgcaggcccttagcttgagttactccatattgctttgtttccctgactgcccatgtatcgggggacagaattttccattgcgggcatgtctggacaagtctcctgtgcagcctttcttatttgtgcagctgtgggcatgtcttaggcaagcccccctgtgcaagttcccttctctgtgcctgcaggccgttcttttgtttgaaataattcaactgaggacccaccataactgcccgcctgaccagtttcttccttttttctctctcaatttgtgttatgatttccttactgatctctgcctgagcaagactgggcacgccttgagggcaaggagggtttatttcctcttacctcagttccagctcctcttaaaacaatgccccacgcacagtaggtatttgataaatgtttaccaaatgaagggattgcctggaatggcttggcagacaggaaagcagaatgaaaacccacaggccaaaagtggctgggaaaagattttccaaatcctagtgctgggcacagggcccactgaaattcactttcggaaccttcccatctgtcttgttctcctctcatcagggacttccatgcccctcaaagcccacctagtcacacactacctttcaggaccaccttccagatcagccaggtgcaaatcccacagacttcctgcctgtggctccaaatgctcagctgaaattctgaggctaatttcagtggagttagaggcttatcccttaggagtggcaatggctggctttaagattcgagaagtagtgtttacatctcaaaagagaagaccgctccaccagaaatgcagagtttttgtatgtgcgggtccggggtcttcaggagataaagaatgatagctccaggagcgctgggacccccgtgcagccaccagtcaccacagcctaggcaggggttgggctctcacctcggcccctcccctgcacgccctggatgtggatggtccccgagtgtgaactcgcctgggctctgaccctgggtgctcttcccgccgttgtggagcctctgcgggtgtggtgcatgcacagggggcttcacaggagacccggggccctttagagtctcaaggccaacattcttggagaatccatgtcaggcattcaggctctcagrgactcagatgcccaaactatgaaaatgagrgaatctatcccactctctcaggtgtggtgagattcctattatatgactatcggtcatctatacatggattgtactctcagagttgcctttatcagtcggccaatgcctahaacccaaagatrggtcaggcatggtggaggamgagttcctttcttaccttctgaaggtgccatcaacaggaatttctaccctgtggagtctagaggagactttccttgaagctgagttgggaatggacatttggacttttttttttaagagttagtaactccgtggagaaccacacatttatttgcttactttaattctacagcaacattcgargtggcttactgcaacaaacccagtgtaataaatacatacgaattactttaaaataacaccaaggaaaatatacattttaaaagattaaggctggggtaaagctggaacattactaggcgggaaggaacatctgaaacatttgctgaaatggagttgaccctttacctrgccatagatttgttgcctcacratttcattrcatctgagcaccagggaggggggtggcagttcaggtcaccagtcccttgtttcctgmttcaggawcagtgtcctgttctayacttacagtcaaagcaaattacatcgttgtaagatgtttaatgatgaagtcaaagtccacagagtcagcaagtaagtgtaaaaacctcaggagtccaaggacagtctacgtttctccccagaaatggcytcactatgcactgttgaagggagagggtcctttcaaggggccccaagatgcaggagcaattgggctgcagctctaaataaagatgtcctttctacctgcagrttccacaaaacctcacaggcaaatttggtgatctcacctgagctaggaattcggttttttgatgtkggttctctttgagccmttgtgtgagctttaaaatgtgaygtggagattttgctatactggtatttccttgstggaatttgacatccacagtggctctggcttccctgtctggtcccaggaggaaatggagtgtcctgcactttttttcagcatcgctttgtgtaagaaggatcaggagacctggagtcaggggctcctccaatctcactctccttcataaaacagtgtcccttaagctttctgggggtgagggccttaacaccgtgctgttctgatgaatataattgtcccagctcccgaaacaaaagcacaggtgcacaaaataccgactgttgcaagcaatgccaaggtggggatgtttcctaggtgccaggtttagcactttgactttgtatrtacacacacaggggccaggcgttgtggtttatgcccgtaatctcagcactttgggaggctgaggcatgagaattgcttgaagccagaagttcaagaccagcatgggtaacaaagcaagacccagtctctamaaaaaaaaaaaaaagaaaagaaaagaaaaaaatacacacacacacacacacacacacacacacacacatactgggtgtggtggctccagtctgtagtcccagctactcgagaagctgaggtrggaggattgcctgaatccaggagttggagcctgcaatgagctgtgatcrggacactgctctagcttgaccatcagagtgagaccctgtctcaaaaacaaacaaacaaaacaaaacaaaatacatacacacacacagccagagccagcactgagggagaggctggcctcaggggtggggtcacaggcatttctcaggtccctctcagtggtctttgtctctttttcctggaggtggaggagtctgtacttcatgaggagaagtcctctgaagaaggcgggagatactcaggagcggggtccrgagagggaaaaggatgaggaagtggagacaaagtggagggggcagggcaagaagggcacatgtgaggaatggggagggggaggaccttccagctgtcagaaaggtcccacgcagaatttggctcttggtttttctgctttatcaggatggatttgggaaaccagccrgagcgggagataaggagtctactttgcaaaggacacgtgtgagtctcctcctaatttgaactcatgagtagcagctgacagccaggacccttgygtggggcgcgtgacgcccctttgcaaccagggcgttttctgcaccccaccagccatccctcctgggaccacgctggtycyctccaaccctaacagggagagaaggaaggagaggtctggaggctttgggtcctccctcgtgctccttcttcctctgccatttattccctgagtgtccttgactttcctccgctacccggaccccactacagcaaagcacatcctgcacactggcctggactccctttgtaaccacccagtgtgttcaccttgctgactgcctagacaaagccgatttatcaaggcaggggaattacaatagagaaagagtaattcatgcagagccggccgtgcgggagaccagagttttattactcaaatcwgtctccccgaaaactctratcagtttttaaggataatttggtggatarggggggccrgtgaatcaggagtgctgattggttggctccggtatgaaatcatagtgagtggaggctgttctcttaggctgagtcagttcctgagtggggggccacaggactggttggcaggtccagatggggtcctccagttgttagaaatgcaaaaacctggcctggcgtggtggctcacgcctgtaatcccagcactttgggagcccgaggcgggcggatcacgaggtcaggagatcgagaccatccttgctaacacggtgaaaccccgtctctactaaaaatacaaaaaattagccgggtgtggtggcgggagcctgtagtcccagctactcagtaggctgaggaaggagaatggcgtgaacccgggaggcagagcttgcagtgagccgagatcgcgccactgcactccagcctgggcgacagagcgagactccgtctcaaaaaaaaaaaaaaaaagaaaagaaagaaagaaaaagaaaaaagaaatgaaaaatacatctcaaaaggccgctctgaggttcacaatagtgatgttaccttcaagagtaactggggaagttgcaaatcttatgacctccggaataatggctggtaatattcagaattccagcccctctcatcctaacttaatggctggcggcstttcattcgttttaaaagaacactttccctttaaactataaattccttcccaaggctagtwcggcctatgcccagaaatgaacaagggcaggttagcggttagaarcaagatagggtgagttaggtttgatrtctttcactgtcatcatttccttacttataattttgcaaaggcggtttcaccttggcttcagccccacccatgcagtaacactgtgccctgtccttccaaccactgccactaggtgaaagcagagagagcatcgcccagatgggctagattcttctcacaggctcactgctagaacgaacattcttgagactttagatctaagycagcctgattyctgaaagccttggaccgtttccaaaatcaaatcaatactccaggaacaagatctgcctcgactttgtctccayccaaggacgctatggcaacgcagttttcaaacgtgctttgagaataaatggaacagggtcccctgtgtccccactcatttgcgtttycctttttattacagccaaccccttttgtaaatattgttacacatctctctattccactgaaaacatctctttcaaakgcactttaagaaagattcaatgacatgaaaatatgaaggatcctcttgaaagagtttctggtgstgggttttaaagaacrttttggtttttaaaactctgtaaccattttggtgtggggcttagcttcgtattttcaaattgaaatattctcttccttaacgtccgcataaatccaagttcacaatttttattattttaaaattttatttatttttgttttggggacaggktctcctcctgtcacccaggctggattgcaatggcacaatcatagctcactgcagcctggaactcccyggctcaagcgatcctcctgcctccaattcccaaagagctgagattataggcatgaaccactgcaactcacccaaatccaagtttatactaaaagataaaattccaacatttcagagaaaatgaaagtcacaaagttatcccagtctctgaagtcactgtcaaaactttggtgaggaatcttccaggttttcccctacttaaaatatatattaatattatgtaagtaatattagcggcattttcacccaggctggagtgcagtggcacgatctcagctcactgcaacctccacctcccgggttcaagcaatcctcctgcctcagcctcccgagtagctgggactacaggcgccggccaccatgcctggctaatttttgtattttcagtggagacagggtttcaccatattgaccaggctgatctcsaactcctgacctcaggtgatctgcccaccttggccttccaaagttctgggattacaggcgtgagccactgggcccagcctccttaaccttttaaaaaaggttaaaagtatgctgggcacttcttttcatagcaatacttaaaagcratcttactctttttaatgactgtatagaattttataatataastcttctttgggagacaatkraaatgttctttatcttcactgtggtagtggagatgtgggtgtgtacaacagctaaaattcaacaagttgaacactttaaatagatgcagtttattgcatgcaaagtatgtcccaatatgatgatttaaaaatattatcgtctttgagatttgtactttgcttatgtgaaacaaaacaaaacaaaaaccctgttcttgtgcccaggagacacaccctgactcatctggaggtagagggtcatgctgtctgcaacttaccctcacaggctctgaaataacaataatagcagtatatttacagattcagaaagagagaaagctatagtaaaaatgttcataagtaaaactagataaaggkcaaaaataaataataaaactacgtcttttaaattttatctctcctttactttttctctccccttttcttcctatctcttccctcctttcttaacacgtyccccyatccttccctcctttcaccactctctgcacttgatccccggtgtattccagccyccaggccaacacacttcaccgcgtccgcctggggcaggtcagaraagggacgcgaggcggcgctgtcacagcattctatgcgccccagcgccctgggccgcgcwggtcttktatcatttcagtggtcmctcccgtctttgacggggccamactcggggtgtaaattaggatcctcactgaagcggcgggaccctgagaggctttttcctggccccttagttgtgggttttcctgcgggcggtggagyccgtttccatmagaaccgcccagaggcgggcgctgccttccaggggtgaagygttttcggacccyggaatctgtgggcggcctgcggsaggggctgaggcgcagttccctactcacycagrtccgaatccaccgcggtgctgtttccagcgagtcagattccagatcgcgctccagcctggactcggaattcctgccccgcgggtctgcattttcacagcrgcaggtgtgagtgccgcgcagctggagaccagaagcctgaggcagctcggccctccccagcccaaagtgccgttattccgtttctgtatcagtaaacacgtttcattttycgkagaccagggaagggtgatgggtgatcccagtcctcgcagtgaattccgggccacaaaattcaaaacgcttgckggmaaagccgtgcgcggtggctcaagcctgtaattccagcactttgggaggccgaggcgggcggatcacctgaggtcgggatttccagaccagcctgaccaacatagagaaaccccgcctctactaaaaatacaaaattagccgggggtggcgcatgcctgtaatcccagctagtcgggaggctgaggcaggagactcacttgaacccgggaggcggaggttgctgtgagccgagatcgcgccactgcactccagcctgggcaacaagagcgaaactccgtttcaaaaaaaaacaaaaaacaaaaagctttcgggcgccgagggcagccccgccctgaattttgtgagcgmccgcgctgggccgtttctctttcttttccggaccctgcagtggcgcctaaagtctgcgaggaggaagtcgcctctgtgctygtgagtccagggatctaaggcaagtgctgagggagaaaacatagttgatggggcagagcagagggggctggaggtggggtggagggggrgggctttgaacagaagacctgggaggcttggtgggggaggggacccaggcctcggcgctgagaagcaactcccctggagctcaagwccwtcttggcctcccctagcccaggggaggactggcttcatgtctccctgaaaccgcttctaaatgccttagaacaaaccttaaatattcattattattattgaactattaaaagtcttttttggaggcgagctgaatgagaccctttgctggagctggcacacggaggaagtcctggagggagggtagacaccgtggagggaagggcttgggacctgtgtcaggagagctgggtccatctscctctctgtctcaaactatgcttatgatctttagcagtgaaaataatctctctaaggtggggacaggaccccagtccctgctgtgcttaataaattatgaggatcaaaataaattatcagtgaatgtgtatgggaagactaagaaattgttaaarttctcgaatacattacattttcatccacagaaaagtgtaggctagggatgataggggaatagttagtaatgacagggatagtkgaacttaaaaaaaaaggttgtgaggccaacaaaaaagaaatggacacagttcctgatcctggagggttcatagtctaatgggrgaggagggtagaagatggtaggtgatggctgggtgtgtggcactcgcctcgcctgtagtcccagctactcaagaggctgtggtgggaggaytgcttgagcccaggcatttgaggctgcagtgagctataatcacgccactgcattccaactgagtgacacagcaagactcctctcttaaaaaaataaaataaaataaatgaaaaaaataagattcaagacagggcacagtcggtaccatcaggaaggttcaaaccatgggctagatcagtagttctaaaacttgactacacatcggaatcacgyagggaactttaaaagatactaaggtttaggtccaacctaggtttactgatttaactggttgtggctgtggcctgggaacatggatattaaaaactctccaggtggttctacgcagtggctaggtttgaagaccactgcctagatgtcccaatgactaagaatgtgcgctgggkacaagccaattctcttagtagaggctttccagacagaattcttattattgagaattgagaatycayatgccacacataatttatcgttttaaagtgtacagatcagtggcttctagcataatcacaaggttgtgccaccgtcaccactatctacttgggaagattttcttcctttttttctttttttttttttttgaggcggagccttgctctgttgcccaggctggagtgcagtggcgcaatctcagctcactgcaagctccgcctcccgggttgaccccattctcctgcctcagccttctgagcagctgggactacaggtacccgccaccacgcccagctaagttttttgtatttttagtagagacggggtttcactgtgttagcaggatgctctcgatctcctgacctcgtgatctgcccacctcgacctcccaaagtgctgggattacaggcgtgagccaccgtgcccggaccctttttccttttttttttttttaaaggctagtcaagtgaaacagtgggagtgaagatgaaacaaaaacatctataactggttgtgatcaattagttgtaaacaccactgcactcagaccagcctaaytgggaagattttgaggatatgctgtggtctgatgggttccaaggcagaggtgacagtaacctggaagagggagactgcttaggcagtggcatcctggtgggatagggtgaggagatcccagagcccacgtttactgcaaccctggggaaatgtcaccagagaaatggrggtggtgccagacaatagattgtgggagctatggtttccatggtagagtagaagcatcyaccatstgtgacattcagcagatggggcgctgtgggtggcttggagcactctggttgtaactgaggcaggcacagtgtttaggaagcctgtgcagtaatccagrctgaagggaggggaamgcctagactaasaytrtggctgtgggattgaaatagcgttgaaggagctgactttgactcccggagatgaaggrgaaagaggaaatcagaagggaccaaggatggtgaagttcttaagagaaactgagkaggaagagaggatgatgtggtgggagacgtgtagagagtccttgtagatctgtcayattgaaggggactatggtcccagaggtacagatgtcctaaaacaggctggaaaagggagtctggagagagcttggtgttgtaatgaaccatggggagccgcctcgttggccctgtgattacccaggaactgaatagagagggggccctgggagacctcagacacttagaggatataagggggtgaaaggggggacctggctttgagtcgaagggaggagaaggagattatatagctgaaacgtctaagagaatttgtgatctgagcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatctcccctccccaacccagacctaaaacaggctgttgggccagctgttccttgaccttccttcttttcttttggttccttgaccccagtgggctctcactccccacaccgcatatctaaaatctgttttgcctgctcttggggtgccactgctccccctccagcattactccttttggcaggtccttcctcaggctgagaatctccccctctaccttggttttctctctctggccagcacccccacyccttgctttgtttttaatttttaacttttgtttgggtacrtagtagatatrtatgtatatatttatggggtacatgggatattttsacacaggcctacaatatgtcataatcacatcagggtaaatgggttatctatcacaacaagcatttatcctttctttgtgctacaaacaatcccattatgctctttcagttatttttaaatgtacaataaattattgttggctgtactcaccctgctgtgctatctactagatcttattcattctaactatatttttgtacccattaaccatccgcactcccccactccccactacccttctcagcctctggtartcgtcattctattgtctctccccatgaggtccattgttttaatttttggctgccacaaataagtgagaacatgcgaagtttgtctctctgggcctggggcttatttcacttcacatgatgacctccagttctttgcaaatgacatgrtggctgaatagtactccacatacacgtgtgcaccacattttctttctccattcgtctgttgatggacacttaggtcgcttgcagatcttggctattttgaatagtgctgcaataaacatggaaaagtagatagctctttaatataccgatttcctttcttttgggtatatgcctaacagtgggagtgctggagcatatgacagctctattatatttttagtttttggaagaacctccacattatttcccacagtggttatactagtttacgttcccaccaacagtgtacaagggttctcttttgctacatcctcrccaggattccttattgcctgtcttctggataaaagccagtttatctggggtgggatgatatctcgtaggagttttgatttgccttcatctgatgacgaatgatgttgagcaccttttgatatacctgtttgccatttgtatgtcttcttttgagaaatgactattcagatcttttgctcatttttaagttggattattagatatttttcctatagagttgtttgagatccttatatgttttggttactaatcctttgtcagatgaatagtttgaaaatattttctcccattcttggatggtctcttcactttgtttattgtttcctttgctgtgcagaagctttttaacttgatatgatcccatttatgcatttttactttggttgcctstgcttgtggggtattacttaaaaaatctttgccagtccaatatcttagagagtttccccaatgttttcttttatagttttcatagtttgaggtcatagatttacatctttaatcctttttgattggatttttatatgtggtgagagatagggtccagtttcattcttctgcataaggatatctagtttccccagcaccatttattgaagagactctcctttgccctgtatgtgttcttggtaactttgttagaaataacttcactgtagatatatggatttgtttctgggttctctattctgtttcattggtccgtgtgtctgtttttatgccactaccgtgctgttttgattactctagctctgtagtataatttgaagtcagataatgtgattcctctagttttgttctttttgttcagggtagctttatctattctgggttttttgtgattccatatacattttaggattgtttttctatttctgtgaagaatgtcattggtgttttgatagcaattgcrttgaatttgtagattgctttgggtaggatggatattttaacaaaattgattcttccggctgggcacggtggctcactcctgtaatcccagcactttgggaggccgagtcaggtggatcacttgagatcaggagttcaagaccagcctgatcaacatggrgaaaccccgcctctactaaaaatacaaaattagccaggcgtggtggcatatgcctgtaatcccagctactcaggaaagctgaggcaggagaatcgcttgaacccaggaggcagaggttgtggtgagctgagattgcaccattgcactccagcctgggcaacaggagcaaaactccatctcagaaaataaaaataaacattgattcttccagtccrtgaacatggaatgccttttccattttttgtgtcctcttcaatgttttgcatcagtgctttatagtttttattggagagatctttcacttcttcagttaagtctattcctaggtattttatttkatttgtagctaatgaaaatgggattcgtttcttgatttctttttcagattatttgctgttagcacatagaartgctattgwtttttgcatgttgattttgtatcctgcaactttactgaatttgttcttcagttctaatagttttttggtggagtctttaggttttccaaatatcagaccacatgatgtgcaaacaaggataatttgacttcttcttttccaattttgatgccctttatttccttctcctgtcagattgctctagctaggactkgcagtattgtgttgcataactgtagtgaaagtagtcatccttgtcttgttccagatcttaaagaaaaggctttcagttttcccccattcagtatgttactagctgtgagttgtcatatatggcttttrttatattgaggtctgttccttgtatactcagtttttttagagtttttatcatgaagggatgttaaacttatcaaatgctttttcagtatcaattgaaatggtgatatggcttttgtcctttattctgttgatacgatgtattacattgattgatttgtgtatgcatacctggaatayattccacttggtcatgaagaatgatctttttaatatactgttgaatgtggtttgctagtatttcattgatgatatttgcctcaatgttcatcagggatataggcctgtagttttctttttttgatgtgtctttgcctgattttgatatcaggatattcctggctttgtaaaatgagtttggaagtattccctcctcctctgtttttcagaacaatttgaataggactgatatttcttgttctttaaacgtttaattgtggtaaattatacattacatacattttactgttttaaccgcttttaagtgtatactcggtggcattagatacattcacatttttgtgcaacccaaaactctgtacccattaatcrgtaactccccattcctccctacctctggcccctggtaaccatcattctactttttgtttctatgaatttgaccactctaggtacctcatttaagtagaatcgtgtaatgtttgtctttttgattctggcttatttcacttataatatttcgaggttcatccaggttgtagtatgggtcagattttcattccttttaatgatgaataatactcattatatgtatgtaccacaycttggttatccattcctcagacaatggacacttgggttacttctaccttttggatattggcaaatatttcatttctcttgggtatatatttatttcttttgartatttcttttgggtatatatccagaaatagaattgttggatcatacggtatttcattttttaatttttagaggaatcaccatagtgttttccattgcaggcgtgccattttgtatttctagaagcagtatacaggggcttcagtttctctacctccttgccaaacttgctgtttgtgtgtgtgtgtgtgtgtgtgtgtgtgtgtgtgtgtgtgtgtgtgataatagccaccctgattggtttgaagtggtatctcattgtggtttggatttgcattttcctaatragtactgatattgagcatcttttcatgtgtttattgatcatttgtatattttctttgaagaattggccattgaagtcttgcccatttttctcccccacatagcttctcatggctattttgcccatttttgagtgggttgactgttttgttgtttttgtcaaacttttttgcatattctggaaactaatctctctctttttcttttttttttttttttttttttttgagatggagtcttgctctgttgcccaggctggagtgcagtggcacgatctcagctcactgyaagctccgcccgctagcttcatgccattctcccrcctcagcctcccgagtagctgggactacaggcgcccgccaccayacccggctaattttttgtatttttagtagagatagggtttcaccatgttagccaggatggtctcaatctcctgacctggtgatacacccgcctcggcctcccaaagtgctggaaytacaggcttgagccaccacgcctggccttctggaarctaatctcttatcagatatatgacttgcaatatttatttcatttcaggggttgattgctttctcactctgattgtgccctttgatgcacagatattttgaatttttcatgagtcyagtttgtcagttctttctattctatctgtgctttggcgtcatatccatgaaagcactgtcaaaccctatgtcatgaacattatacccaatgtttttttctaagatatttttatgttttagttcttgagtttagagtttaggtctttgattcattttgagttaatttttgtatatagtacaaattaagggtccaattttatattatttgaacatccagttcccccagcactatttgctgaaaagatggacttactctttgataccctgtcacctgcccaccccagtggacactagctgktccatccaattgctgtcctggggccttgtcatgccactcttccactttgracccaagcccacaycrttgctcccctctgggatactgaccccactataaacttcwctrgggctacaaccttcctaccccttgtgcctcatgaccaccccctcccttgtccccaccatgcccatgatgagtcttttctcraggcagctcsccttgcctccatctcaccctcacctgtgcaccacagccacactggacatgggtccctctgagcctgagtcccttcccattcccacygtcccctctggcaagaccttccttccamcactgccttcatgctcctccctygcccctgcagggcagcctctccccttggcccctattcccttagggggcttgtggccacccagtcctggcacctgacctacaagtttgccatcttcattcccccttcttctgttcatcagccccctcctctatcctcccaccctcacagttttccttgtatatgaaatcttcgttcttgtccttttgcccatgygcatttcctgcctcctcagggaggtcgggacagcagacctgtgtgttaaacatcaatgtgaagttatttccaggaagaagtttcacctgtgatttcctcttccccagagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaaratgtcctgggagctragacctgggacacagagaccgaggacttgacagagaatgggcaagacctcaggaggaccctgactcatatcaaggaccagaaaggaggtgagagtcggcaggggcaagagtaatgggaggccttctccaggaaagttggagacagagagcagggacctgtctcttcccgctggatctggctgggrgtggggatgaggaatagggtcagggaggctcagcagggtggtgagccggaactcagcccacacagggaggcatggaggagggccagggaggggtcgcygctgggctgagttcctcacttgggtggaaaggtgatgggttcgggaatggagaagtcactgctgggtgggggcaggcttgcattccctccaggagattagggtctgtgagatscatgaagacagcagcaccaggggctcccggcatttctactacratggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacaggtaccgaccctggccaggggctctactgttcccgcaattctgctagagttgcctcgcctcccagctctgtccrgggaaaccctccctgtgctatggatgcaggcgtttcctgttggcatattgtgtcctgatttgcctctcctgttagagccattggataaagacagtgggtctgggactgaactgtccagtgttgtaatctgggaaagcagtgggccctctgacagaagcctgagcctggkgtgggagttaggcaggagaggaagccctcagggccagggctgccccctctgcctcccggcctgcccatcccggagagttccctcctggccccatgacccaggagtccacccttgacatccccctcctcagcatcaatgtggggatcccagagcctgaggccacagtcccaaggcccatcctcctgctagcctggaggaattaggccccagggtgaggacagacttacagaaggtccggkatctgtgagggattcagccagagtgagaacagtggagaggagcagccctgttccctgcatctcccttagaggggagcagggcttcactggctctgccctttcttctccagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcayrgcactcaccctgtgccctctggtgagcctggggtgaccctggagagggtcaggccagggtaggaacagcarggacggctgtggctctctgcccagtgtataacaagtccctttttttcagggaaggcgctggtgcttcagagtcaacggacagactttccatatgtttctgctgctatgccatgttttgttattattattattctctgtgtcccttgttgcaagaagaaaacatcagcggcagagggtccaggtgagaaaaggggacagtttctggagatgggaaagctcctttctaggcagtagggtctcctcattgctcctgcccagacaagacgtaggtgacaaggctgctggracaggggatggaagctggggtatttgggaggggaatgggagctgcatctccatctacacccataagtgcttcycaagccagggctggggcaaggccttcgaatatccagctgtggcctcctcctgctgcaagtgaggagtgggcagcagggagggctgtggcacctgctctgtccccatcccagcctctctgtctctcgggctcactagggtgcrtccaggtggggtgagttgggaatcacgtgctgattgctgagggcctggatgatcatggtgtcagagggaggaaatagtaaaggtggctgtgatctggggagggccagaaactggagaggaatccaaggagaggcrrtgcccacccgtgtgcctcctccaggaggcactttccaggttcccacyacctggcctccctgagtttccttgcagatgacacagatgaatagataagcagatgtccctgggccatttgaggagcggggcccagcccctcatcagggcagttgtggtccctgttttcatcctacctccagcgtgttttcttctgcagtccctgagggacacagtccccaggcgccatctctttgaggctttgttctgtgctctgtggccttaccttgccctccctgagccaatttccctttctcaaggtggtcactgcctggtaagtttggagtaagggacrgtcagaagcatttcccccacagtcaggttgtttgatgggrgatgaaaagagacagcagaagttttgtgtttctgcaaaaacagaggcagtgcaggggacagtgagaggctggggtgtccaggagacctgagtctggcggtaggggcgctggtttctcatccttgaacctarttgcactgtcagtcggcccctcatgcctgagcagatgggaaggttcgtcccctgccctgcagcaagagggcccyrtccaggaggcacccacagcaggggcagtgcaggtctgtggtcactcctgctctcacctgcggcgtctcccgtggagggattgtcacttctggttccctgtgggcaggaatggtttccwcgtaggtcactggggttttggccaggaaaagggtatgaaattcatgtgccagtttmtcaaaattcctgctttcaatgttgatgtccaataaagatgttcgtaatttcagctctataatcttaataggatttcctctaatactgctgttgtaaagcatattaaataaaacaggaactcaaatttggagccccctctccagaagggtctgtgtggagatggtggctgtggcagcggcagttcccaggtgcagagggtgggcagaggcagcctcaggctaaggggtctcccctactccacgtggagaaaagtccttgtaggttgcaagggcagtggcctgggtggaatccctgctagggacagagcaggaaggcctcrcagcctcaccaagcagcagcyctggggtgaagtaagtggaccaggagtaagtggaccaggcaggagcagtagtgactcaacagcaggtcacaggcctaggtgggtgctgaaggtcatgggaggccaggcctcctcgagcaaggtggggggtcccagggtcakgtcaggtgcagatcctgtggcagccaygtctttccatgctgggcctgctgggccccccaggcttcctgatggggtccccagttaggagctgcctgctcagggctgggaggggaggagtgctgagctgcagatagagggcagggcccacagtgggcagggcctgccctggtgtgcaggtgcctctgcaggagagragggcctggggactgagagcaagggtcagggcctctctttggggaggcctctcactgtaacaggactggtcaggcctgagaggagggcactgggttccctcttgggtcttgtccttttgtcttggggccctttcmctccctgcacggtgagtggtgggcacaggacaggggctgatgttgatggagtgatgggagagaactgacaggggctgggaaaagcaaggagggaggaagaaaaaagtgggggcctcatcttctctcagagaaagggygaatctgattttggggcaactgaagagagaaaagtccttagggaataaacacaacactgcacccagtggagcatttacccgtttccctcttctccagagcttgtgagcctgcaggtcctggatcaacacccagttgggacaggagaccacagggatgcagcacagctgggatttcagcctctgatgtcagctactgggtccactggttccactgagggcrcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaatagacatttctggtctgtgttttatttcatgcgtctgggagcggataaagtgtgaggttcagggagaaggagaggtctgtctcaatgccttgacccagcatcaaagcaatctcccctccttgttccctttccctgctagttcccaatgactgacagattcacagcagaacagaaaggactgggaagggatggaggtgggacatctggcgccaatattcaggggctgaccctgtgagggaacatctgccctgaagagttggagccttcatgtgatgacacagagatctctgtcactgtattcagggaaaggatcaagcctcactccccatgcagggaggaggttctggctgtgatccggcctgtgggagaagtgaggacccgctccctctacagtgacagccaagaacctgcaggtgacagagaaggcttcccctcaactgtctcctatcaggttcttccaggcatcaaggaatagacctgggacattgcctccagtgacatgaacacacccagaagtgaggtggccctgccagggggtcctggtgctgccacttgttttgggagctcagtgtctggagaggggtgtggagagtaggctttctgcaaaacagtaatcatgacctataaattattttattcttcattagctttttgccataaaataaaacaggtacccaaaaagaaaaactgtctgaaaatgttgccctttaataataataataaataataataataaaagataaacaccctttaaccaccagagatatagaagtttgtcagccagcccagaaaccatcatttgccccagctcagtgataaaggcttcccttccccacataaaatcacagcctgacctttatgatgattgcttctttgttctattttatattttcatcctctgaaattgtagtttagttttaccttgggatgtataatttttgttctcttttttcttttttttttttaagacggagtctcactctgtcacccaggctggagtgcagtggcatgatctcggctcactgcaagctccgcctcacgggttcatgcgattctcctgcctcagcctcccgagtagctgggactacaggcgtctgccaccacgcccggctaatttttttgtatttttagtagagacagggtttcaccatgttagccaggatggtctcaatctcctgacctcatgatctgcctgcctcggcctcccaaagtgctgggattacaggcgtgagccactgcacctggcctgttctctttttttctctatgctcctccttgaaattttattgtctggctgagttttccatagtttgcattttgctggctccaccccaaggcatagtttaatatggacctgttttatctgtactttctacaaattggtagttggctacagagatttgcttatagactgacttgattttcttcttgaatacttcatttatggcactccattgtattcttccatcaggaggaagaacttagtactggttatttacttctactctacttttaattgccattgcttttcaatggctaaatctgttaattcgttatgggttgcaaaagaattatagtctcagtctctcattccttccccattcactagctgaataatttctaaaataagagatttacccttggctggatgcggtgacttacgcctgtaatcccagcactttgggaggccgaggctggtggatcacctgaggtcgggagttcaagaccatcctgaccaacatgaagaaactgtgtctctactaaaaacacaaaattagccgggagtggtggcgcatgcctgtaatcccagctactcgggaggcggaagtaggagaattgcttgaaccaggaaggcggaggttgcagtgagccgagatggcgccattgcactccagcctgggcatcaagagtgaaactccgtctcaaaataaataaataaataaagtggagcacttgacggccatgggagagaatcggttatgaccacacacagcaagatgatgagcccaacaaagatgatgagcccgactacatgaaaacaacttctaatttcattcaatcagaaccaacagaactcatctacagtgttaaaaatcaagacagtggctactctagggtgggggaggctggtttatgactcaacggtgtttcttggagggtgaaaatgatgttgcttgatgaaggtgttgtttatcygagtttttacttgggcaaaacccactgcccacctgtgatttgtccacctttctacatgcatgttgtccttcattcaagtttacatttctggtgttttgaaacaattctctctaagctaatatagaatttctcctactccaagtccttagaaatgctgcattgaaaataccagtgaatttttttttaattccaggaaataaatgcccatgactcagatataaaaaggagaatctacaagagcagtaggcttgggagctgacaccagaacagctttggaaagggctgtcgagccaggaactaggaatcaaaacccaaacaagaccacaggaggtagagggtagaaattatgccccagtagtgcatgaatgaatgaatcaagggcagtgactcatgggttgcctggccagtctggaacttggggaaaataaagttgtaaaattgggggatggaagagagaagtgtgcactgaccactttccatgggaagagcatgtgaagatagaggttgcatatggatgcctgccagagggtctccaaggggctggggctccctgtaaccaggtgagcgagatggcttgatggatgatgccactcagccgcacaaggcttgctcatgagtccctgcacaaagtggccgtggtggctgggatggacactgcatggacagagcaattgagtcaccactcaccaaggctgacctggcagctgccactgctgaggacccagcctgccaaaagcagctgtttctttgaacagagaaaaaaaacagacaatgttaattaagagcaagacagtgttatgacagataaatatgccactgcagctatagtagagatgtaaacaatcttgaaattataaaaaaaaaatgtcgatggaaaagacttactgcaagtaagaagttaaaacagttgtaaaaattctatctctgcccaactatatacagattgtttcacagggaagtcctactaaaccttcaaagaaggttattggacttatttaaaatattcaagagaatggagcaaaatacagaaagctaggcaactcactttatcagctatgaatagtgttaattctaaagccagttagggaacaaataataaagaaacaagataggaaaatcactattagtaattagatgtaaaatagatgagaaaaatagtagactgtgtccatcagtgtgctataaacaaattaaatatcttgaccaagttatgaatcccaagaataaaagaatatttaaactttaaatcttttaatgcattttaacacttaattcaataatttaaaaagagacaatcatatttcactagatgtagaaatcactgtagatgaaatctaacactacacctgacctacatttcttcagttatctccacttttaagaatttgtgatcagtgcagcactattcacaatagcaaaggtaaggaatcaacccagatgcccatcaacagtggaatggataaagaaaactgcggcacagggccaggcgcggtggctcacgcctgtaatcccagcactttgggagggtgaggcgggcagatcacgaagtcaggagttcgagaccatcctggctaacacagtgaaaccccgtctctactaaaaatacaaaaaattagccgggygtggtggcgggcgcctgtagtcccagctactcgggaggctgaggcaggagaatggcatgaacccaggaggtggagtttgcagtgagccgagatcacgccactgcactccagcctgggtgacagaatgagactccgtctcaaaaaaaaaagaaaagaaaagaaaagaaaactgcagcacttatacaccatggtacgctacccagccaaaaaaacaagaacgaaatcatgtccttcacagcaacatggatggaggtggagaccattattctaagcaaattaatgtaggaacagaaagccaaataccacatattctcacctataagtggcagctaaacattgagtacacatggacacaaagaagggaacaatagacactggggcctccttgagggtggagggtgggaggagggggaggattaaaaaactacctattgggtattgtgctgattacctgagtaacaaaattatctgcacaccaaacacccgtgatacacaatttacccatgtaacaaacctgaatatgtatcccttgaacctaaaaaatcaaaaagaaaaaagtaaaaaagaattcctgatcagattgagccaggacaatggccgggcgtggtggctcacgcctgtaatcccagcactttgggaggccgaggcaggtggtcagggtaggcctcttggaggagccatgtgagcagacttgagaaggagagaaacagccatgcagatatttgaaggaagaaccttccagtatcccgctctaagcatacccaggactctgctctggggcagaccctaaagctgcagtggaaatggaggtggccacactcacagagactgtggcagagagtgatggggatttgggtctccccttcctgctgtggctgttagaagtgctggagttggggagggaaaggcactggcatgtggaggaagactaggagaggaggggaggctgaagtgtgtcccactctcactccacctctctgttctctatctcctgcatccggtgcctccccgacttccccaaagttgtggtccctgacaaggargaccctgagggcaaccacaccttgccatgtagagcacctggcttctcacttgccaacatcactctgacctggctgcaggaaggggaggagccaactctggactcaagactcaaggggaccagacccaggaagatgagacatatcagggctgggcagctgtggggggccctcccagagaaggcctgagatacacctgcctgcaggtgctcctgggcctggagaagcccctcagtgtgactaggtgaggtgttgtcagaggaccagaggctgagggtggggcgtcccatccagatcctgcccccctctctgccccagcacccaaggccccttcctccctcctctatggagatgctggggatgtcctcattctccctctgagcactcacatctcacccctcatctgtctctctaacctccttccttcctgctgcagcttctgccccagccccaggctctggcctctctctccccagttccaccctccagggggtgatggttcacttccctctgaggagccagcactaggtgagaggctaggagaaggaaaagctcatgggccatgggttgggagggagaatgggcactgaaatggaagggtagggagacagaagaggcaggtatttccaaatcaccatttttctgtcatggtccaagggtgccatccttctcccaggcccagggatgtggaaagagcagcaggaattgggaaatactccacaggaaagaacaatgtgcctcctccctccaccggcttcttcctcttgtctattctggtcaattctctaagtgaatcatgttaccaaaatgtaaaatgtttattttaggaaagtctccaaatattagggaataaaattactagtgcctaagccctgcatactgaaaaacagaagctttaagaaataaagacctgcatggaaaattgctcatcaactcggggaagtcaaagtctgagctgaatcagctctttttttctttctctttttttttttttttttctttttttgagacggagtcttgctctgtcgcccaggctggagtgcagtggcatgatctcagctcactgcaacctctgcctccccgactcaagcaattctcctgtctcaggctcccaagtagctgggattacaggcatgcgccaccw

SEQ ID NO: 17644 - DNA, 187986 bp, Homo sapiens
  misc_feature (1)...(187986): n = A,T,C or G, or insertion/deletion polymorphism (see Tables 1-2)
gtataacatctggaaatttttctatctcccaaggtaattaaccccttagtggccccatttggtattcaagtggaaaatccaccgaagtttaaaatctaggggggatgcctaaataacagggccattcacgtacaacttttcacaaagaccaataacattgtggtataaactttgacaatcaagtcttatttgtaccgaaatccccaggtgatggaaatcaggacctggtttgggaccaggcctggctcagtgatcatgcctggacatacaagccctgtgagtacagatttggaccatacaagtaaagtgtatgtagtagccacaccaatgtttaattatttttatttttttgtgatacagtgtctccctgtgtcgcacggtgtagagcacagttgtgatatcggcgcattgcgagctccacctctcatgtgctcaccattctcctgcgtcagcctctcgagtagctgtgactacaggcgcccgccaacacgtccggataattttttttgtatttttagtagagacggggtttcaccatgttggccaggatggtctaaatctcttgacctcgtgatccacaggcctcggcctcccaaaacgctgggattacaggcgtgagcaccgcgcccggccttgttctggtttttaaagggaaagtggcttccattttaccataagtatgaaatatgctctgtgtctcaggccaaggaccttcccttctttttataggttacttaagtgttttgtttacttgttttccataactgggtgttgttgacttttacaaaactgaaagcttttctgctttataatttaatcgttttttaaaataaattttaagcttatattatgaagtgcacataaatctatagattccatcttcctggtgcattgatctttgtatcacctttttctactctttggtgctaatgatgactttgatcttaaggtccactgtgtgtgatagtggtataaaacgcttttccttggccatcacttgcctctcctttcttttccttacggtctttgtgtgtttatattttaggactgtctcttgaacattgctggattgtgtgcctttttaaagaaatccaatttgataatctctacctttttattattgattattgatctgtttgaattttttgtactgttgcatttacattttatactatttgtcttgctttttccatttttctcctagatcaatctagtttttaaaaatttcttgttttttttcgataggtttagaaaacatacattcaattctattctttcagtagcctcccttaaaatcttactatgcagtatagccttaactaagtctaaagtgatcatgacctgtttcttccttctgagccatrcaaggaccttaatacactttcactcctgtcttacatgtcattgctatctggtattttggttctaatttttaataactctccaacttatcattaccattgttattgttttatataatgactgcctgctcatatttacccccatatttactattttatttatttaccttttcttggcatcctgtttctaggctgaattttcttcttcctggcagggcgaggtggctcacacctgtaatcccagcactttgagaggccgaagcaggaagactgcttgagcccaggagctctaggagtttgagaccagcctaggtaacatggcaaaaccctgtctctacaaaaaaatacaaaaattagccaggtatggtggtacatgcccatagtcccagctactagggaggctgaggtgggaggatcgcttgagcccagaaggtttaggctgcagtgagttgtgactgtgtcactgcgctccaccctgggtgacagagaccctgtctcagaaacaataacaaaaaatgttttttctccctgaaattccttctttagtagtttcttcagaaaggactgttaatgttaagcccactctgtttttccaaaaaaaaaaaaaaaaaaaagtctatgtttcctcaactctgaacaataatttacaggtagaccagatgttacagtccctctgccacggccctctaaccccatctctccgtttcttctagactaccagtgtctgctcctccgtgcctgagggccagaagtgttgagggctgaatgcctcctgaagcagccttgacaataactgacaggaaggagtaagtgtagaaactctcctgctccctgacccaagagtgggaagattcagaggcatggatcttacattttcccagacttccctccagaaggaagctttcttgtccacttggtggctggcataataaacatcttttattgactgctttccctgccccgtatcacattcccacttccctgccgatgcttcctgtcctcccaaatcaattatctacactaaaatactcagggtctgcttctgggacttcaaactaagacactgcatatagaattctccacaaatggacttcttctctcagcacttctctttggatcttctaattctatcatgtttcttaattctgcctccatttttttttttttttttttttttttgagatggagtctcactctgtcacccaggccaaagtgcagtggtgtgatcttggctcactgcaacctctgcctcctgggttcaagcaatcctcctgccccagcctcttgaatagctggaattacaggcatgcaccaccatgcaaggctaatagttgtatttttagtagagatgggatttcaacacgttggccaggctggtctcgaactcctgaccacaagtgatctgccttacttgggctcccaaagtgctgggattacaggcataagccactgtgcctggctgctcttccattttttcatctctatatttgagtgatttctttagaaccatttttcagctttttttttcccaaaaatatctggtgtttttgaatttttcaattaatttactatatacatttcttaaagttctttttttttttttttgggacagtatctcactctattggctaggctggagtgcgcgattatggctcactgcaacctcaacctcctgggctcaaggggtcctccctcctacctcagcctcctgagtagctgtgaccacaggcatgcaccrccaggcccagctaattttttatttttattttttgtagagatggggtcttgctgtgttgtgtaggctagtctcaaattactgagcacagacaatcctcttgcctctgcctcccaaagtgttaggattacaggtgtgagcctccacgtctggccttaaagttctttttcaagttttcctcctgttctttcttttttttttttttttaacggactctcactcggtcaccaggctggagtgctgtggcatgatcttggctcactgcagcctccgcttcccgggttcaagcgattctcctgcctcagcctccagagtagctgggactacaggtgcgtgccaccatgcccagctgatttttgtatttttagtagagatggggtttcaccatattggccaggatggtcttgatctgttgaccttgtgatccacccaccgtgagccaccgtgccctgccttgaaaaaagtttattctttgtaaagacagggtcttgctgtgttgcccaggctggtcttgaactcctggtctcaagcgattatcccatctcagcctcccaaagtgccaggattatagacatgaaccaccgtgcctagcctctattataattttaaacactcatttttttctttttatctttctctgatgattttattatctgaaattcttagggatttaattcttgctcatggtagattgttttctcaagtgttgaaaaatttgtgattttgaattcatcgtcaagagagctttatttgcatgagtgcaaaggatgaaaattctagactgggcgtggtggctcacgcctgtaatcccagcactttgggagaccgaggtgggcagatcacgaggtcaggagtttgagaccagcctggctaacatagtggaaccccatctctactaaaaatacaaaaaattagctgggtgtagtggtgtgtgcatgtaatcccagctacttgggaggctgaggcaggagaattgcttgaagccgggaggcagaggttgcagtgagccatgattgcatcactgcactccagcccagcggacagtgcgagactccatctcaaaaaaaaaaaaagaaagaaaagaatattctaaaaaaagacttaattccccccsccaccccaccccaaaacaagtggagacaggcaaacttccttatcttctaggttgggggatggatttttttcctggtccactgtttggaagatgtttcccttcaaactttcagcttttgcagggatctccgttctagttctccctctgggtcaggcccgtagctgcactgcccattcttgtaatgtgcggcctccagtctggagggttcccagactggcctacgctaggccacccatgggcctaccctgcctcatgctcatttaggctcctcttcctcattgaccctttaagatattccttactttcctcccagatcaactgtggatttaaagaacatttgttgtatttagcacagcatttaaagatattttgtaatgaaagggttttcagattagttatttagtttttttaaataagagctggaagtggaaatcccgatggccttttcttttcttttcttttttttcttgagacggagtcttgctctgtcacccaggctggagtgcagtggctcgatctcagctcactgcaagctccgcctcccgggttcacgccattttcctgcctcagcctcccgagtagctgggactacaggcgcccgccaccgcgcctggctaattttttgtgtttttagtagagacggggtttcactatgttagccaggatggtcttgatcccttgacctcgtgatccgcccacctcggcctcccaaagtgctgggattacaggcgtgaaccaccatgcccggccccccaatggccttttctactgtctcatgctgattctgcctctggtgccatttttcttccttgggagtgtgcatcttcctctcctggggcggtaaagggagtagcagagtgcgaggtatgtgggaagggaggaggttggaacctagtggtttctcaaagtcttagggcaggaggtatcatggagaagcagtgaggaggtcttccatacccagacatgcctcagggtgcttgtctcagtgcctggaatcccagcacgagagtcatcttccccccaccgctgcccattgcatcagttacttattttagtaggaattagtttagcagatggtgttgagaattaggcttttgggaatgggaggctgggaagaagaattgtgtgtgtgtgtgtgtgtgtgtgtgtgtgtgtgtgtgtaagatcagggtaccagaagtgggtggaaatgtccttgagaattagaattattagaatgtagcaacagtagaagtattagactcaaaccatcactccccaccttcaccattttacaaaggcttaggcttgtggccaagaccttcatctttagccgatccattcaaccctggccaggatccaaatggactgtttttgtcagggccaggaccggatccttcatacctggggtgcataggaagtgttagtactccccttcctccaaacacagcagcaaaattggctcaggttgaggtgtttttctcaacttccctggagtccagccctggaagctggatcaggaagctgtgttgttctactgtgattccccctggcctgtatcagcttgccctgaaacaaccagcattcctggttatcccacacaggtggggcactctaggaagaccagggatcaagtgtgggggtgtagggatagggggtgtttggggagggcaaggcagttaattaaggcagctgccaggaggtctccctccaaactctacaaagctttatcagcttggaggtacttctaataccatttcctttcattgtttccttttggtaattaaaaggaggccaatcccctgttgtggcagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaaggtatggcctttggaaggagagctggctcagttgtgggaggaagatgcaggactgactgatccctgctcctggggagctggagttctctgtcgctggactagaagggctttgtttggaggggcaattcaattcagccagggatgatcctaatactccctcctccacttgcctctgagggtcctggggctgcttttcttcatgcagtgggttttactgtttgatagtacttcactcaaatgagttggaatgaagtttgccctcacctctgagaacctgggagcagctgaatgtacctgcgtgttaggactgggaggggacacctgcttggagaccgagacctggcagtatctgacatctcagtgttccttccacagatgtatcacagattggcttgatttcacctttggctggatgggaccttaggtaggaagggagtcacccccagtgaatctcaggcagcagattctgcacttcatttaacaacttttcccgaggagaggggctacagcaggggctctaagtgacttggggtacgctctgccagccaggatgaattgtccctctcttgggggtcacacagtggggaagtctgcctgcatccagggccgctggactcctgtccattttttcagatgaactcagcaaacatttgctggrcatctcctgggtgctaagcatcttgccaggtgctggggttggaggcaagggagacagcctttgctcttgtgaaggcacttgtggtacagagtcaggggccaacaagcaaaccgtcaagttggtggttcctgagcattctctatgtctgggctgctgtggtgggcacacaagtgtaagacggttcctactcgccagtttggatgcagaggcaggaaggaatgaggtgtgtgttagctcccagctgcttcaggaggcagggatgtgaggcccagcgggcctggagggaaggcagcgttttcctcctgtcttgggcctgggactgctgtctgtggaaaggtgcccacaggtcccagctcacagcgattgttacccttgggcctggcactggccaggggttttttcgggggccagaagtccatgttcaaaggggaaaagrgggtcacgaggatcaatcttttctcctgctttaaagaaatgtttttgctactgcatgccctgatagtygccacaccagcagccgcctacctgggcagcaatgaccagctcacgtctcttgcttctttgcagatgattcctgccagatttgccggggtgctgcttgctctggccctcattttgccaggtaggtacaaaagggcctccatttctcattcctgccccagggccatctggagtgacacctttccgggaatcagcaggtgtgtctggagctcacctgtgtgcccagccctaacttaggctgttggttgcctcctgtgaaggttctgcggagttcccacccttgacttgtattccagagaccaggtgcctgcaaatgccatctcctgttggggaattaagaagcataaaggtggcacagaactgtcctatattatgggggcacaggatgaggaggaaggaatccaagacttggatggattattagttttcgataagattgtggaggtcaccttgttgaacctcccatggtacaatgaagagactgagggtcagagaggagaaatgactgctccaaagtctcctagagccaaaatcagaggtcagtcttcctgggttccaggccaacaccctttccactgcactgcatcatactgctgcccttcccttgctaagattctgggtctgcaaatggcgggaggggacttttgaccttgggcgctttccacttagatctctcaggtcagcagcatccagctactgcccacaggtgagtctgggaaaaaaaatacacatttgtcacactctctgcatcttcctactaggtgggtcttttgccggggaacccagaacacttagagatttactgctgtatttccccacctgccgacacacacacacccatagtcagtgaaggagttagcctgtgacgccggaggatttcacacttcagagagtctatgtgtcaggcacacagtctgatctgtttaaaatttaacatgcccaagacatgctagtagatttatgtacaaagatgctcactgcaatctatctataatattaaaacatggaaaaatgctagaaacctaacaatagagggctatactatagacattcagatgcaaaatataatgcagccactaaaaaccgcatattggaagtatatacactagcacgacaaattgtttacaatctattgagaaataaacagaggttataggtagtttgcacaagttggtcaccaatttataaaaaacccacagctgtatatatgctatacaacaaaatggaaagatgaacattgaaatgttaactctaatcatcgctgaatgttgggttacagatggttttaacttctttgtcttttcttttctttttctttttcttttttttttcgagacagagtctcactctgtcgcccagtctagagtgcagtggtatgatgttggctccctgcaacctctgcctcccgggctcaagtgattctcctgcctcagcctcaccagtagctgggattacaggcgcccaccactacacccggytagtttttgtatttttagtagagacagggtttcgccatgttgggcagrctggtcttgaattcctgacctcaggtgatctgcccacctcggcctcccaaagtgctgggattataggcgtgagccactgygcccggccagcttctttgttttcttctgtatgccccaaatttttaataatggacatgatgacattttaaatcagtaagtaaatgtcattgaaactaatggatttcctgaaaaactgttccttagttattgctgtgagtctggggtcatatctgggagctgaaagcaacagctttagtctcatttaggatggaaaatacctccccacagcccagtttctatcagaggcagtctaatttctacgaggccagagaggtttgagctgatggtcccagttgtgccctgagatcaccagcccaacctgtggcctctccctccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggtgagttctgggcactgcagggaggacttcagagggagggctggctgagctcagccctggtgtgggggaggattcctgctctcaggacagtgtctgagcggaaaggtcactgctgagaacaaggagaggaacagcctttctgtgacacgtagcccctcttggctttccccgggtctctccccacgggagccgggtgggatggatgaagagagtcttcatctttggtagtccactgtgtccgttgctctggggcccggcgatgccctgggaactccacagcatcaaggcaaatgatgaactagagaaggtgctttggaacgtgtaaaactccttgccagagagaagactcgttgttgttttcttggtggcctgtggatcagaacatcagcttatgctgaggacttcctgtattcctgcagaagggctggtactgtccctgccatgtccctgcatccccacaacagccctgggatgtagctgtagtcatcccagttttaccaatggagaaccaaggctcatgaaggttgcatgatccttccaaggcctgacagacaataaaaggtggagctgaggccgggcacggtggctcatgcctgtaatcccagtactttgggaggccaaggtgggtggatcacctgaggtcaagagtttgagaccagcctggccaacatggtgaaaccccatctctactaaaaatacaaaaattagccgggtgtggtggtgtgtgtctataatcccagctacttgggaggctgaggcaggagaatcgcttgaacctggttgcaataagctgagatacactccagcctgggcaacagagcgagactccatctcaaaaaaaaaaacaacccacaaaaaacaaaaaaactggactaagcaggccaaggacagagcccaaggccaaggcttaatctagaagagggctcagaagtgccccactcaagtttggtcaaggagggagtctttggcaacacctggacacttacctgagatctgggctgtagggctcctggggtcattgctccatcagtcagcggggactgacacagggtcctccatgtgcccagcactgggctaggctctgtctagcacctggctatagctatgagctccccgcattcctgctttctccctgaggccatctttgctacctgccctgactctgctgggaaacttatcacatatgacttctgggcactgccatccttcccactcctccatgagctcctcagggacaaggagcatgtctcactcatctgtgtttcctggtgcttagctcaccgagttctctgttgtgctgaagattatgtatttatttatttatttttgagacggagtcttgctctgttgcccaggctggagtgcagtgagtggtgcgatcttggctcactgcaacctccgcctcctgggttcaagcaattctcctgcctcagcctcccaagtagctgggattacaggtgccaccatgcttggctaatttttgtatttttagtagagacagggtttcaccatattggccaggctggtctcgaactcctgacctcaggtgatccacccgcctcagcctcccaaagtgctgggattacaggcatgagccaccatgcctggtctgaagatgtttacagagtgtgtgtgaggagccctagggaaggagctttgattggccagagaagacaggggagggtgctgcatgtggtggggacagcatgagaagtggggaggctggaaggggcatgtactcctgacatggagccctggggaggtcagtgtggctggagcagcagttgccaaactccaggctgcatcaggaccacccggagagctgtgacaaacagatcactgggccctgcccctggagttctgactcagtagaaatggaagggggcctgaaaatttcccaactgctgctgctgctyttagrgtgggtaaccagactttgagggtgcgggactggaggagagtaggctgggaggctgtaccatcgggtgaagctgcagtgtagggtcttggagtctgatggggactttgagtcgattccgcaggctgtgaggaactagtatagggtcttgtgcagcagggaagtggtgagaggaaactggttctttgccaagatggtcctgaaaaggagagaggtaggaggcggaatggccttggccgtggtaaccagggaggtagtgaaaaggccagaggcgccccagggcatgacaaataagaaagtcatcytcaacactgaccgtgagggtcccaacttgcttcagaggctgcagctggggaggagctggaagagcagctggagagaacccctgaacccctgcccctgggaagctgaaggctcatgccctccctaccttggtgaccccagattttatttaaagtggattttcccattttataaatcacggcagagctgatacagaccactacctgtgatggctctggggttgtcagtgggaatggagggttagaagtgaccggaagaggccgggtgcacgggtgcaatggctcatgcttgcagtcccagcactttgggaggccgaggggggcggatcacctgaggttgggagatcgagaccagcctggccaacatggtgaaaccccgtcactactaaaaatacaaaaattagccaggcgttgtggtgggtgcctgtatcccagctgctcgggaggttgaggcacaagaatcacttgaacttgggaggtggaggttgctgtgagccgagattgcgccattgcactccagcctgggcacagagtgagactctgtctcaaaaaaaaaaaaaaaaaaaaaaaaaaaaaagtgaccagaggaagattttgatggagacactgcagtgcccggggtgggggcgggtggattgctgtctggactccataatctctgttagttcagctctgctctggactccctgccccgagacgggctggtaaacaacacatactaataccttagtcccaggcacagagttcatgttctgggctcagagagccaagtcagcatgttgaaaaagctcccttcccctatttgagcccaactccagacctctccccaagtcagggtagccctaccaggtggggacatgtagcgtgtgctggtgcctctgggctgtctcggtcacctccttcaggaagccctcttgcccattccacccgtccagcactgggctcatcaactcgtgctcactggtcggtttccgtcccacagaactgggtggctctgcccccagcaggaaatggaagcacagacagagccagagttgcagtcggaaaacccgtgttctcctctgctctccctcttcactgagtgttccgagggcagttgtgctgtcttagcctccaattcctcatcttttgaaatggaatctcrctcgtgttgtccaggctggaaggctggattgcagtggtgcgatctcggctcactgcaacctccccctcccaggttcaagcgattctcctgcctcagcctcccgagtagctgggattacaggcgtgcgccaccacaccctgctaattttgtgtttttagtagagacggggtttctccatgttggtcaggctggtctcgaactccygacctcaggtgatccgcccgcctcggccttggttcctcatctttaaaatggagatactgtgagcatcaagggagacaggttatctgaaaatgtgactgcttagccaagctgagttattgaaagcagccagcttaacatggggtgttcacttggaatcgccatgcagagacaggggctgctgggcccccaggcatttccacgaggtcagggtcacttgagtttcawctccccctcataatccacacaggtttgtgctagaggtctggcctctcgggccaccgttttctgggtttcagtggtcacagaggaatttgaagggccatggaaggcctgtctacctcaaaaccccttggtgggattccccaccaggtcattattcttttcttataagctgtttgcccttgtgaagtgtccattttctgggagattgtttgcctaaacaaggttatggatcaaacacactttaatgtwaattgatttcattttcaccaaaaccgtgctgctaacatcatagagaatgggtggctgctttgcctcttgttggtggtggtggcaggtttggggtgtgtgggagaagaggaagaattagaggggggtgggctggcattggtgcatcagggcagccaggggcactgggtcaggggagggagcccaggacttgggccctgcagtttcagtttccgtgcacatgcctaccttcttttccattgttctgcaatgacatcctgtctccttgaccgtaaatcgcacatccacattcctcccgagtgcctgtggaccttattcatatcctgggaaaagtgtttatgtacgcacacgaagggccacctggtgccaaggcgaggcccctgtccttgattctgtctcctggtgaggcaggctccagggttcgaggccaaggcgacacggctgtttgccagacagcacagaggccagagagagactatgggagtcctggttcctgctcctccgtagagactgctcttcctaagctacggctgcaggatctggctctcatacctgccaagagagagccatcaacaaccaacagcctgctgagtcacttcccccggggagccttagtttccgtggcatggtcagaccagacccctgttctcagtttggagggagggtcacctgcaccagaatcacgggcatagaaggtagagtgtttagtggaaatgcagatgagtgagttccacactaaagcctaagagagcgcccaggtctgacggtagttccagctcctggcctgcttctgaaggtcccaggattcctctcactctaatatgtgggctaggagcttactcctcactcagcgccttaatcactgcgttcagcaggcctggtgggagcctctgggagagcttcgctggcttgtcttgcctctttggggtgacagccagcctctcttttcctaagagttatagaaagtgctaacctggaggtctgtggagtgcaggggtctctcctgggctcaccggcgatttctaatggctcgttttcctaatggctgcacatcatctgatscccctgagttctgcatggagggaatgagggaaataaaatgcaaggctggtctggagttctccctgcattagtgattagtgcaatcctagaacactccgatgccctgttacrcagctttgtgttgcaaaaaggggatttggacagtcaaaaaagcctgagtgtaggctctgctccatttccacagtggaaaccaggggttctcagtcggggtggttttccccctgaggacattttgcagtgtctggagacattttgggttgtcacaactgtggagtgggtgctgctggcatctagtgggtagagaccaggaggctgctggttctcccaccatgcacagggaagtgtctggcgctgaatgcaatagtaatgcagtggagaaatcctgctgtaaacctaggccttcgtttctccgtctgtaaaatgaagtcagcctagatcattgttttctgaactgagtcatgggccatgggtcctaaaatgagttgagtggttataactagcatttaaaaagacagaaaaggttagaaaacatcagaaaatatcagagtgcatggcacacggcaagggtaaatatgatatgaaacgtgtgtgtgtgtgtcctgagtcataaagttgtgtttttactgtgctttctgagcaaaagagtttaagagccgcttatttagattcttcctgctgccatagtatgtttttctgaattataggcctagatcacactttgaaaaatctcattgccaggctggacacagttactcatgcctataatcccaatgctttgggaggctgaagcgggaggattgcttgagcccaggagttcgatgccagcctgggcaacatagcgagacccccatctgtacaaaaatatacaaaaattagctgggcatggtggcacacacctgtagttccagctatttgggaagttgtgacaataggattgcttgagcccaggagttcgagggtgaagtgagctgtgatcatatcactacatgtcatcctgagcgatagagcaagacctcaaaacaaaagaaaacaaaaccccaaattcccttgccactcccctgctccggctgtggactgactgctcttcaagccccctcagccatccagggccaggaattctccttgccatgcagttcaatcctcactgaagggcacgatgcagccccactcctgcccctagactcctgtttttggtttgtctctgggtggatgggggctggttaccagaacctgaatcatccccttcaggagccccagttcctgcggtaggtgaagctccaagggcagccagccccacgtcccctggctgcctggagctgcctcacacrggctcagccctgggctgccccttggacttcctgatgctggtctctccttgggctgcccagagcaagcccttgacatacttaaaacagcactcgcttgagtcccagctcttcatcactgactagctctgtgatgataggcaagttaccmcagggtctgccgcctggccagccccgagccccgcagcctgtgtggacaggttcctctgttatttactctaggagggctggggctctccttctctcccatacacttctcctggttctctcctgtttgatttttctgcttctgctgaattcttggtttattcagccttgcaggccttactttacaaacttatagccatagcgacctccgggctcccctgtggcacccgctcagctctgcctcctgtggaacgagtaccttgcttaagtgattttgcatctttggaagcctctaagagctgtagatcagcagccacagggccatgccaaccccaagctgcctggctgcctctgaagcgttccctacccattctccagccacagtccctgggagacttggtcccacccaccctttctgcatccccaggagaaggagaaacaccaaggaggggctcacgggggttcctttcccatttccaggagggagatgcctttggctcggaggtgacatattggttgagttacccagtgaagccgaggcagaactccctgtgagatgggatgaaaggaggattcactgatggggagacaggctcagtggtaatagggacacagacccctgagcccagacctcgtgggctcatttgtctgccatctggcaggtggaggcttctgctctggcaggtctccagtgaggagtgtgaagtgggtccctgccctgtcacatgggctcactctgggctgtgtgtagtgttcagagctccagccccagaaaaggccgagggagggatttggtcttgggcccagtgcaaatgcctagggccctggaagggagagggtgcaaactggaggttgttacctggttgtcccatttgtttggtttttcgacattttcttatggaaattttgaaacatacagaaaagttgaaagacttcaagatccatatactcctcactcagattctaccattactggtaaatacattactgaaaaaaagaaaaagttactttgcagggcacggtggctcacgcctgtaatcctagcactttgggaggcccaggcaggcagatcatgaggtcaggagatcgagaccatcctggctatggtgaaaccccatctgtactaaaaatacaacaaattagctgggcatggtggcgggcacctgtagtcccagctactcgggaggctgaggcaggagaatggcgtgaacccgggaggcggagctkgcagtgagccgagatcgcgccactgcactccagcctgggcgacagagcgagactctgtctcaaaaaaaaaaaaaaaaaagtttctctacgcaatcacttttccagttgtttctttttctttggccaatttcttgctgtcagtaagtttgttcagcttctaaaggtttgcttgctgtaaaaactgttctaggtgggaatgcagagcaagggagacacctcagctcaaacaggacaagtcccctttcatttggcaggcatctccattttctcccagttgtgttgatctggagctccgcagaatgtggtttatggactgtgagtggtctgtgtgtctttcctggtggctgctgctgctggcatatcattaaaactattcctagaatagacttattatttacgtgggagagccctcactgaatttccaccagaaacaagtctattctgtagctcattcgkgttggtttggagtgtttgtgtgttccagggtgcatgctatgtgtgtgcatggtgtgtgtgcgtgtggtgtgtgtgtgtgtgtgtgtgtgtgtctgtgtgtctgtgtgtgtggttgtcctcctgcagcctcagttcagcccagagccctgctggggactcttcctctcctggctaggagtgaggagacctctgccccagctcctctggccatgacagcaacaccttgagtcaacagacctgccaggtcttctgggcttcgttccacggacatcttagcctcttcttgccaagaagaagcccacactcccctatcccttctaggagaagagagatttgctcatttttaagaccaactttacccctgagtcctatgccccattccttcaggacctcaaggcattgtgccccacacgtcagctctttgttttctctggctgcccctatctttcctatttccattaatttctcagtctccaaggcttgagaccagactctctattttcccttctgggtcttttgattcttatgaccaattagttatctttgaatatcaaagacccaccacgagtagcagttcttagaaactaggtgaggtttgctaagctttggtcacgctgtgaaaaatgtcttgcctgtgtttcctctttcatgctggccaccgtcccatcacccttgtcaccctgttcagccctcacaaccacaccattctcagagcctattttatcatgtgtctggatcttcagacatttccattgtcaaccatttagtgtgtccttattaattccatgtgctgtgtaaggcgtttgacccacacgatctgtaaactcctggataatcaaattcagcaaacttaggtggagctcatgaatctccattttaaacaaacagcccagggattctgacttgggctgtcctaagataccattttatttatttatttatttttattttttattttttttgagacagagtcttgctctgtcacccaggctggagtgcagtggcgcgatctccgctcactgcaagctccgcctcctgggttcacgccgttcttctgcctcagcctcccaaagaactgggaccacagacgccagccacctcgcctggctaattttttttttcttcatatttttagtagagacggggtttcaccgtgttagccaggatggtctcgatctcctgacctcgtgatccacccgcctcagcctcccaaagtgctgggattacaggcgtgagccaccgcactcgaccgataccattttaaatagcactgctaggccagagcggggtggctcatgcctgtaattactygcaccaaggagctcaagaccagcctgggcgacacggtgagatcttgtctctacaaaaagaaaaaaaaaattagctggatgtggtggtacatacttgtgatcccagttaccctggaggctgaggtgggaggataacctgggcccaggaggcagaaactgcagcgagccatgttcacatcactgcaccccaacctgggcaacagagcacaaccctgtctcaataagtgaatgaatgaatgaataaataacactctcctagagcacctgttaccagtaactcacagtgttgcctttttgtttgctgccttacaatatactcaattgtcgcatgtttgtcttctatttatacgcaggttgtaaactcccagaagcaaaagatcatgcttttagatttttcttttgtgatgtttgagagcctacctgagggcaatgtatccagaagtcactcaataattatttttagatgaatggaaaaatgggtgagaaaatgagatttttagggagatttttgttgctcgcttgtaaagactttttggggcgttttctgctgagaaaaggttacgtagataatgattcttaatcaatgtattcattttttgagaggagtaataatcactactattgacttttttctctttcaggggacttccagaatggcaagagagtgagcctctccgtgtatcttggggaattttttgacatccatttgtttgtcaatggtaccgtgacacagggggaccaaaggtaagccaacaatgtctgagttagaaaggaccctagggatcccctgacacaaccccctcatttttagatgaggaagctggggcccagagaatggaagcaaatgttccaaggaagtsagtagcagggctgggtgagagccagctctcccgattgctgatctaggtcctcagccactttgcaycatgttctgaaccctacaacatggggttggggttagaaggtgggagagacatccagaaaatgcacaagaagcccacttctgaacttagcctttgccctccagagtctccatgccctatgcctccaaagggctgtatctagaaactgaggctgggtactacaagctgtcyggtgaggcctatggctttgtggccaggatcgatggcagcggcaactttcaagtcctgcwgtcagacagatacttcaacaagacctgcgggctgtgtggcaactttaacatctttgctgaagatgactttatgacccaagaaggtaagatgttctgggataccatttccctaaagtgtggccatgctttttatttccttgctcataaaccttcactaacatgccttccctggcattcaagcctcactgtgacctcacctcaatttatgttgccaaccttatctctttgcattccattccaatgcctagacctctagtgaaaccaggtcttagagctcctcaaagctgacttcgttcaactttgaattctctgtagcaacttgcacgtggcagatggttggtcaatgctgggtagtttgagtcgatcctcctcagcccactacagtggagtggataaaatctatggagtggtcggtcctccacaccatccaaaaaggccagtttatgtgtgtgtgcatgtgtgtgttcacgagcaatagaaagtaatatggataatgtgaaaacactaggctgggcgcagtggcttacccctgtaatcccagcattttgggaggccgaggcaggcggatcatgaggtcaggagattgagaccatcctggctaacatggtgaaaccatgtctctactaaaaatacagaaaattagccaggcgtggtggcgggtgcctgtagttccagctacttgggaggctgagacaggagaatggcgtgaacccgggagggagaacttgcagtgagcagtgatcgtgccgcttcactccagcctgggcgacagagcgagactccgtctcaaaaaaaaaagaaaacactaaagatgaatatttcaatcttctttaatttcaattacataaacattcaattagtgatgttcccttgccaaagctaaacacttacatatgttatctttcttccttatgacccaaccactttctgattagagagtaaacatgcagagaaacaattgactcttcctttcattggaatgtaccatattggaaaatagcatgatagtttattttttggttttctccagcactgattttattgtctgatatgtacatttagggctataaatttccctctaaatatcactttagttgcactctatatatgtgtgtgtgtttgtgtaaatatgtatatatactgtatatgtgtgtatatatgtaattatatatgtgtgtgtatatatatgtatatatatacacgtgtgtgtgtgtgtctgtgtgtctctgtgtgtgtgtatttagagataaggtcttgctaagttgcccaaactgatcttgaactcttgggctcaaggaatcctcttgcctcagccttcctagtggaattataggtgtgtgttactgtgcccagctgtaccaattttgatatgtaacatatttcatgttttaaattttctaacttccattttgagctctttctgaacctatatacatttacaaattcaaaagtttgaatttttttttttttttttttgagacggagtctcgctctgtcacccaggctggagtgcagtggcgcgatctcggctcactgcaagctctgcctcctgggttcacgccattctcctgcctcagccttccgagtagctgggactacaggcacccgccaccatgcctggctaattttttgtatttttagtagagacagggtttcactgtgttagccagggtggtctccaactcctgacctcgtgatctgcccccctcggcctcccaaagtgctgggcttacaggtgtgagccactgtacctggcctgaagtttttaaagttacctatttgtaactaaattgatttctaaatttggttaaaaaattgtggcctagttaaaaaattgtagacttgtttgcagcctttttttttttttttacaagtgttctatgtatgcccaaaaataatgtattctctgattggtgcaggactctacctatacttcttgaattaagctttttaattgtgttttccagatcttctgtatgtgtactacttcttgtctgcttattaatgacccattactaaaagagctaaatttttctataatggtggtgaatttgtcactttcttcatgtaattctgtcaaattttgctttgtgtgtgtgtgtgtgtgtgtgtgtgtgtgtgtgtgtgtgtatatatatttctttctttctttctttctttttttttttttttaaagacagagtcttgctctgtcacccaggccggattgcagtggtgagatctcagctcactacagcctccacctcccagattcaagcgattcttctacctcagcctcctgagtagctgggactacatccaggtgtcaccacgcctggctaatttttgtatttttagtagagatgaggtttcagcatgttggccaggctagtcttgaactcctgacctcaagtgatctctccgcctctgcctcccaaagtgctgggattacaggcgtgagtcaccgtgcctggcctgctttgtatatcttgagcctttgttattagtgtttagaaatactgaatctttcggctgggtgcggtggctcaagcctgtcatcccagcactttgggaggccgaagtgggcggatcatgaggtcaggagatggagactatcctggctaccacggtgaaaccccgtctctactaaaaatacaraaaatgagccaggygtggtggcrggtgcctgtagtcccagctactcgggaagctgaggcaggagaatggcatgaaccttggaggcggagcttgcagtgagctgaaatcgcaccactgcactccagcctgggcgacagagtgagactccgtctcaaaaaaaatatatatatatatattgaatctttctagggaattgttcctttaatgtaatgactctcatttttaccagtgctttttgccttcaatctgtctgatattagtatagctattccacctttcttttggttagtgtttgtttgatgtatctttttccattctttcaacctttctatgtgattttgtttcagatgtgtgtcatggaagcaccacatggctctattttattattgttctttcaaaagtcagatttattgaggttaatttacagacagtaaaattcaccctttcacatacagttctctgagttttcgcaaaagcgtagagtcatgtaaccaccacaatcaaactatagaacagttttgtcaccctcaaaatcaccatgctcctttgtagtcaaatcttcccccaactcctagctcctggtggccactgatcttttatctgtttctgtagtcttgatatttccaaaattcatatgactgtaatcataccctatttgcagtatttagtcttgtaagtctggcttctttcatttaacatggtccgtgagaggttaatccatattggtgcatgtatcagtagtttgttcctatttattgctaaggagtagttaccacaatttgtttacccattcaccagttgaaggatgctttgttgtttccaattatggaaaattatgaacaaagccagtgtaaacatttgtgtatagatttctacaccccgccgcattttttattgtgctatgatacatgtaacataaaatttactatcttttttttttttttttttttttttgagtcggagtttcactcttgttgcccaggctgcagtgcaatggtgtgatctcagctcactccaacctccgcctcccgggctgaagcaattctccagtctcagcttccctagtagctgggattacaggtgtccgctactatgtccagctaatttttgtatttttagtagagacggggtttcaccatgttggccaggctgctcttgaactcctgacctcaggtgatccgcctccgcttagcctcccaaagtgctgggattacaggcgtgagccaccgcgcctggccaaaatttattatcttaaccatttttatgtatatagttcagtggtatcaggtacattcatgtagttgtacaaccatcaccaccatccatctccagaactcttttcatcttgcagaactgaaactttatattcattacacaataacttcccattcttccctctgggctcctggaaaccatcattttactttctgtctatgattttgactactctaagtatctcatataagtggaatcatacagcatttgtctttttgtggctggcttatttcactttgcataatgtcctcaaggttcattcatgttgtggtgtatgtcagaattttcttcctttttaaggatgaataatattccattgtatcagaggaatttgaggaaaagaaaaaaaatttcattgtgcatacagaccgtacgtactttgcttatccatttatccatcagtagacacttagattgcttccacgttttgcctatagtgaataaagctgctatgagtataggtgtacaaataactctttaaaaccctgctttcaattcttctttattttttttgagatggagtttccctctgtcgccaggctgaagtgcagtggcctgatctcggcttactgcaacctccacctcccgggttcaagtgattctcctgcctcagcctcctgagtagctgggactacaggcgcatgccaccacgcacagctaatttttttttttttgtatttttagtagagatggggtttcaccatgttggccaggagggtctccatctcttgacctcttgatctgcccaccttggcctcccagagtgctgggattacaggcatgaaccaccgcgtccggctcaattcttttgagtatattcccagaggcagaattcctggatgatttctaatggcaattctattttcttcatatatttcatgatttatttttcaggtatgtgaaattttaaaatattccttttacaatatctatttctctttacttaaaaggagaaaaatttgatatgcaatttcttcttaaacattttttaaattttttctttttaaaaatttgtataaggccgggcgtggtggcccacgcctgtaatcctgtaatcccagcacttcaggaggccgaggtggatggatcatttgaggtcagaagttcaagaccagcctggccaacatgtgaaaccccatctctactaaaaatataaaaattagctgggggtggtagcacatgcctgtaatcctagctactagggaggctgaggcaggagagttgcttgaacccaggggacggaggttgcaatgagccgagatcgccccactgcactctagcctgggtgacaaagcgagactctgtctcaaaaaaaaaattgtataaatttatggggtacaagcgcaattttgttacatgcacagattgtgtagtggtcaagtcaggacttttagggtacaatatactttgtacccattaagtaatttctcatcatctgccccactcccactctctctcacctttctgagtctccaatatctatcattctactctttctgtctgtgtgtacacatcttttagtaaccactttttggtgagaacatgtcatatttgactttatgtggtttgtttcacttaacataatgacctccaatcccacccatgttgctgcaaaagatgcgatttcattcttatggccaaatagtcttccattgtgtatatgtaccacattttcttcatctaatcatctgttgatgggcatttaggttcataccatgtctttgctattgtgaataatgcacaataaatatactagtgcaggtatatttttgatatattgatttcttttcctttgggtagatatccagtagtgggattgctggattgaatggtagtcctatatattttttttttttccgagacagagtctcactctgttgcccaggctggagtgcagtggcctgatctcagctcactgcaacctccagttcccgggttcaagcaattctcctgcctcagactcctgagtagctgggactacaggcgcatgtcaccacgtccggctcatttttttttcttttgtatttttttagtagaggcggggtttcaccatgttggccaggctggtctcaaactcctgacctcgtgatacgcccgcctcagcctcccaaagtgctgggattacaggtgtgagccaccgcgcctggcagtcctattttttttttttttaaagttctttgaaaaatctgcatactgttttccatagaggttgtactcatttacattcccaccaacagtgtgtaagagttcccctttttcctcatccttgccaacatctgttattttctgtctttttaataataaccgttgtgactagggtaagatgatatctcattgtggttttaatttgcatttctctcatgacaagttatgttgaccatttttttcacattcctgtcagatatttgtatgtcttcctttgaaaaatgtctactcatgtcctttgcccacttcttgctgatattatttgttatttttcattgttgttgagttgtttgagttccttgtgtattctggatactagtctcttgctggatgaaaaagtttgcaaatattttcttccattctgcaagctgtctcttcactctgttgatgatttcttttgctgtgcagaagatttttagtttaatgaagtctcatttatctatttttgtttttgttgcctgtgtttttgaagtcttagtcagaaattccttgcctaggccaatgtccagtacagttttcccaaggtttttttctaggatttttatagtttcagaccttacattcaagtctttaatacatcttgagttgatttttttttgtatatggtgagagataggggtccagtttcattcttctgcatatggcaatccagttttcccagcaacatttgttgaagagggtgtcctttccctagtatatattcttgtcagctttgtcaaatatcaactggctctatctctgggtgtctattctattccattgatctgtgtgtgtgtgtgtgtgtgtgtgtgtgtgtgtgtgtgtatacatatatgtgtatatacacatatgtgtgtatatatatacgtgtgtgtatacacatatatgtatatacacacatatgtgtatatacacatatatgtgtatgtatatacacacgtgtgtatacacacacgtgtgtatacacacacgtgtatacacacacgtgtatacacacacacacatatatatgtatatatacacacatatatatatatattttttgagacggagtctcgctctgttgcccaggctggagtgcagtggcgtggattggctcactgcaagctccgcctcctgggttcatgccattctcctgcctcagcctccctagtagctgggactacaggtgcccaccaccacacccggctaattttttgtatttttagtagagatggggtttcaccgtgttagccagggatggtctcaatctcctgaccttgtgatccacccaccttggcctcccaaagtgctgggattacaggcatgagccaccacgcctggccgatctatgtgtatatttttataccagtaccatactgtttgattactatattcttgtaatatattttgaagtcacatattgtgatgcctccagctttgttctttttgttcaggattgctttggctattcggtctgtttttcagttccatatgaattttaagattgcattttctaattctgtgaaaaatgacattggtactttgataaggattacattgaatctgtagattgctttgggcagtatggtcattttaacaatatgaattctgatccattagcatggcaattctatttttaatttttttttttttttgagacggagtctcgctcagtcacccaggctgggtgcagtggcacaatctcggctcactgcaaggtccacctcccaggttcatgccattctcctgcctcagcctcctgagtagctgggactacaggcgcctgccaccacgcctggctaatttttgtatttttagtagagacggggtttcaccgtgttggccaggatggtctggatctcttgacctcgtgatccgcctgcctcggcctcccacagtgctgggattacaggtgtgagccaacgtgctctgcctgtttttgtttttttgagacagtcttactgtgtagcccagtctggagtgcagcagagcaatctcggctcactgcaacctccacctcccaggttcaagctattctcctgcctcagcctctggagtagctgggattacaggcacacatcaccatgcgcagctaatttttgtatgtttattrgagacagggtttcaccatgttgaccaagctggtctcaaactcctgacctcaagtggtccgcccacctcggcctcccgaagtgctgggattacaggtgtgagccaccttgcccagctgactgtaatggttttgaacatttttaatgcagctgctgttcaataaatatttgttgattgaataaaagaatcagcccttccctttctgagcacatgcagaatctgtgccttcttctggtttttaactaacacctagttttaagagagaaaattccgccctcccccataaatgtcatgttctgtctgtcatttggacatgacccaaaagcttaattttctaaaaagccaaagtgctgggattacaggcatgagccaccacgcctggccctgatgcttcctatctttcatcagatttagaacattttcagtcatttttttctcctttgggaactgtgagaaatatgttggattactttatttttattattattatttttttctttttgagatggagtctcactctgtcgcctaggctggagtgcagcggcgtgtctcggctcacagcaacctccgcctgccgggttcaagcaattgtcctgcctcagcctcctgaataactgggactacaggcgcccgccaccatgcctggctaattttttgtatttttaatagagacrgggtttcaccatatcggccaggctggtctcaatctcctgacgtcgtgatctgccctcctcggcctcccaaaatgctgagattacaggcgtgagccaccgcgcctggcctggatatttttatttcatcccttttttaatctttaccttacttccattttttttttttaagctctttatccctctgtgttgcttttttaggtcgtttgcttggctcaagtgttgtgctcatgctggttggtgagaattgattgtgtgtatctcttcccagctccacattcactgatatcacattggtagcttgaaactggccatggtaggagtatttacacgatggaaaccagcaaatgctacaaatcagagctttgcttttttcctggagaaggggattatcagctcatctctacttagatctatcttctaatccactaattctctctcaactgtgtctaatcggcaggtgatgtctaaccaccatcaatagaggtttctgttcatttcattaactatatttgtaattttagaaggtaaacctggctctttttctactctattatttttcttattatcttgttcttttatgaaatttccatttcttctttacaacaataattttaaatatgtttgttttataacctttatatagaaattttattatctgaagtttttgaagctctactcttgctatttctgtgtctttctttattattattattatgctttaagttttagggtacatgtgcacaatgtgcaggttagttacatatgtatacatgtgccatgctggtgtgctgcacccattaactcgtcatttagcattaggtatatctcctaatgctatccctccccactctcccaaccccacaacagtccccagagtgtgatgttccccttcstgtgtccatgtgttctcattgctcaattcccatctatgagtgagaacatgcggtgtttggttttttgtccttgcaatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacacacgtgtgcatgtgtctttatagcagcatgatttgtagtactttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcatgtggttttgatttgcatttctctgatggccagtgatgatgagcattttttcatgtgttttttggctgcataaatgtcttcttttgagaagtgtctgctcatgtccttcacccactttttgacggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggctttcgttgccattgcttttggtgttttagacatgaagttcttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcccttccccattgcttatttttctcaggtttgtcaaagatcagatagttgtagattatttctgtgtcttttgactcttgcttagagtggactgtttcatcatgtttcataattttcgattgtgaactcatctttgaagggttttgtgttaatatttcaatatggagttactaaatcttataagaagtataaataggaatctcaaatccatatgagggctttcccacaagtacagatattgagggagacgtttttcctcacttatccagaacttagactaggttaacaaacttttgcttccttggtttttttttttttttttttttttgagatagagtcttgctctgtcccccaggctggagtgcagtggcgcgatcggggctcactgcaacctcctctgcccagttcaagtggttcttctgcctcagcctcctgagtagctgggattacaggcatccacccccacgcctggctaatttttgtagttttagtagaaacagggtttcaccatgttggacaggctgatcttgaactcttgacctcaagtgatccacctgcctcggcctcccaaagtgcaagaattatagatgtgagccactgtggccagcccattgtttcttagagtagattttttttcttgtgaactttctcatggagggtgttgtcatcctttaagggtcccagcttcacaatgggggtctcaggatctccttcctacatcatggagatccaaagctgttaaacccacaccccttcgttggcaagattgccacccttgccccgacttcaacactcaccaggtctgtttttcctttttctctccttatcctttccccctctttctttttgtcttttgaaatttctttttttttgagatggtgtctctgttgcccatgctggagtgcagtggtgccatcttggctcactgcaaggtccgcctcccaggttcacaccattctcctgcctcagcctcccgagtagctgggactacaggtgcctgccaccacacctggctaatttttgtttatttttagtagagatggggtttcaccatgttagccaggatggtctcgatctcccgacctcgtgatccgcccgcctcggcctcccaaagtgctgggattacaagcatgaaccactgcgccaggcttgtcttttgaaatttcttatacttttttgtgagattagtcatgaattcaatagggcatttgttcattgtagtggcacgtgtttcagtgttttctaatctgtcatgttgctagaaatggaagtcccagccctaaaatatctttcatattcccaggctttaaggtttaaaaactgaaaatgaagtctatactgtgttggtgtttgttggtaaaaattcaggactctggtaatatttcagaaaccatcctcaaaggactgggggtttagttgtctttggttgttaaagactcaacaatgtttgtccccaaacagttaactttccttcctgacttctaggaatctgctcagcttggcttttacttaggctttcagagagttttctctaagcaagaatatttgtaattccatctcttggacagtgtatgtctcgtttcagatctagcctgtaaagtttcacttcatagatggtcagggctaaaaacgaccctagaagtcatctagtctaactccttatttgcacataaggaattgggatcagcccagatcacacagggtcacagaggggctttgcccaggcaacaacatgaagcctcctctatgtcccttccttaatgtggtttattagaaagtgtcaaaacctgtgtgatatggagtgactgagtacccagagagtacctgtcacaatgtctggcacacagtcaacatgccacaaatttaagttctcttgcctttggcttctcccatgtatcagtttcctgtggctaccaacacattaccacaaactcggtggcttgaaacaactgaaatttattctttcatggttctggaggtcagaagtttgcaatcaaggtgttgggagggccaaaactccctccagaagctctcgggaagcatctgttcctggcctcttctaccatctgcagtcatacctgactcatggctacatcattccagtctctgcctctgtcttcacattgctttctcctgtgtgtgtgtctttgcccgtctccctctgcccatgtctttttttgttttgttttgttttgttttgtcttttgttttgggatggagtcatgctctgtcaccaggctggagtgcagtggtgcattctcggctcactgtagtcttcgccttccaggttcaagcaattctcctgcctcagcctcccgagtaactgggattacaggcacgtgccaccatgcctggctaatttttttgtatttttagtagagacggggtttcaccatcttggccaggatggtcttgatctcctgacctcgtgatccaccctccttggcctcccaaagtgctggattacaggtgtcagccaccgtgcccggcctctacccatctcttataaggatacaggtgattgcatttaggcttacccaagtaatccaagagaaactcttcctctcaagatccctaactcaagcacatcttttgccatatgagataatatttacatgctccagggattaggaagtgaatatatctttggtgtgggggggatctttttctgcctatcaaacccccacataccaactgactatattccaaggtctcatttatattttccttccctggggacagtttatttactatttgcaaatgcattacttgaccttgagacctacttctctcttccaggcctggctatgcagaaaactgctcatcccaatactgcaaaggtagtagtctcatactgcctttgtaatacagattacgcaattactttgcactaggccatgtaggtccacgaggccctcacagtctattgtgagtagctgacagtagcatgagcactataagtactaaagcacagatgctgtgagagcctggagtatgcagtgacttggggaytgggcttaggttccatgtcatattcttaccttcrttctgcaaaaatattttgagcattcgtaatccactgtataagaatttagagataagagacwcagcccatacccttaagtaaggagctcacagttgaatgggagatgaatatgagcaaaaagaatacaaaccaaaggtgatgagtgttttggtagagggatgcccaggtgccatggggcacagggaaggtgacacccatacaggctggggtgcgaaatgggagtagagctgttcagaaaggaccattcactcaccaggaccacacctggaggcagtggttcttgagctgcatcttgaagaaggaatggagatagttaaggcaataagggggaggagaacattccacatggagggagaaaggcacatgaaggcatggagaagtgacagggaaagggcatttcctcatcatctttcacctcatctccctcatcgtaattgtaaccgtccrtccatccatccatccatccatccatccatccatccatccatccatctatccatccatccttcttcagtctccaagcgtctgctgagctctgatgcccatgccctgtggtgttaggttgagcactgtatgcatgcttattgtttaatttaatacaagtttgattcaggtaaaaacagacctagagcctggtgtggtggcccacacctgcattcccagctactggggaggctgatgkgggaggattgcttgagcccaggtgttctgggctgcagagcactatgcatcaatatgggggcctcctggggagtgggggacaactgggttgcctgaggaggggtgaaccagccaagccagagatgggtcaagtcaaaactcctgtgctgctcagtagtgggattgcacttgtgaatagccgcgcactccagcctgggaaacatagccagaccctgtctctttataaaaaattaaaacaaaacacacaaaaccaccagcagacctagaattttcacccagaagttctgggacaggcataactgaagcattactttcctgaaactttcctccacagggaccttgacctcggacccttatgactttgccaactcatgggctctgagcagtggagaacagtggtgtgaacgggcatctcctcccagcagctcatgcaacatctcctctggggaaatgcagaaggtgggtgtggactggcctgggtgcacctggatggtgtgtgatttctggatctaaaagacagaaggactcagtctcatatccttccatctgggggaggaatggacttacgcagggccatttcctccaaaactaactgtggctagagtctaattctaatacatctcgagcctgaagctctaaaaatgagtctgggctaatgacttggtgtagtgtctcagtccatttgtgctgctataacaaatgcctgagactgggtaattttaaggaacataaattatcttttatagttctggaggctaggcagcccaaaatcaaggtaccagcattcagtgtcttgcaaggaccttcttgctgtgacctgaagccgggtcctgtggctcattcctgtaatcccagcactttgggaggccaaggtgggtggatcacgagatcaggagatcgaaaccatctgggcgcctgtagtcccagctactcgggagactgaggcaggagaatgacgtgaacccaggaggcggagcttagcactccagcctgggcgacagagtgagactctgtctcaaaaaaaaaaaaaaaaaaaaaaaattagctgggcatggtggcatgtgcctataatcccagctactcaggaggctgaggcaggagaattgcttgaacctgggaggtggaggtttcagtgaactgagatcgtgccactgcactccatcctgggtgacagagccagactctgtctcaattaaaaaaaaagaaaaaaagtacactgaagtgctctcatctgcctcttttatcagagcactaatccattcacgaaggcagagccctcaggacttcatcacttcctaaaaggcgccaccttttaatagcgtcactttggggtttaggttccaacacatggattttggaggacgtagacagttgaaccatagcaataagtaactatgcttttctgttttagactccagtgccctcttttgtccccaaatatctccatcatcacctgctaggtgtctgaaattttaccgatagaaaaaagccacttctttcttaagtggctgttgtaaactagaaataggagggaaagcctcctcttataccagctcagctggaaggaaaactactttatagttgcagacactgaagggagtctgagtgagaggctgtgcctgaagtgacatagcttggatgtcaggatggcttcctgaagctgctgtaacaaattatctcatactcaatggcttaaaacagtaggcatttattttctcccagttctggaggctggaggtccaaatttagtttccctgggctgagatcaaggtgttggctggctttgctccttccagaggctctaggtccttgcttccgtcatttttgggtggcagcggcattccctgtctttgggctcatgacttcaatttctgcctctgtggtcacatggccttctcctctcctgtgtgtgctaatgcctgccaaccctgacaaggctgggaggactgccccaccccttccacagagccctgttgccacttacaaggtagccttgtagcagctctgtctgcatcagagttgccattcatgatctcactcaccaggacctcacactggagagaaggggaggtggggaggggtggccagaccacactctgccttcacctgccacaggtaaagatggtctttgtgcctctctgtgtgtgggtgtttggggcaagaatgctttatgtggggcaagacctcactcaatgggtaattccctccccactgtggaacaggctgacttgggctgaggaggtaggtgcagctgtgaagctggactcctgtggggaacaggggttgttgcccttttgggattgtgctcagagactcatcatctgaggagcaaggttccttggtggtgctgtgagtcagcctccctgggcgggacgtttgtatgcaggaggtttactggggagctctcgagcagccttggttaggaagtgagagaagcagagttgggcagtgggagaagttgaactgcttgtgatagcaytgatagagcttcagcggggcctcagctgatccttcaaggagctctggaaggtggagtggcccctrttggtcactggatgtgggctgccctgggtaaggaggtggaactcccttgggctgagggccattcctgaggaatgactcagyggtgagcccttggcagccaacactggacagctggtggatgagtcctcgggctctgaatgggcacctacgctgtgccccgacacctacgctgtgccccgacaccctctacaaagctgctctgcttgacagcaccaccttcctgcccttatccagagagcaaccacactgtcaaaaatgtcaactgaagaatcacaaggttcataaacttagagaggagagcttttcttattcagagttgtggcctgcaggctggccatcctgcaggctgggaagtgtagcctctggtagaaactgaaagcaggcacttcaagggagaaaggggtggaatagaaacttattccaaaagggttggctcagtgtacatatttaacaggttatgggaggagctatgaatattcataatgggaggaggyatttgcatatacagtaagcaaacatacatgttacatatgtcccacattcattttgggatggagacttaacatttaaatgcattaaaattagcctctataggtcaaaaggtgaaatggaggacacagaggcatcttgtgcacagcctctgtaaatcagccagaaccattccgtggttggtggtctcttaccaggaaggaatgctggtcagtacacacacacacacacacacacacacacacacacacacwcwywctctctcwcwctcactcactcactcactmactagctgggcatggtggcatgcacgcacgcacacacactagctgggcatggtggcacrcgcgcgtgmacacacacacacacacacaaacacatactagctgggcatggtggtgcaccagtaatcccagctaatgggagggctgaggtgggaagatggcttgaacctgggaggcagaagctgcagtgagttgagattgcatcactacactccagcctgggtgaaaatgtgagaccctgtctcaaaagaaaaaaaaaaacccgcaaaaagggaagggagwccctgctgggccagttctgtttaactcttaggaaagaaagtctaatggtggttagcgagggagagggtataaggaggggtgttcaacctcccatcctatcatggccaggaactcagttttaatatttctctggggtccctttggccaagggggagtccgtttagtcggtaggggggcttaggattttatttttttctgaaaacctacaaacatgcacaaagagggtggcccctgcctatacccaggaccatggtcatgatggacgcgacaggccacagttgcctttgtctgggcaygggccactctgcagagcgtgagtgcatgctgcagtcacccgagtgcgcagcccatcagcagagcagtagggcaggtgctctgtgattttgttcatcccatgagaaaacaagccataggaggttaagtagctgccccaagtcgccagctagcaaggtgcagagccaggactcatgccctgcctggctccctccctttcctgttcrggtcacattggttcaggctactcaagttatttctaccagtgggcccttgtgtttctcttggggagttgggctttgcaggttcttaaggtttctttaagttctaaaaccctttattagcctggtgcggtggctcatacctgtagacccagctgctcaggaggctgagtcaggaggatcacttgagcccaggaggtagaggctgcagtgagctacaattgcaccactgcactccagcctgggcaacagagtgagaccctgtctataaaacaaaaccaaaaccaaaactctttcattatgtgtttctgtggattgggctatagagacagtatataataggtcttaataaatattggatgggtggatgaatggaaattggtggtgtaatttatctagggattgtgacctccacaataatccagactcctttacttgtagaaatctgatttatctaagtaagtacataagtagagaaacccagccctctcctattccagaaacaaaataaaacacacccacatctccctcctcccacccaccccccatcacrgtaacacgaggaagcttcgttttagctggttattaattcagtgagtcttcatcttcatggaacawtttgacctctgaccaaggagaatgtcagacccagaaaaatattctgagttgatgctaaatccagctgcctaaattgtgaacagacaatctccaccttataaacaagtacattccaaaagactttttcccttggactttggtggtgctaggtcctctggttagtccatcaaagtctgcatcacctggatcctagcccagtaccggcactaacaaaggcggactgagttctagcacgtgaggggagggtgctgtcttgtggaagggaggagtttcctcttctttgcagtcaaagttctaaatgcctgaaccatacccttgatagccccttgagtgtctctcaccctgggcctcggcgtgagcgtggtgctaagggtgtgggtttgagtcagctcacttactggctttgtgaatctgggcaagacaagtgcctttgcagagcctcagtttccacatttgtaaagcagaaatagtacctgctgggtcactgaaaaggtaagagagggataatatgtatagagtttagcccagtggggctcaactgttaagagccatgatgatgatgaggaggaggaggaggacgagaaggaggaggaggaggaggaggaggagttgttgttagctggctccccatattctcccactgtcccgtgttttccgctggagtgcccctgccttgagaatgggagccggcagaagcaggacaagcacacgccgggctttaagcacaagtttcaacacgcattctttttctccttccccctcgcaactataacccattccttttgggtagccgagcacagcttgaggttagaaggaaaacaaggtgcccagatatctccacacctccaagtgggtaagtgacaggaaccagccttccttctagagcggtttgtgaacccagatggatttcaaattgagtgcactcgaggtattgtgtaagagaggacagattttcggccgggcacggtggctcacgcctgtaatcccagcactttgggaggctgaggtgggtggatcacgaggtcaggagattgagaccatcctggctaacatggtgaaaccccgtctctactaaaaatacaaaaaattagccaggtgtggtggcaggtgcctgtagtcccagctactcgggaggctgaggcaggagaatggcatgaacctgggaggcagagcttgcagtgagccgagattgcactactgcactccagcctgggtgacacagcgagactccatctcaaacaaaaaaaaagaaaaaagaggacagattttcataatttctttctttttttcccaaacatasagttgtgctgttggcaggtgggtcaccctcggctgcccttcagtgttctccaggcagatgaaggggaggtggtgggtgcttcagtgggtgaggtggggtcagggtggctgtggaggtacctctaatactgaaacatgscttcaaagatttattatttttggtctcattttattttgcaaacatagcccagtgcagagtaagtacttgacaaatgttccctaccctcggaatacaaaggaatgatctcatttatccatactgagtgggaggtaaagacaggattctcaagtggagaacctgatcctgaggtcgggttgaggagggagactgggaggtttgtctcctggagacaaargggagggagaatgcaagagaagccttgtttgcctcccggggcacctttctgaggctccagctgtaccctagctactcgctttgtctcctgggtgcattaaagtccttactaaccagtgtcctgggaacagctgaaaaaactgggtaccaggttcttcgtgttgggctgaggccacaaacacgtgagacctcccagaggcacaagctcctcccagctcagaactcccggtttcaggttgtttacctgagaagagaagactgctttgtcctcagccaatcagatagtgtttgcccacaaccgaggttttttcactggctcggaagcacaatgactcgtctcccaagaggtgattaatatggccttttgaattgttcacagcctgtgtagtcccgcagggcccccaggttcagaagtccggtctggtaaatgccgcatcatttatgagtgtctgctgttgtggctccaagggccgttcrgggtgacagagtgttytgtgtgggagttcacactgaccttgaaactttccttgacagcctccagaatctacttccccaaccctctggtgctttctgtctttctagggcatagcaaggagtcagctcattctgagagccaggtcatattacttgttagttatacctagggaatgaatgtttccttgttatgccaacaaaacccaatgcctgtctccactgggactgataatggccttgtttgattgcatgcaaatttgcagttttttcagcttttcaaactgaaggcaagatggttggagtttggagccccaagctatgaacattcagataattgatgttcatctgcaggtaactatcacaaagtgtacctttgagaaagaaagacccttagatcactttaaaaaaattcgatcagactggggaaggccagcaaggactgaaccttacaaagggatcttggctttgtcctgtagtcctgtctgcaacaggaagcccaaggctccggggggctgggcttgggctgcatccagctcatagcatgcttttgctaattagaaaaaggcacccctttctctctctctctctcgctttttttttttttttagacagagtctcgctctgtcgcccaggctggagtgcagtagtgcgatcttggctcactgcaagctccgcctcccgggttcacgccattctcccgcctcagcctcccgagtagctgggactacatgcgcctgtcaccacgcccagttaattctttatattttttagtagagacggggtttcaccgtgttagccaggatggtctcgatctcctgatctcatgatctgcccgcctcggcctccgaaagtgttgggattacaggcgtgagccaccgcgcccggccaaaggcacccctttctcaagaaacttcaccaccacctgccgggaaacggccaagataaacataataactgaacatataatgtacatgtatatacctctacaatgtctaccatatgaacagtagtcacttggtgtgttgccactgtgtggactgtgtggcttgcatcatgacatgtgatggtgttggcctggcttcctcagggaggcacagtctctgtgaccatcatctcctcgctcaggatcacctcctcaaggcgatcagtctctattgagaaactgagtgcaccagttaccactctacctaccgtagagtggtgaatcattcagcagcagcagcaacctccgacagctgtctgaagtggaagaaatttcttttcatcaatgttaggaatcttaggctcataagaactcagagttggttgagaatctagcagatatctacttcaaccccctacctgccgcatgaatgctctccacaaactgtgtctgggtagacaggttatgctgtgaccttgactgtaagagttaaatcttggccrggcgcgggggctcagcctgtaatcccggcactttgggaggccgaggcgggcggatcacgaggtcaggaggtcgagaccatcctggctaacacagtgaagccccgtctctactaacaatacaaaaaaaaaaaaattagccgggcgtggtggcgggcgcctgtagtcccagctactcgggaggctgaagcaggagaatggcgtgaacccgggaggcgaagcttgcagtgagccgagatcgcaccactgcactccagcctgggcgacagggtgagactctgtctcaaaaaaaaaaaaaaaaaaaaaagagttaagtctttgagacacccttgctgggcgcttcccagccatcttgcagacctcagccctaggcagccctcctttactccctggtaaattccttctttcattgtatgcccgttcgaagctaaagccctgtccttccgtgtccctgaatactggagaagcaggtgctttgggtctggtttctcctggtctggctcaggagctcacatcaattgcagtcctgtcagtcactgaatagcctcagatttcctgttttccactggtctctgaatttggtgttyattaggtgaacacaagccttattttctttggccattcatgtcttcacattctctcgcktcctccattatcttgtagaactctttccgcctcctctgaaacagcatgcagttcacctgtgattcctcttcctcccagaaaatcacctgtcctgcttgagctaacattttaaacagtcatgttgactttgaataatcacagcatgcctcctcagtagcccaaagaggcacagaaaatacccattccrttagagacaaagcagttcactcttcatgttctcattaaatattgctcaagccttttatttgcaaaggacctaccagccctttctgctatttctgctcatggtgactctgaaagggaaattcacaggcatggagggaggcaatgtaagcccagcggacttgggtctcactgtctaggcccacttctgccttccctccttcttctccttgcctcttccattcacttaattggcagttttggtctggaatggacttttcttggagactgggaagaattttgttacattwgtttgcttggtagcatagttgtgattcatagagtacagttgtcaggggagagcctggcccagagaaggtcagtagatctcaaggaaggacccttggaatgcaggatcccagagaagttagttgtcagatgatggccctggttttagagttggggtgcccacccactatgccccagtgacaccragctcagagctggggtttgcaataagtacacacgtgtctttccccgttttgatgagaactgctctctcaagtctctctttcttgagtcattgataggctaaggaatgaggacttatttcaagtgctttastgaggtccaagaatccagggggcagtccytggtttggcccaattctctgcatgtcctcgtgtaagttactttcctactctgcctctcartcttccctctctgaggtaaacagagctccacggaaccccccatggataggcaccctttctttacagcagactggctcacctgagtgcaggatgggagaagggcagggagccaatggttgtggtgaaacagtggtgaccttggccactgttcccttgggggtctagcctcatggcagaggtcagtggctaccatggggttttgcagatttcccttgaacttggcctttaaaaatttttttttaaaattttactttaagttctgggatacatgtgctgaacgtgcaggtttgttacataggcatacatgtgccatggtagtttgctgcacctatcaacccatcatttaggttttaagccccacatgcattaggtgtttgtcctaatgctcgctctctccttgcccccgccccccgcgccccccctccccgcccacaggccgtggtgtgtgatgttcccctccctgtgtccatgtgttctcattggaacttggckttttatgttgctcatttgacaagcccttgaggagagttggataaggacctagcacccaagcattcaattcaaaggcctccctaacataatgttcccaaaatcctttaacgaactatttctcaggtgggttcctttcccttttccttttccctggtgagsarcagaatggacaagaatctgatggtgcccataagtgcatattcactgagatgtttcatatggcttgcgtswtacaasgtagactaagggacaagacacgtaagagaaattaaaccatgaaagactgtctggggttagtaaatgacaaatcgccaagtgaatggtaagtgatagcgcagcttaggggaattagctcctgtcacagagctgatgcttttttcttgctgggagcaggatgggtgagtgattcagaaagggctgctttccatccccagagcttggtaggccctagactgggaaccagggaatggtgccccgtccttgtccatccagccagcatgccctaatccctagaagctgctcagatgcctccaggagccccaaggagaaggtgaggagggtcccttagagagstccatggccaagtctcctacttctcatgagcactggaccccagctatcttagagagaggwatgtcaagctctgcagaaaccatccatttggtggaaatctatcaacaggtttcaccaggtccttgtgagtcagaatcttggaatgcgggtgggaatcttgggccggccagaagttataaatagaatcagctaccctcccccacccatcattacagctgaccaatgagaaagtattccctgctgcagggtgaattcttgaacccactactttggagcagctcagactccaggcgcctccatacctaccaggggctgctgcagggcacccatcccagagctagaaagatcagggcttgtggaacaatattgcactctatgtattagactttcctttctttgttcactcagtcctaggaatgtccccctcccttctcctttgtcagctgcttgggagcaaacacaatagctaagcttcagatctctggctctgctttctctcctcctgctgcctgccactgagatgtgcttgytttccctcctcctcccctgcacccgcctgatgtctccagggaagatgcctggtcttctttaatgaactggaaatgtgattaagatgggccacaattgggcctgcacaccaacccaggcatggtgaggtcatggctggatgggctggggcagctgctctcccgcagctcctggcacsgccgacaggagttgaaagaagacaggagtagctgatgcagggccttggagccagggagatgctggaagtgtgcaaattagctggcccttgttttgcatccctgccagaatggtttagcagagaactgaggagccagtaccgattgcaggcaaatgagaatagttataagcatttgatttcctggtgtcatctcatttgatttcattttgcagaaaccatctagggtaggtccaagtactgctgtctgtgtcagttaggagtaggttcagctgtgagtgacaggacttatacaatctaagtttatttatctctyatgtaaagaagtttggggtaggatgtccagggccatgcaagatctcatggtgttgggatccagggtccctctgtcttatttctctgttgtccccagtgggggcttctaccttgtgcaccaaaacgccrgctcaagcttcaggcatcacaactacattcccgcagtagaaagagaagggactaaggaagaagcagtcccttattttgaggacacttggtggaggttgcacaagacccctctgcttatagcctactgggtattgcttagtcatatggctgcccccagctgcaagggaggctgagaaatggaatcttattcctagcagctctgtgccccgygggggtgggaaattgaaaactgaggattctgtgactaagaaggggagaatagctcctggacaactttcaacctcttccacttttcccctctttcacaggtagggaaatgaggatgcagagaggcaagataattttccttttcttttttgttttttgcgacggagtctcgctctcttgcccaggctggagtgccgtggtgcaatcttggctcactgcaacctctgcctcccaggctcaagtgatcctcccacctcagcctctctagtagctgagactacaggcacgtgccaccacgcctggctaattttggatatttttgtagagataaggttttgccatattgctggtctcaaactcctggactcaagtgatctgcccactttggcctccaaaagtgctgggatcaggccggttgcggtggctcacgcctgtaatcccagtactttgggaggccgaggtgggtggatcatgaggtcagaagtttgagactacccttccaacccttccaacatggcaaaaccccatctctactaaaaatacaagagtgctgggattacaggtgtgagccactgcacttggccaagatcattttcttaaagtcacacgctttgaaagtgatgggttgcgagaggcagaggttgcattgagctgagatcacgccattgcactccagcctgggcaacaagagcgagacttcatctaaaaaaagaaagtgatgggttgagattctagcccaaccatgcttctaaaacctgagctacagccactgtatgaccctgtcttctaatctgattgctaggaaacaggagtgggagggcaggatggaaaactgtaatttgtggtttggaatggactcaggcactcagggtttgcaccccatcactagtgttaaaagaaaaacctgagacaaattaaatttaacagggtttacttgagcaaagaatgatgcatgaaccaggcagcccccgaatcagaacaggctcagagagactctggcctgcctcatggtcaaagaagatttatggacagaaaaagacaagtgacttacagaaactggaagtgaggtagagaaacagttggattggctacagcgcaacatttgccttattagaacgtagtttgaacagtgggctgccccaagaggaggttacagtgtgtttacatctccagttaggttacagttcattatgtagggagaaacctttaggcctaacttaaaatatgtaaggaggcagctttcggctaaacttaaaatttaacgattgtatagcagttctccaactgtttaatcgcagggcccctgtatactcttaaaaaataatgaaggactttaaagagattttgtttatgtgggtcataactcttgatacttaccatattagatattaaaacaaatttaaaacattttttgattcattttaaaataacaagctcatcatatttaatgtaaagaacatatttttaggccaggcgcggtggctcacgcctgcaatcccagcactttgggaggcctaggcgggcagatcatgaggtcaggagttcgagaccagcctgaccaacatggtggaacccagtctctactaaaaatacaaaaattagccgggcgtggtggtgtgcacctgtaatatcagctactcaggaggctgaggcaagagaattgcttgaaccctagaggcagaggttgcagtgagccgagattgtgccactgcactccagcctgggcgacagagcgagactgcgtttcaaaaaaaaaaacaccatatttttaaataaaaagaacgataaattccaagccaaaaaataatttaggggaaaaatgacactgttttacagttttgcaaatctccttgctgtctggcttcagatacatcatctggactctcatatctgcgtctgcatttaaatctgttgggatatctcatgtctcatagcctcggaaaactgcactgcactctggtgaaagagtgagagaaaaaattgcaaatagcatcttagtattattataaaaacagttttgacctcgtgcactgctgaaaggatcttgggagtcctaggcgatccctggacctcaccttaagaaccactgacttaggccaggtgccgtggctcactcctgtaatcccagagctttgggaggcaaaggcgggtggatcacgaggtcaggagatcgaggccatcctggccaacatggtgaaactccgtctgtactaaaaatacaaaaattagctgggcatggttgcgcgtacctgtaatcccagctacttgggaggctgaggcaggagaatcccttgaaccaggaagtcggaggttgcagtgagctgagatcgtgccactatactccagcctggtgacagagcgagactctrtctcaaaacaaaacaaaacaaaamaaaaaacaccactggcctagtaaattctttacccactccatgcttcagtttctaaatctgaaaggctgtctgtatcagcctttgtctgaggagagctgtgttctttggaggtgtcttcaggcctctgaagggcccatttgtggcatgggtgatgagatggtctctgaaagtactttaggtgggctaggagagaggtcagctgtggagaaggaggtgaggtttgcctcagcctttcctgaacgcaggaggatgggcggagaatctgtggagggccttctgggcagggagctctatgagccaatagccccccgtgactgagtggatggtaagagccagagatgcctggcctaggcatcccgcctggctcctgctgcccaccccacccactggtgtgcatgattgtgccaattcccacaggaaaagagggcacacggagccgtttctaagccatggagggcataacctagggggagtgagagaaaggggtctatgagaacttcgcgcaggcaggaacacacgcggaagggtctgagggcgtgggaacaggcggaaagtagacacctactcaaggagagcttggttgggtttggattatgatggggccgtaactacctgctaagagaagctgaggccacagacttggaacagcctctcagcgggcagctgtgcctttcctggggaatctgtcggcaagactgggctggagtcttagtgctcggctcagccgtggtgactctgtttcttctcctgcctgagcttatgccattggcttcacctgacatggcctccctcctgccctgcagcctaagtcctatgttgcatccagggccctgtgcagactgccttctgttaggcagccttccctgatgtctcagctgcaggtttcttgctgctgccattggctgcaccattgggaagacacctctaggtgagaaccaagtcttcaggctgttaggcaaacatccccatggaaacacccggttcaggtagattgaatgccagttaagagctggagggcatgaaaggcatgacttactcctgtctgcrttcatcactgttaggtttgattcagcatatccttattccctgccatgagtgccctgggaatacagctcctgtctttgaaaagcttgcagagaaatggaggagacggccacagaaatggaccatttcagtacaagaatagaggcccccagagggctgtgagaacacctaactcggcagagtggggagaaggacctgtcagagaagccttcctggaaaaggaggctcttgatctgaagtgtggggtgggagttagtgggggccaaagaagggggaaatgcaggagggcagatgggatgggtagagggcagatttccctgctgggctttatgagggggatctgtttgctttctattgcattccttgagcctggcacagtgtgtgaggtggggagcagggagggtgaggctggagagccaggctggggtcagatcatgaaggctgagcttcctggctttgctgtgtcctaatgagctagagctttgccctgtcagccagggtgggacatacatagttagacttgcattttatatgggcttggacaccctgctggagacccagaggccacactgctaatgcttgttgagtgaatgttttggtcactacctgcatcccagtgtctctgccacgagcctgagagtacaagacgccaactcctctttggacctatttttttttttttttcgagacagagtctcactctgtcgcccaggctagagtgcagtggtgcgatctcagctcactgcaagcgttgcctcccggcttcatgccattctcctgcctcagcctcccgaatagctgggactacaggtgcccgccaccatgcccggctaattttttttttgtatttttagtagagatggggtttcaccgtgttagccaggatggtcttgatctcctgacctcttgatccgcccgccttggcctccaaaagtgctgggattacaggtgtgagccaccgcgcctggcccttggacctgtttctgtgtcctgtctcaggacctggtctggtctggcagggctacctgtggcagaacagggaagctgggagcagcagagatagccacctaaacatgccatgtggtatggctgcaggtgagtgcggatccagctgcaagtcctgcctggctctcagctgtgcccactcaggtggaccaagttcaggccaagcctgaccagaggaagactgaaggacaaaatgggaggacagactttatcttttgtttctgctaagaaagaaaccctaggcagatttcagaagtttgtacagtggaggccaaaggaattgttctaagaagggaggtggctgtttctgcagaaatccactcccatcctgcaggcaaatcatcagaaacacccttcttgctaaggctttctataagccatttaatgcctccagggacctcccaggaaatgtgctggagtactgttcccattatccctctgagtgggaaaagagtgatttggaaatgctggagatgggccatgctgggctctgtctggtcacggctctgagaggggagggtgcctggattcctgggtctcttctttcccttggctggtactgtgtcctgctggtgagaatccctggttccttgtccctgtgcctgcaggaatcagtcctgtggtgcagggactgctccgagccactctgctacagcccaggtgatggcagcagtcatagcaatgaccaggaaaaccccagggagtgcatttttgaggttttctctagtttcaaattgtgggtggggaaaaggctagacaatagcctgagcacatgaccctctctgggacamcctcatctgcactctgagttcagtgacgtaattctctgaatgacatttttgatggggtaggcagcatggcagaatggagggaaagacacaggcctcagtctccttccctgagccccaacttggcagtgaggatgggaagttctgcctattgcaaagaagagaggttccctccctgctactagaaactcactttgttctggagaagtgtgaacttcccaaatgaaagatgaatacaagcagcccctctgttccctaaggagcacgcaagatactaggaagtgataatgctcggcaaccattcatctcagtatagcccagggtgatggagataaggggaaaaggagaaaggtgtccttctgtcctgctggggacctgctcactattctagagggtaagcctagtggccggagggatctctctggaggccaggagatgatgaagatgatgatgatgatgataggggtcatcatttattaaggtaagtcttccgcgtgcatattccattcagtcttcactagtcttgtcccagaggaactgttactattctcccctgttttgcagaggaggggttgagtaaacagcttagctcacacgctagcatggggaagacgctgggctgaatctggggctgtggaagtcatgatgaggccaaggcaggcctgcccacctctgtcagtctccctcgtcattgctttcagaagcctcaggttccccttgtgtaaaatgctcagggtgaccaatggaaggctgcatgtaaccacctgagacctaagtggtcccgggacccacaacagtggcctgcattcatggctggcctacgtggtgctggcattgtggcatcttcacgtggccccaacrggccgtctgggactggtcatttccacaggtcattctcactctgggacactcttctctgaccaggtgagctgatttgcctaagtccccaccgccagtaagtggcagagctgggctttaaggcctaggcttktcatagccaygccgtgggtgcccgcccggcagaaggggattgggcaaggcagggccgtggaggggctgctgttggccccgagacgcagagcagctgatggctgtccccatgagcctacctgctgcacttctgcagttgagcagcccatgccggtgggtgctttcctaaggtgcagagagaacccggcttgttttttgagacagggtctcgctctgtcacccaggctgaagtgcagtggcacaatctcagctcactttaacctccacccctgccccgccgttcaagcaattctcttgccccagcctcccgagtagctgggattacaagcatgcgccaccacgccccactaagttttatattttcagtagagatggggtctcaccatattggccaggctggtttcaaattcctgatctcaagtgatccgcccgacttggcctcccaaagtgctgggattacaagtgtgggcatcttttccaggcctgcctgcttggctttgatggtgaagtgggtggaggcctagcaagcggcagggccctagcaccaggcattggggctaggacactgatttccttaggaccaacgtccctgtgctgccggactggatttcgagaacggtgagcagatggggtcaggtttctattcctgtgggctttctgtggcgccgcaaaacaggaggcccacaggcctggcccctggccccgactgtagatttatacaggcttgctctggagacccttggtacaattcaagctgattgaatttccctctcctcaaaacgggtcrtttctttcctcttttttgctgtcccctttcccaaataccaactggctccagtttacccttcaggacccagtccttccattgagatattcttgcacttttttctttttagctgaagatcataagttttttcatgaacttgcagctttgtcagtcagagagtattgcattatgcatccaagaagttatgcaagaaagaaatcatggggatcatatatatccatgactctgtgttgtgccaaagctaagaaagacatcatggattctaagacacaccattgttctgtgtatcgctcagaaacaaaagcctaccaattcaaatatgatagccatcctaagacgcaatccaacttcagagatgttacactgtgggaaaaagrtgtatttagagtcattaacatacagaatggagagatgtttctaggtaaaacgtagggtcgttgatactcgtgagtgagcagaagtaggaaatgatgacaattccaaagctgcctgtgttatcaggttgagggcatcagcaaagtggtagaaccaagaatactcgtgcttgctgcagtgtgtctgggacattccacagaatcagcgcatgctgttgctgatgggaactggtcccgtctggccccagcaatcwcctggggagtgtttaaaaaaaaaaaamtcttgctgatccccatcccaaactactgcattcagatctcctagggtgagacccagaaatctctataaagccccttgtcccatccccctcattcatagtgaagaagatcaaggtcagggaggggagctgaacaggtcagtgcagaaccgatgctgacagcattcctggactctgcagccacccaggccaactccagggcgcatgctctttgtgcttctctccatcctctgtccgttcctaggacactgcccaccatggcaatccagggccttggactctgcatttccaggactcagtctaggatgtaaccttagccttggtctacttcacattgcacgggtccagcatcttttccttggtcgatgggctggtgcattgaacacatgcatgtgcttggtgccagcctgtcccaggtgctgagggagctgccttggtttccctagcagggctaagtctcagtgccacactcagggagacactaacggagcataccgctgaggcggcccctcttcctgcagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgccyggaccwgtgcccaggagggaatggtgctgtacggctggaccgaccacagcgcgtgcagtaagtcggccccctgccccgtcctgccctgccggggatgaacggtctgtcctgggtggtgtcccttagggtgcttcggggctgtgtcacgtatgtgcggctttaccacacccagccagccagtgactacaaagccacgtgtcccggacccatttcctgaatggctcctgccctctgtcaaacgggcttcccaaagccccgtgtcctgcccctgcctccgtcccgcccccacgcctcccctggcgccccctgacttccctcaggaaatccgacccctgcactcacacagtgttctctgcttcccaccaagatcttggcagttgcggttttggtttttgtcttcaccgcctgcccgccygaattgatgaggagcaggacgctgacctggctgtccgtgtgtggtgatctttgagagagcagaaagcattcattaagttcttctcttttattaaatctctctcctccaggctaatgaccgctatccctcctgccttactcgtgctgtgtgtttcatcttccagtctcaatgggtgcctagttatggtcactgtccccaaattatcaggattaagtggggacttctgaggtcaccttgcaagaagtctcctctttccccagcccttccagtgattaaaagccatgcagacggataagcagtctgtgatggttccacagatgagctgagccggccacatctttacactgcacacgtgtgtctcagtgtgtggcaaatagctgctgaattcaaactttctgcctgtggtgggggtgtgaggaaggaggatgctagcagctggtttcttctctgtaaagccgagtggctgtttttttttttttttttttttttaggtctgtgaatgtagggtaggggagataacctgatgtatcttggagaagggttaaggggcaatagtttggtgtcagaaagcccagaaaagagtgcttatgtgtttcggtctttcagtcagcctgaatgtcgctcagctacagggtagagagaggaaggaggagagcctgtccttgcagtgaggagctggttccattgggaagaacagagagtgcttaggtgatatctgtgaaggcagccttgtggcagagtggaaataaatatggaatgagtgtcaccatgcaggcaaatgtgccctgtgctgggtggggcatttgattggggccaatttcatggggaaaaggaggagggatgggatggagggcaccatggctccttgctttgtcgtaggactccacttgttttgagcctagaggagtttggtgtcactctgaaagggttttaggtgaaggggaggaaagaatgccaagttrtacatggagagcaggcgaccaaggggaagggtgggggtcctgggtgcccccgatgggtcttggtaagggcctcacaagatggaagatgttcatctaagggaggggtggcctcaggggggcacgtggctcactgggggtgagaaggacctggaagcctgaagacagaggggagcagtcagagtgggcacgagaggctcaggctgtggcatggctggtgagatgatgcaccggtgggacctgccctgggtagacccctttgatgttccttttcaggcccagtgtgccctgctggtatggagtataggcagtgtgtgtccccttgcgccaggacctgccagagcctgcacatcaawgaaatgtgtcaggagcgatgcgtggatggctgcagctgccctggtaatgaacttcccactttatttacagatcaragaccttgccagcacccttggctttgggaagtgagatgaaggccacttgtgtttgctccccgttgctgaaatcagaagccttttattaagtttttaaatgtctttgtccagcgtgatcaggattgagctggtctttatttttaatgtacgttgtcctgttgtactgtatccatgaacgcacttgtgttgagggaaattggagggtggcctgggccccaacagtaactttgtttggggaactcgtggcccatctgagctgagctgttttctcaattaggtgtgtcagggaaccgatctgggaaaaagatctcctgggtttgtcatgtgagctcagctgaaaaagggctctgcactagaaagtcttttcaggggaggcttggtgggctttggggaaaacccctgtttaattactgagagcaaggctgggtgcggtggctcatgcctgtaatcccagcacttttggaagccgagatgggcggatcacttgagttcaggagtttgagaccagcctggccaacmtggtgaaatcccgtctccactaaaaatacaaaaattagctgggggtggtggtgcacacctataatcccagctacttgggaaactgaggcaggagaatcacttgaacccaggcggcggaagttgcagtgaaccgagatcgcaccactgcactccatcctgggtgacagaacgagactcggtctcaaaaaaaaaaaaaagttattgagagtgagtcctgtgtgtttcaactcatgacttctctactggaagaacttgaacaaaactcttgactcccttcatctgtggaatggtaatgagtagtcttctccctctcacgttgcattaatgtgtaagggaagcagcacacacattcttgagcttcctggaagaagccctaagcccagacttgtgcctcccctactggatgacctggaacaaaattcttttgctcatgtcttcatctgtagtaatggagatgaggaatttcccttccttatattgcattatgtgaaagataaacaccacagaacaagttctttgagcttcctggaagaaacccaaccattgtccctggggattctatagttgtgggatgagtgacgcaatgacaatgttgaggyctttgtcttgatgcccttgaccccagagggacagctcctggatgaaggcctctgcgtggagagcaccgagtgtccctgcgtgcattccggaaagcgctaccctcccggcacctccctctctygagactgcaacacctggtaatgggggctgcgcagcgtgctctgggagacctgcctgggggactggggagggaagctgggtcagcaggggtggtggcaggtggaaaagaacctggaccgtgccaagaaagaagagactgagttggaggctactggtgggggctagggacaggtgtggcaggcaatgayggggagcaaagagtatattacagataaataagccttgaagatggggaggtcaggaagggcaggatccttcacgtgcagacatcatctctagctgtccctccaaactatgctttcataaatgatcctttccccctggaggagggctgtatcactaagcagtacgtaggtccttctctccttgaaatctctcatctgctaggtggtaggaagttgcagtggccagtggaaactcacaccagtctgccctcccttggtccctgcagtaggccaggcccagcctggcttctgtcatctcaagaagcacccctggatgtcacctctggctggctttgccagtctcctgcacagcagggacaactcgtttggtccccaggcctcctccctttgctatcttagcagccttctgtgtgcactgagcccccaggttctcagtcggccaccgcccaccacacttctgggctgggagctacccatttccatatcgctctcttgctctctgccactcactgtgtgtggggtaggaatttgacttcttggtatctgagtagattttcagggggatcaggtagtttttttttctttcttctttttctctgttggggtttcttcccctgggtaatatctctaagattcctttgtggccaaagctctgtcctgtacaattttaaccctatgaagattctgctagcaccagctcttttcttttcccacatcccttcgtttggggactgtgataactaccawgagctctaaatccatttgcatacccttgtgtttgcagaaccaccaatgacctgtgctttttccctccaacagcatttgccgaaacagccagtggatctgcagcaatgaagaatgtccaggtaggcgacctgccgctcattctcttcctccttccctgaatcggggaggcgtctcctcctctcttaccagacagggagggccacaactcaaggcagcgagaagttgccctctctgcacaggttggctgcaaccacgtgaccccagctctggtttcaggtaccagctatgctaacccattcacaggccagaggtgggagccctgcaacagctgaaagcggagaatgcacctgcgttcagatgttattgtctgtccttattacctgtttgctgaaaggattaaggttgatgagctgtaaggcctgtatggtcatgattgactaaacaaagaggatacacattctttggaaaattaagaggtagaagggcctggtaattctttaggcttgaagggacagttctaatggaactttccagaatgcctaatatgaagaccatggcgtggtccaagagctcggaaaaccagrtcaccaaatgattcctcccatcctgtccctgccctggaaaatctgcttaggaaaaattattgagcaatctctgccatttgctttctcctctgtttggccccaactctattctatttactgcaaaccttgcccattcaaagctcccttctgccccaccttccaatgacctcagaccttgccctctgtgctcactcacgtggtgttttctatgtgctggccactgtgctaaacactttccggttacaacctgtgaggcaggtgcaatttattctcattttaggaaagcagaaacagacctagagaggttaaatgacttgcccaaagtcacacagctgctacgaggcagagccagggcttgaactcacaactgcctgacttcttactttttcccttccctttcttctccttcccagtactaacctttggtggcctgaagtgggttgagcttggatacctgggactgtatttagggtctgtgagttaaagactttaggatgactcaggacctcatccagtgtcctctacactggraaaattctggaactagatgtgggctagatcagttagtcttgcaaagagatggtcacccagccaggttatcttttgtgtaacccttaaagaaggcacgaaggagaaaagattgctcttgaaagggatatctgtgctccactgaacgtaattacaccatgtccaagactaaaggagctctttggaagacatatgagttgctgcaattaacctgtgaaaacacttttaacatttaaataataagcactcattgtatgagatctgtgagccacagtggatggaattaggaattcagtttattgtgtgtgtttttttagacgtttgtaaccaccagattaggaagttttaacaagtacttactatagggtgaatcttccgtccatcatccttccaactgtccattcatccaagtactatttgaacaccaactatgtacatgatggactgttttctggggcagacaatacagtcctctggtcttcaattcaaaatctagaagatgactttgctgaggatgtaagacattctcttgatgtcttgatgaaaagataaacagtgtcaattctgtctactaagtggtttgatattttgccaacaaaaccactacgctcttctctgcattctcaaagccctggctctgaccatctttttctagtttgggagttttgttgatcatcgcctcccggtccatttgcacccacgcacacaagcatatttccacaccctgccatgactcagcaggcagtggggctgtctgatgctcccagtgtgatgactgcagatagagcttctgatgggaagaataggcggtatggttctggaggggatatgcttggctctgcttgtaaagtgaggagcaggccggagcttctctgcagcccctggaggaggattagaatgacatcagccatgtgagaaatggtaggagccaacccgggaggcagttttaggtggcatcaagggctctgggctctgcagctggacagacctgcccgtattcagatccctgttcagtttctttgggaacttggatgagttgaacttctctatgcttcagtttcctcatctgtaaactggggataataatgagcacttcataggagcaatcaatgagatggtttccatggagcacttggaaatgtatcttatgccaggcatggtggctcacgcctgtaatcccagctytttgggaggctcagtgggcagagcgcttgagcccaggggttggagaccagcctgggcaacatggtgaaaccccatggctacaaaaaatacaaacattagccaggcatagtggtgtgtgcctgtagtcccaggtacttgggaggctgagatggggggatygcttgagcctgggagattaaggctgcagtgagctgtgatggcatcactgcactccagcctgctgggtgacagagatcctatcacacacacatacacacacacacacacacacacacacacacacrcaaaaaaaaaaaaaaaaggaagaaaaagaaaaaaaaatgcatcttgggccaggcgcggcagctcatgcctgtaatcccagcactttgggaggccaaggcaggtggatcatttgaggtcaggagtttgagaccaacctggccaatggtgaaaccctgtctatactaaaaacaaaaacaaaaacaaaaaacccacagaarttagctgggcatggtggcacatgcctgtaatctcagctactcgggaagctgaggcaggagaattgtgagagccccggagatagagtcttcagtgagccgagatggcgccactgcactccacgccgggcaacagagcgagactgtctcaggaaaaaaaaaaagaaatgcatcttgcacatttggtagagattatgttgcaggctttggtgacaatttgcatctggtggaagtctgagttgctttgctaaaggcctgtgggttgggcatttctgcagggaaggctttgggaggtagagggttgtggggctggggaaacaaatggtctggagcagggcagccgcgtccagggctcactactgcaaaccaaagggtttgtttagaagaggtaatgtgcttccattaggtgagaggttccgttttgttttttttcatgaggcaggatctttattcacatagaaatggatctgctttaacttctggatttttttttttttttttttttgagacagagtttcactcagtcgcccaggctggggtgcagtggcgtgatctcagctcactgcaacctctgcctcctgggttcaagcaattctcctgcctcagcctcccgagtagctgggattacaggcacctgccaccayacccggctaattttttgtatttttagtagagacggggtttcaccatgttggccaggctggtctcgaactcctgaccttgggtgctccgcctgtctcagcctcccaaagtgctgggattataggcatgagccatgacggcccggcctggatgctcttttttttttaaatgcagttttaggaatcacctgcctttcattcattccccaaacttccagtgcccatctccatctagtggtgggcccgctgttcgtcaggagctgcctgttgctgactgatggggaatatcctagtgtcccatcctgggtggaggatgggtgagcgtgttcgcatggcccatagttctggctgacgttctagctcccgtggctaacggctacctggcagctcacccacccattttcctgtgtttgtggctctgttgctcagttgtaccgaggagataagctcatataatatttagacttctgatttgcgagaaacttgggaacacaagtcagtgaaggtcagagaaggaaatcagatgagacgattagatgctggccctgaaagttttcctttcgaatatttgcacatttctcgttgacccttcttttcctgggtattgttaaagaagacagaagtccattttcttgcttagataagagtgctctgagaaaacacagaaaggcagggggaagaattcccacccatttttactgccctggggtcaagacatttgacacaaatgaccatattactgtgtttgtagaatgatgataatttctgaaaaatggtcagttcaaaaaggctttcctgagacctcactggacttgaaattacagcacatccagaatgggctgggacgatcctggcccctatcttgtggcctgctctgtcctccacgaacagtcactcctcactcccgctcttctagagggggcagcggagaaggtgggccatgctgatgggagtgatctggggcctttccactttctcctaatttcctctgggctggatgtgccctcctgacccatgctgtcctggaagggatccactgtcctggggaccaggcagagggatgtgtacatccctgaggcacctcatccttaatcctgccttcatacacatctcaaaggcaggcccacacctgggtccagkactgcacagtctagcctggcccctggctgggcctgtcagrgcacatgcgagcatgaagtgccagacagtgagggcctgtggagcttgtccttgacaagctagaatctctctgtgccttttggggaccccttggctgtgtgacagggctagcattagcccctggagctgggcccacataggatggtctgtaggaccctcttacatttgtctttccaacgttggtctagcatctgttccccaaagggggaacttcaggtggaggctgaggtagcgctgtagacagccaagcttccgctgtttggagggtctcaggggaagccctgtgcactctatgtgtcctcatctttgctttgatccttagagaaaggaactcacacatgcaccgtagagtgactgggtgggaaaagtcttcctccttcaccaaatggcaatggtgtctctctctatatatatttctttttctgtagagtagatagcaaagatgagagcaggtggaggaaatatatagggcaggttgggaagggatccagatgcccttttcagctttgatgggtccatgtttggccctgaagatgggattgcctcaagccaggcaggttgatggagaatcactggagacattggcagaggcctccccctgccaggacaccttccaggatgtgtgatctcagtttggaggtgcattgggccacaagtatggggcctaggctggggcgtgggggagatggtgtgggaattagggtggggacaagctgagggctttgggttgcagggtgatgaaggggagtcctagtccccacccacagatrtgtcagcctgggctgggaagctggcgctgccgaggtcagcactgcctgggtggtggtgagatcatgggcagatggcctcctggttccccattggccctggctggagtcacagcgtgggcttgcccctctgaggacgcagaaagcaatggccttagagttgcccctctgctggtgaggaggatggagtccccattttcactgctgagctccaagactgtcctgcctcaccctcccacctcatcctgcctctgggctgcctactctgccccctggcctccagggactctccaggggtgacactgtttcccagagcctctccacactcaggttcagagaaccctgtgctattgggcagcctccccctggccaggcattccgctggcaccagtctgaggctggtgtggccctgatgccagcaggtagcgtgggacatggcagtgagctgtgagggaggaggggaggctgcagggagcctggaagcaggagygtgggttcctgcgtggttccaccactgactgagtgtggctctgtcaccttccttagttgccccatctgtaaaatgaggccttgacctgaatgacccagctctgacatcttgcagttttaggagcaggaaccgaattttctcgtagaacttgtttttagactggtttgggcaaaggacgtccatgcagttttggggaagggcaccctgcttgcatatgcattccaccttggccaccccaggggaagtgccctcacctcccattcttctcccttcctctgtgtctctccaggggagtgccttgtcacwggtcaatcmcacttcaagagctttgacaacagatacttcaccttcagtgggatctgccagtacctgctggcccgggattgccaggaccactccttctccattgtcattgagactgtccaggtgagctttgccagcccggctgctggtcgggtggtagcccaaggtgctgcatagctgctaggctgaatgggcagtccctggaaggcgtggggcattgctttctgtgcatgagggaggtctcttccagacttcagttagctcctcattcatccagaaacccagcccatcccctctctccctagatgctggcggaaggcatcctgccctgacaataatgcctcctcagggctggctcagctccccacccagtggacgcatcctgcttgggtctagcctgttgcccccataactaaccctctgatgtttggagctggggatggctggggtgggggcaaagagggctggtcttctcttctgaactctgtggtacatgtgtggcttcctttctgtagggatggaagcaaagatgaggacgaagagaatgcacagggctttccttgaggatcaaagtctttgattctctttggaacagtaggtccaaggaacacgatgaagcagaggcccatggttctttataagagactgggccaggctgggagaaggcgtgtgcaaggatgcacttagcaagccttcttgctgcacaactctagggggccccattcacatggagtattctgggagaatggagttgtaggttatgagaaggccagaggctctcgggttgaggcctttctctgattaagagggtcctgggctggggagctggataggcagggggtgcagcaaagtcaccctgtgttccctcttggcagtgtgctgatgaccgcgacgctgtgtgcacccgctccgtcaccgtccggctgcctggcctgcacaacagccttgtgaaactgaagcatggggcaggagttgccatggatggccaggacrtccagctccccctcctgaaaggtatgcttcgtcctgctccatcaggcctggggctggcacagcccatcccttagcaccctccttctcaaccctggccactgtccttaaggacctgcatgcctcttccatgggaatgtgatggagagttatttttggagggcagggtggggtgcttggcatgcatccctccaagaaaggaaggcttcctggaggaggaagactagagaaggaagcctatagatgaagaggttgctctagacctgggacagagtgtagatgggaaaagggaaccgagaggatttttatttggcttgaaccaaaggggcgagttgagtcttgggcaggtggttctggtttgctctggggtgggacaggggcagaggctgatgctgagagatcgggggtggctggtgatgtcacaccagaggatgccacttggggcgaggccaggtgaccctctggcctgtctagaggtagcaaaaaacctacctgtccagtatcttcacctgggttgcactgtgccggtcaaagcaaacctgcttttgcatggtaaagctcccaaacttcacactcaaagtggctctcagactcttccttcttctccacaactgctggccactttgtcgcccattatcctagcattgcacacagcggatgaacttgggctagtgggtacccagcacgtccatgggtgttatgctgtgtgtctccttataagatatgtttgttcccccagggcaaggggtgtgctcctatctgtcgccaccttcccacagaagcaacaattgctgtattcagtgtcgtacacagcatcgctcagacatgaggtggtgtgcagtggcagagtgtcccaggcacattcagatgtcgtggtgtcaatgctaaagagatccccctctgctccagggcacctgcctacagcccaggatgcaggagcctctgcctccctcctgtggcagtagggggaatggcaggtcatagcggggggtgcagaggcttcttcctgggggaccctatttgcgctctgtccaccttgatcrcccttcctcctgacacccccttaaacctcatggccaccccatctkcccctaagtcattgctcttcagtgctaccatccttttgagacaccccatttcctcccaaatacatctgcctgccaccaccctgtcctctccccacctctgcctgagtcctgtcctgcygggttccaggtgacctccgcatccagcrtacagtgacggcctccgtgcgcctcagctacggggaggacctgcagatggactgggatggccgcgggaggctgctggtgaaggtaggtgccctcacggggtactggctccctgcggcccgacccttacaaagtaccccttgtgctctgggtagaatggctttgtgtggtgggagaagaattcctttctcctcatggcctacacccccagagcragaaacaggcctctcttgtttatgaggctggtgtttgttttctggatgccccttcttggccctggggattcttcctgctgggctctgctatcccaagggcctctagactggggtgggctcttgtggggctggggaaggagcaggtttgctgtccaatctcccggctgaaacaaggcccgggagcaggggtgtctccctgggtgcccactgtgggcagtaagggaagagccagattggcactctcagctaagagaaagcctgcccgggaaaggttgctcargaaaccaccagattcttcccctggacactgggactctgcatgtgtgggccacttcctcttgttcttggtggtcctggaatcacactggatagcaatccatacttttcactgtttctctggaaatgaccctggcaggtggacagtgcaaatattactgccattttataaatgaggcaaccagggcacaggaagtggagggatggtgcmgcactccagaacttccagggctaggatagactcctctgatcagaggactgatcccactctgacccccaccaaccgtgtcatggcagagcgaggattagttctctgcctcatgcctttcccatcagaacaaaaagtggttctcgctttttggtcttgaatgcctttacactcttaaaaattattgaggacctcaagatcttgtaggaggattatatttattggtatttatcagattgraaattaaattagagacatttaaaatatgtatttattaactcattcaaaaattataataataaacccactacacattaatataaacatcactgttttggggaaaagtaactgtttgccagaacaaaaataagcaacaagaataataccactgctgcacatttctgcaaatttctttaatggctggcttaataggagacagctgggttctcatatctactgctgcattcaatcttttgcaatattgcatgtcatgtggcctctggaaaattccactctatacttgtaagagaatgaggagggaaaaggcaaatagcgtcttcatagtattatgaaagtagttttggtctcgcagaccccttgaaagtctcagggacccctatgggtctcaagaccacactttgagaaccactgcgctagattatgcctgggatccctggagagcctcctcctgcctcctggggtcctgtattccacagggtccttgctataatcctgggtggcaggggcagggtggcaggtttcacccaggagatcctggcgtcctccatcctcgtgtggctatgttctttctcctgtcttagagctcctgagggaatttcaaactaactcctttttttttttttttttccttttatgaaaataaacctgcaaccacagaccataaagcaggaaggtctgggagatcctcttgtcaacctcccttttccagtaggaaataaagagccattatttctggagcaggagtaacttgccctaggcctcatggtcgtttagttaccgggcaaggaccagaactcgggtctcctggttcctgaccagtcttgcctcctgcaccccggtcttcaagggggtgcttcacgttagccagttcactttctttttgtttgttttgttttttgagagagggtctcactctgttgcccaggctggagggcagtggcacgatcttggctcaccacaacctccgccttccaggctgaagcgattctcctgcctcaacctcccgagtagctgagattacaggtgcccaccatcatgcccagctaatttttgtatttttaatagagatggggtttcaccatgttggccaggctggtcttgaactcctgacctcaaatgatccaccctcctcagcctcccaaagtgctgggattacgggcatgagccaccacgcccggccagccagtccactttctcagcatcttcccacctcacagagagggtgctctccacccatgcactttctccccttgatcagcagggccgtaacttctcatcctgggcagctgcccttcctcccctcaggtttctttggtctttgtctctcccctgaggagaagagaagccaacttctttctgtgggaggggatgtagggttatctttggggtgggtttgtgtcagtttagctaacaagaagacgtttccttggccaaggttcaggacagggtcagatgaccccatggcctatagaactgtctttttatatatatttttcttttttctttttctttacacagattcctggggctcrtggaaagggactatcttgtgggttttattatgaagcaggaaagggggtgtttgagttggggcaggaggtggggagcctcagaatactgacaccagggcttttggggatggaagtgtggaggcgagagctggagggaggccagctggggcagaggcggtgcaagaggaggtgcagctaggggcccccyggtctccttcccctgggtgtgttrtgtacgctttgtccccgtggggctggcggtccaggcagcaaggctccagccagcagaaatcacatcctctgtgtgctgyttccctgccctgctggctgccctgcagggcccagctctgccttaggcatagcagtgtggaaaagatccttgcacaggcttcatttagtcagaactgtcactgaccagaggtttatttcaaatagtgagtgtcgctaagtgacactaagagagtctctaagtgtcgcccccactctcctaaccctggccgagctgacctccgagacaagccaaggggatgggagragacctggttttagagtgggrcatgggagtgatggctggcttggtgggggtgaatgaaaacgcctttggggagcatcaaactctgagaaaggagagagaaaagatgctgagaggcgggaagggagtggaggtgcaccaccagttatgccgccttgcccagggtgccctgactgcgggcattgcattccagcrcatcaggaggagaacctagtcattcacttacttattcattcatttgttcaacgattcattcattcaacaaacacttactgagtgtctgctggcactgctgtggactgaatgtctgtgtcctccccaaatttatatgttgaaatcctaacccccaaggtgatggtgttacgaggtggggcctttgggagatgakgaagaatgagatttgtgcccttttaaaagacctcagagagcttgctagccccttccaccatgtgaggacacagctagaaggcaccatctatgaaccggaaagcagggtcctcaccagacaccaaatctgctgatgccttcatcttggacttcccagattccagaactgtgggcaatcaatatcagttgtctataagccacgcagtctgtggtattttgttatagcagcctggaagggctaagacaggcaccattctggatgctgagattacagcagtgagacaaaacagacaaaaatccttgcctcatttagcttaagttctaatggagagagacagacaataaacaaagcaaacaagtaaattatattatagatcggaaagtgatagatcctgggggaaataaagcagagaaaggggcaggatgtgccaggattggggggatttaaattttaaataaggaggtgggagaaggcctaatgtgacaacatttggtatttgtcaagcaaacaaggaaacattactctgtcccctttcttaacagtgtttacttgggttcgatttctatgggcctgggaccttctactggattgttaaccctgcattttgttaggttggagctggaagctgaaaaggggctctaagagctgaccctagcccctgagggattcagaacgcagggaggtcatcccaccttggtaatgacatgcggagagggagtcaggactcctgggtcccagcccccgctccaccttcaaatcggggtcctctccgtagaaaccagcagatgcccccagctgtgtgggggaagggcgggctccactctgctggttgttcccgaatgtgcactttgggctcagaactttgttcagttctgagaatggacagtaaaccacatgctcatggcctggagtttgaactgtgccgctgctttgctgctgtcaccctggcaggctgcctcagagcctctgcagactcctactcctatccatcatcaccctcagagtcttctgtggctcgtggccctttctcttcagtgatgcccagggcctgagtggcaggcagcaggttgtggggaggtgtttcttgtcattaaccgtgagctcccggagggcttggaccacacctggcagcctgctgggcccacaccgagtgaccaacgcgaagtctttctatatagaggggccttgagtttgcacgtaactctgggtgggggggtcaggcccactggtgtggatggcacagagggcagagtgcttcgggctgggctcaacctgcctactcaccctagctccgccactacctccctgaccttaggcaagtcactttgcctctttgggcctcccttctccatccttagatgatctgataatttctaaaatctcttgtggcagtacagggctctgatgatttgggaacagggatggagctggtaaatttacactgcagttcactttcccccgcccccccttttgcagcctagggcttagctgccttttattacattcatatttatgtttcacccggggaacttttttttttttattaaaaccatctcattagctaaacaactatgccgctgctttcgcggcagcggctccagagtggcctggtctctcctgcagctgtcccccgtctaygccgggaagacctgcggcctgtgtgggaattacartggcaaccagggcgacgacttccttaccccctctgggctggcrgagccccgggtggaggacttcrggaacgcctggaagctgcacggggactgccaggacctgcagaagcagcacagcgatccctgcgccctcaacccgcgcatgagtatgtgaacccgggggcaaggcagggacctcgcagaatctcgaggtctccacattagtgcagtgcgttccggaggcagtgctcccaccgcggagggcgggggcggggagcgaggaaaggggtcgggctttgtttttaccgtcagcacttgatcatctgaactgggccatttgctcttcaaagtccctttattgggcgcccgccacaggccaacccccgggaaagaaaaaaaaaaaaaaagtctaccgaggcgggaggatcgcttgagggcaggagttcgagaccagtctgggcaacgtagggagcccccatttctattaaaataataataataataataataataataataataataataataataaatttgccgggcgtggtggggcgcgcctgtaatcccaactacttgggagctacgtgggacggttgcatgaacccaggaaggcaaggccgcagtgagccaagatcgcatttctgcactccagcccgggcgacagagcaagaccgtgtctctccaaaaaaaaaaaaaaaaaattccatagtccccgtccttcgaccttcccagtctactgcagcagcagcttacaaactcagcgttagatgattgtaagataaatggacttgggggtgggggtggcatttgcagatttctctgcgtgaccttgcagccctctattagcagcactgggctatttccaggggagtgttgaccgggagggcgtggcccccactcctccccaccacatcccaggctcgctcctctcgccccacagccaggttctccgaggaggcgtgcgcggtcctgacgtcccccacattcgaggcctgccatcgtgcygtcagcccgctgccctacctgcggaactgccgctacgacgtgtgctcctgctcggacggccgckagtgcctgtgsggcgccctggccagytatgccgcggcctgcgcggggagaggcgtgcgcgtcgcgtggcgckagccaggccgctgtggtgcgtgccctcccwgcccgcagycctccgggccgccccccaaatccrtccacgtgtgcttttcgaagccctttctctgcgttgtttcctgtggaaagagggcgtagggcattgtgacaaacacgggtggggaggacggttcatttgcacccacttttcccttccacctcccagcaggacaggcggtggggaccggctgatgattcgggcctgttccaggaagacaggttggctcctcctacctggaggcctagaacgtgggggtccctgcaaagcttgggtttcccgtggccgctgccacctagtgttcgttcagcacagaaggtcaggctgtggagcgaatgggtcccagatcccactgggtctccgcctcccttaagagtccgatgaaggcaagggaaattcacatacaaaccctttgcttgtaactccaggcaaaccaccgatggacaaaacctctggcgttgtataaagttacctaaaggtgaattacatcactgtccccagttggctttagattctcactctgcactgttggattcctggcaccagaggtggtatctattgtgctcacttttttgtttttgttattgctctggggacatttgctgcatgcccagtgtggtcgggcaacagtgatgatgtggaactccaaacttactgttagagtcacagatggaaatggccgccctactagatacctatcctactaagtgaaaggatragtagattcagggcagggaaaaccaaggaaggctttctggaggacgtgtacttggctagggttttaaaaagctgctttcttggcagagaagacttgtttccaatggtagaatcatagtaggcatagaagtgacgagtatattctgttaagaataaggcatagtggatattctgttttttagggtaaagtagatgtgtttagaaattaaaatgtaggtgtagtcccagctacttgggaggttgaggcaagaggattgcttgagtctaggaatttaaggctgcagtgagttatgatcgcaccactgcactctgacctggccaacagagaaagaccctgtgtgtgtgtgtgtgtgtgtgtgtgtgtgtgtgtgtatacatatatatatatataaagtagatggtcctgttggaagaggagttatgagaaacagtgaaaggaattagcatctatatttcaggagcagtgtaggcatggggaccctagaagtgctactattttgggtccaatgagccaactcatgttttgagttgtagaaatgtcatatgaaagaggagcagagacaacagtaaggacgaaagggacgagcacataatgcagccgttgtgccctccccattcctccagctctgggatgtcttggggagccacaggctaggggctgggacaactgggtctgggtccttactggcaactttcccgtgaggtaccagttatgggaccttgaacccttcacgtaacccctttgcacttcagtttcttccttagcatttgctatttagaaattggggaaagtaatgaggagtgaatgagatgctgcttgtgaatattctttgcttgtccaccagtgttagaaatgatgcattatcagtatgtggcagcatccgcaggatttcttaatttaggacattctcctggaatgctaagggcccactgaaatattctttaatctgtcatgaacagccattcttaacctccactgaacagaacaggggaaatgggctgatgcttcagtagtggggataagattcagttaaagaatgtcttgactcctgaggcattacgatagggtagaaagggtggtaggaaggagctttccctggagactgttaaggacaagaggggtctgtctctgtgggtttatgtgacaagagactgggctgaccagatggccttgggctgtccctttgtacccaaggcagttgggtaagtctcctgggttcttgccccaatcttttcttgacttggagaagagctcaggctcagctgtcccctctacccacttccactttctcttccagagaaatgaacagagctccctaaaccagtgaatctattcgtaagaagaggtcacatcaattggagacactcagggagcacagacttaccatgtagctactttgtgggatggtgtgaggagattgatgagaagcacacacattttttttcctcttgcaaattggttgtgctccctttrggaagacaggaccacaggctttctgaaggcaaggaccagggctggccatctctgcctccctgggcctagcatagcccctggcatgcagtggatacacaagaagtgtctgctaaactgagawgtgcattgtttctttggggaagaaggctaaaggagaaatttaataaggctccaagccagcyctagagatagcctatcagaacaaagaaagttctcaagtctagctgctttttaatgggtaaaatgtgcccttgtcattgtaggctcaggtggttgaaagacatctccatctttattgtctaacacatcctgtcttaacctacactccctcagtattcatccaataatccaacctttccattcttgcagagaaaaatcaatgtctaataggattaaagaggccctcccttcccagctaccttcaaacaccaagttcagggtggttgtaggagcgggaggctgcagggtctctccagaggctccccactccattgttcaggctcacggccaaggcttacttttataacatctgtgaaatgccctgccagtaggtttctgctggagcaatggatttgaacagagaggggaaggattgtgatggtctcagaagaagcatgcccagggtgaggttctcatttcttgggcagcagctggtctgcacagggaaggcattttgaaagggcagaatgctccccacaccttccctgtcctctaccctgcccataaggaattttgtcaccagaatgccagagcttctgaggcctaggcctttctctggaacactccttccttcttgggaccgctgagctggggctgtttccttagcaataagaataataattattatcagtgaacattattagcagtgaacattctccacatgccagacattcttctaaatgtgttagctcattcaaccttcacaaagactgggtggatactgttattccatccagtgaggatactgcccaagrtcacacagccagctagtggtggacctgggcgtgaacccaggtatttgggatacagagcccgttcccttagctgcgttgccactttgctacacttcctyctggcttgtgtctcttgcagtatttttctgtgggaggctagggagggtgagggctgtgggcagatgggtgcagcccatttcgctgtggtaggyatgagtgtccctcctctttgggaccagcatgtcctcaaagggactgttttctttctagagagtaagggttatgagcatgagctttagggctgcagagagctgagttcaaatccttcctctgcttcttcctgtgaggtatacccctaacaagtcactcagcctaagtttcttgaaagggggtgatgagagctaactcggcatgaggcatagagcccacgtaagagcaaggcattcagtaggtgctccataaatggtactcattgttgtcacggggtatgcccttgcccgtcattcccagtactttttaatattcacagcttcaaaacctgccaggatttctactacatcctaggctttgagaattcagagatgactaatgcacattccctgtggttgaggaaaggagaaaatgtgtgcccccataattataatacatatctgcatgctgaaaaatacacatttgctcatagtgggaaaggaagttgatgaccatacagatataattgggggtcacttggggaaaactgggtaaagggtacatgggatctttctgcattacttcttgtaattgcaagcaagtctacaattatctcaataaaaattttaattaaataattgggggtcacagctacaaggggtggcaagtcctagaaccacagtccttgctgtccaacattcccgctgaggccttacttcttctcctctctcttctagagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggccyagtgcccctgttactatgacggtgagatcttccagccagaagacatcttctcagaccatcacaccatgtggtaagtgcaggcagcagtgtcagggacctctaaaacagcagagctggggaggaaaacgggacccccaagtcctttacttcatggatgggtaaactggggcccaaggaaggaagtgacttgtccagaactgtacagcaagtcagaagcggagctgggatttggtccaggtcttctgacttccttactacacagggaactgggattcctggctggcagtaggagttcttgagttttattgccaactgttatgtgttggcccccatttctgggctttaggtctcagttttccttttctggaacaggaaaagggagatctgcctgtcaccctcctttccagcctgctttcagtattctcaagctgaagcatttgagcaggaagaacatggaccactgcagcgctgcctccatggggcattgctaccctgacctgcttcatgcacttccccaaaatagctccaaatcatgcttgcttcctgcagctctttgcctaggccttctgtgacagtcggtttcaacagggttgccatgagcgtggaagaaatttacaacaggacatttgttgagcaaacacttacctgtcacctgttctgtcttagttctggctaagaattggtggtctaaagatgagccaggctggggcagtggctcacatctgtaatccccagcactttgggaggtggaagtgggaggaatgcttgagcctgrkagtttgagagcagcctgggcaacatagtgaggccctgtccctaaatacaaagaaaaaaaaatagttggccatggtggtgcatacctgtagacccagccacttgaaatactgaggtgggaagattgcttgagcccaggaagccaaggctgcagtgaactgtgatcgcgccactgcattctagcccgggcgacagagggaaatccagtcaccagacacagtacctgatagtctactagggaagaccagttagaaacatccyrattggccaggcacagtggctcacgcctgtaatcccaacacttagggaggcygaggtgggcggatcacgaggtcagtagatcgagaccatcctggctaacacggtgaaaatacaaaaaattagctgggtrtggtagcgggtgcctgtagtcccagctatttgggaggctgaggcaggagaattgcttgaacccaggaggcggaggttgcagtgagctgagatcttgccactgcactccagcctgggtgacagagcgagactctatctcaaaaaaaaaaaaaaaaaaaaaaagaaaaaaagaagtcctgattatggaaaatttcagacagacattaaagtagagagaatagtataaggagccccaacgtatccattcccagcttcaatgattatcagcactttaccattcttattttgtctattgactcctctgctgtgtggctggaatagttttttaaaaaagctgtaaatattacatcatttcacctgcaaacacttcagtatgtatttcaataaataaacgattaaaaaagtaaaggtaccattattaacctgaacatgaacaataattccttaataacgtctaacattcaatccatgttcacttcttttttttttttttgagactgaattttgctcttgttgcccaggctggagtgcagtggcacartctcggctcgctgcaacctccacctctggggttcaagcgattctcttgcctcatcctcccgagtagctgggattacaggcacctgccaccacgccccgctaatttttgtattttagtagagacggggtttcgccatgtcaggctggtctcgaactcctgacctcaaatgatctgcccgcctcggcctcccagagtgctgggattataggcatgagccaccacgcccagcctggaggattgttttgaggtggagcagaagtctagggactaaacgcacaaggtgtactccacaatccccaaggtaagtcctctggcatgaacgcatgctatatgaaggaagactaagactggagggaagttgggatgaggttcaggggtcttcagaagtgagggggtgagcactgatgctggagcagtaggaatggggcccctggaaggttcttagcagggagcaaataggatccaagagtaacttcagggggtgggttttgggagctgcatgaggtatgatggcagggagagcatctgcaggaaaaygttgacgttgaccgataagaaggtagcgaggccttggatcaagcgatagcagtagaaatggagagtggaagccagaagccagagacgctgggaaagcagatggactagtgggatgtttgagaggaggaggggctgttgcagatggccctggagttctgaacttgaatgcctgtgaggacagtgacgcaagaacagcaagagggccctctggaggtagagggcaagtgatggctttggttttggccttaatgactttgagttaccatcttggtgaacaaatggaatcaacagcttgaaatgggtctggaaggtgagtgagaggttggggtggagagaaagacgtacatggaggtgacagtttcagccatgagagtagcgaggatccctaaggggagtgggccagagggcagaaaagaggactgagtcagaacttgggggaatgttcagagggcaagaggaagaaaaagaggattgcatgagagaggccaaagrtcaaaggccagtaaaaagggcagaaccagagcagtgccatatcatggaaatgaagggcagaagggagtaaggacctcctctgcaggactgctgacttggccttagcccagtgctgttttactacagttgtctggctatagtttgccaggagtttctctctgggaccttaaaacaacactgttgggcaggcatgacttgcttttttagtaaagaatttgaggcttagagagactatcactttcctaaatcagccagcaagtgactagagcccagggattcttgaactctccttattacagtgagaatagacggttgaatttggggatcagaaggtcatggtggcctctgtgtttcagtggtaaggatagaggctagactataggaagttggtatgacttgggagggcagcaactgttgctggctatttcactaaaacagagaaggtgggagaaggtgcgccttggcccctgggtgaacagggttggggagtgaccctggctttgggctctttttagggtttgacatcagcgacctctccatgtctgcgtcctccttgtctctcttttaggcaccagggctgaaagctattcagcagcttgtctttccacttcatttagaaaattgggtttcacggagaaggtgtgttggaaggacctcggggcctgtgtgccgctgtttatttttattctttagacaacacactggagaatgagcctcgctggagcaggtgctagtggtggtcgtgaaaaggtggcaggagggtgaaatgctgtggcctggaggttctgcagaccgcgtgcttggtcatcccagcggccatcacaatggagtatttcttcttctgcagaccaggctcagggccaggagttgattttaaacctatctttgaggctttttagaaaattaagcttttgggtcatgtccaaatgacagattgaacatgacatttacgggggcgggtggaattttctcccttaaaactaggtattagttaaaaaccagaagaaggcacgggttctgcaygtgctcagaaagggaagggctgattctcttgttyattcaacagatatttattgaacagcagctgcattaaaaatgttcaaaatcattacagtcagctgggcaaggtggctcacgcctgtaatcccagcactttgggaggccgaggtgggcggatcacttgaggtcaggagtttgagaccagcctggtcaacatggtgaaaccctgtctccactaaacatacaaaaattagctgggcatggtgatgygtgcctgtaatcccagctactctggaggctgaggccggagaattgcttgaacccgggaagtggaggttgcagtgagctgagatcatgccgctgcactccagcctgggcgacagagtaagactctgtctcaaaaaaacaaaaacaggcagggcacgttggctcacgcctgtaatcccagcactgtaggaggctgaggcgggtagatcacaaggtcaggagatcgagatcatcctggccaacatggggaaaccccgtctctactaaaaatacaaaaattagctgggtgtggtggcacatgcctgtaatcccagctactcgggaggctgaggcaggagaatcgcttgaaccagggagtaggaggttgcagtgagccgagatcgarccactgcactccagcctggtgacagagtgagacttggtctccaaacaaaacaaagcaaaacaaaactgaataaaattattacagtctgagaaatgcaaattaaagcaatgagtatgacttcatactagactggaaaaattagacatctggataatgcagagctgaggggcatgggggcctcatctgcttttgtaaggcatagactggttgagtcatctaggagagtacttggcacatcatgtgcaggtcaggtattcacacctgctatccccgcccttctgcctctgtgcagatagactaaaatccttatacacattcattaggacacatgtctgcagatgttcagcacagctttgtttgtggtggtaaggagcaggtgacaacctatgtcaatcactgggacactgagtgggtaaaaggtgtattgtgcaacagaagtcacagacaagtggtccgtgtcttcacagggatgaatcttacaaacacggtgctcgatgggaaaagcaaaacacagcatgctatgtgatatcatttatacaaactaaacatacatacaaagcaaccacagacgttttataaaaatatgcagtcagttaggagacttttacatagtccaggcaagaggtcatagtgtcttgtctcatgacagtggagataaagtggatatgaatttcagtggtatgttggaggccaagtccaagggcttgatgatgaatcagatacagaggatgagggagaagacagtggcagggatgatcytgggtttctggttgcgaagccagatggatggcgtcaccattcagtgaatcagccctggaggagaattggctttggtcgggggatcatgagtttagttttgaatatactgagtttgaggtgtgtttgagactcactacattagtgagaccatgtaggcrtttgagtatatgggtctggggttcaaaggagcggtccgagctgctgatgtagatttatgagtcatgtctgtgattggaactggggatggcagcagagtgtgagaagaggagcgagcctaggacagagcctggggaaggccgatattgaaaggccaggcagtgggggcacatgaaagctgaggctgagaaggaggaaccaaggaagtgggaggaaaacctggagagagaaatattttttttctagaagagtggagtgttcaacagtgatgaataatgttgaatgggatcaattaagcaaataactgaaaaaagtcccatgggatttagtgacgtggggatcatccattggtaacgttagcaagctgtgcttcaggaggggttatgggactgggacctggttggaaggggcagagagtgagtgggaggtgaagatgtggaggcagcgagtatagacgagtctcgtgaagctcggctatgattttcttctctgcagctactgtgaggatggcttcatgcactgtaccatragtggagtccccggaagcttgctgcctgacgctgtcctcagcagtcccctgtctcatygcagtgagtactgtccccctggaaggcccattgactccatcctgcccagattcctcacgtgtggaatggcgggagagagctgggtgacaccgtcagatgtgcgtgtgcacccaggcatgggtctggcttcgcccaggatcgccttcatttctgggtttgtgtgagtgactttcaggccaaggcatgtctttgcatgtgtcaatcccgaccattgaggcaaggagtatttgatttcgtgtaaggggaaagacctgcagataaattctatgagacccctattttgcccgtggagaccttaacccagtggatagctgtgagttggtggccttgattgtgatgacagtcacccttctttgatggcctcttgtttcctatggacatgctgatgaagacagctcttccttgagaaagcttcttggatgggtttgaaagagagaaagagaagggttgggtccgttgctctccattcgaaggtcctaacggtggctgcactgtcttttttttttgagagtctcactctgtcacccaggttggagtgcagtggtgcaatctcagctcactgcaacctctgcctcctgggttcaagcaattctcgtgcctcagcctcccaagtagctggaattacaggcatgcgccaccacacctggctaattttttgtatttttagtagagayggggttttgccatgttggccaggctggtcttgaactcctgacctcaagtgatctgcctgcctcggcctcccaaagtgctgggattacaggcatgagccaccacgcctggcctgttgtactgtttaaggaccaggcatggaagggagaaggggctgacctggtactgggggtttcacatttacatttatggattgcagcacccttatttgcttccagaaggcttatccttgcttagaaaggactcttccagtgggagagagataaatggctatcttcaatctccagcttgactgcttccctctctgcctctcactttccacaaggctccttctgtccaagggacccagttctgtgccatggtgtttgcttcctggcttgccctgcgtgacaggtctggctcctggcgtgaccgactggagagcgtctctcagcctagagctggggcaagatcccgagggcatgggtggctcaaaggttgagaccagaacttgtgacctcaagatcactccatccttctgtgtcttcttctgtccctctcagagagtttyccccacacccactctctgttgcattctgcctctcagacctaccttccgtgcttctgctcagaatcttctagtctggtcactggaaaatgtaatatttttcaaagtcaggaaactcctgggattctgtgcagattgggaaaagccgtttagccttttggagtttcagttttctaacaagagtttccatataaaaataaggcyagaaattttgactgttttgcccagaggagcgagtatgtgatacaaatgctattaagtgcacctgggctttggaaagaaaggtgctgtatcagtcatctgctgtcagtattacccaattagccattgatacctactaattgccacgaagtaggatatgtcaatgcgcaaagtagatagaaatccctggcttcatggaacatgcgttctagtgggcccagtggcttggggaggacagtaaacaagtaagtgagatgtgtagtatrtcagatggtgagaagaacatatataggatatcagaggggaagcagcagggaggggagattggagtgtccagggatggagtgttgcgggtgttgcaaattcgcatggagtggctgggcaggggctgacgcgagcagagatctcttttaaagccattgtggtcagatggccttctctccccacattagttgtaaccatttaggaatgattctgttgggtccattaaaactcctttttagcwcccaaactcaggtcttttcaagcctgggtctggaaatttctgcaatgcatcctgattcaatgtaacctgctatagcaaggttaagggtgatgacaagtatgggacattagatgagagctggggtcagaagagctgccaccaatgtaagccagaggtcagaagcccaggtgagaagatgccctcccagtcccacacagggaccctggctcaggcagcygctggtccccrygagtgggcaactctgagtctcttgaatttagtcacagactctaggggaccaaaggacagtgtggaaggtaggtccattmtctccttcactaatcatctctttgcttttcctaccttcgaggcaaaaggagcctatcctgtcggccccccatggtcaagctggtgtgtcccgctgacaacctgyrggctgaagrgctcragyrtrccaaaaygtgccagaactrygacctggagtgcatgagcatgggctgtgtctctggctgcctctgccccccgggcatggtgagtcaccaggcacagagctggtgcctgcccttcagttttcttgtaggcagggatgagtgagggggctgtgcagccagagagaggaagaaacaagggctaaacacggatagcaatggaggtggtgctggtaatgggggcatggaggaggggaggctcttctgtctcctccctgccaaagtcagggagggagttgttaggaaaatgcctggggttgatcctcacaggatctgacaaaaatataagaacttagcttacaggagtgccataggaagcaaagaatttccagaaaatacgtactagtaaaaacaagcattcccactagaattttcccaggggccgccttccatgctatgaaaatggagggacacatatatatttgcatatgattgacgtatatgcatataattttctatttcaaaaaaagacattgatggccctgccgtgtcactagcaagccatgggcccaacaagtctcttycccacaatgaaacttgttttcctcatctgtaatgtgagtcgtgaggtcttggccagcccttaacattccatgactccggtgctgtgcctgaaacaggcatggaggccgtgcatccaaggccgtgctggtttgcgactcctggctcctatgtggatgttctgctgctggtggcaatgatctgagcatgcctactcctccttatctccctcccaagtctaatcttagccagcgttgtattaaatagattaygcatacatcctgaaggatgcaacttccagatgtttctctttcaaaatgcatcctgtcttcttgttttccccaactccaattccttatacccaaagtgaatggtgaggagttggggcagaggctgtggaggccagaatgggagagggtggctctcagatggctttggaggggacttagtgttgcccaggactctgcttgaggggaagtgtcctggactgtgggacctgtcaatattctgtagagggaatgtggactcaattaccagtgtctctcaggaaggctgggattgcagtgtgtgaaggacagatgcttacttttctacttccccttcaactctttcttctcccaaacagagagaccaactcttgttaattctctcctcctctgtcttagcctctgagggttttggaactgtcttttctgatgaggagagctagcgattggccaatgagcacctttgaactggaagggttgtttggtgccttagcagaaggtggatatcacgaagggtctctaaggtggggaatctcagacctgggtaggaacaaaaaataggagagggcaggggaatcttccttattgctcttctttatccctggggcctcttaggtagagtgtctcagagctttggtgtggggaaagcatagatcattgtctcttcatcatactcagcaggaaaaggaacatcactcagaggactatgtcagcatcggatatgctttgaaacaaacttttttgtcatgaaggaaaaaatacagatagccttaaatattagtaaccacaataattatattatgaccccaaatccaaaaaagaggacagcgggacctcaaatacaggctgtggctatcctrttaggcgctcatttcattcctgaagcactgggcatgcattctgaggacagcacttggatacctgtcacgtgacgaggtgactcgcacttcagccacaggggattctaacttgcaggttcatattgtaagagattcggttattttcacaactgcttccttacgatgccggcgagtgtgcaaattattgcggccagattcgagasagcagagaagtccgtgtaatttattaagggtgcgcagcgtgccgcctgcagcacgggacacgtgttcttggcyataacacaaagaaaatggagctgggcctggaaacaccctgtttgggcccatctgatggtgcagacatcatccctcggggtgttcctctgtccagtctgtcccttgtgaaggggcagggttgtgggatgtcactaagggcttggggaaggggtcacggattctgcattcttctgaggacttgacaggggaaagggaagtggctttttcccgggggcagatctgcggggggcagaaagagcaggaatggggtgcagagggcagacccgtcaggccaggcttccctgctttcccactccatgctcttgtgcaatccttcagtctttaccggaagcccagtcacctcatgtgttacgtagacaccgaattcctgttctgcctccatgatgcatggctgtgggccccaaggagatgtgtgtgaaagcactttaaagccagagagttctacagaagtgtaggaatagctttcattgttgtttctgtaactatccaaggctgtctcagaggctgcacccatcagttcttcctgctgtccataggagagacctgtaaaggatgctttttcttagatttccagcctgctgtggacccatgcttttgtaaatacaataaaaatgaattctcataaaaataaaacaaaagcaatgacaaaaataatatgatcccacccaactaaaaaatattttcagctgggcgcagtggctcacgcctgtaatcccagcactttgggaggctgaggcgggcggattacgaggtcaggagatcgagaccatcccggtaacacggtgaaacgctgtctctactaaaaatacaaaaaattagctgggcgtggtggcgggcgyctgtagtcccagctacttgggaggctgaggcaggagaatgccgtgaacccaggaggcggaggttgcagtgagctgagattgcaccactgcactccagcctgagcgacagagcgagactccgtctcaaaaaaaaaaatttcttttttttttaaaaatttttttgagacggagttttgctctgtcacccaggctgcagtgcagtggcatggtctcggctcactgcaacccccacctcccaggttctagtgattctcctgcctcagccttctgagtagctgggattacaggcgcacacgaccacacccagctgatttttgtatttttagtagagatggggttttgccgtgttggccaggctggtctcgaactcctgaccttaggtggtctgcctacctctgtctcccaaagtgctgggattacaggtgtgagccaccatgcccggccttaaaaaatgttttctttcctttttttcatgatccctaaatctaaactcttacttcccactttttatgacatataacagacataacatgactctgccaaatttccctaagattttctaaacactttctcttagtttctgtgcttgcgtcctcacaggctggccctggcccagggaatgcactttgagcagccctgttctcagccgaagattgtctctcctcctctaaggtgcctctcagtgtccaccgtatgcccagaagcacctgtttgaaaatattggcgggggcagagaaagaacccctctctttctggtttgtcccaggcctggcacctgcttagagcagaggttttctggttgaccccacaagctgcaggctgtatctgctcctgccatcgtgcaaaggtctcctggcatgggaatgaggaggatgggggtccctttgctaagtggtccgcaccgtgataaatgaagggcagagaaaccgcctggaaacggcatggtatcggaacctcayacttccaggtttgaatcctgcctcctaacatctacttaagtgagtggcaagtcacttaacmtcttggcgtcttaattttcttatctgtaaaaytggcttgcaggctgttgggaagactggagatgagagcagcgagcacatgggaggtgcttagtgagtggtggtttaatgaccactaactattacagtaagttcgtggtgggaaacggtgaatcctgccatgaacagagatgctgcagggaattagcacacacaggagcatctttttagatcccagtgttcactttctgagacctgccggatcgataaaatgagggggttgtgctggaagatctcccaggtatttttctctagttcagaaattcttggagccatgcttgcctgaagcatccatctctttaagttagaatattacctgctaccaccactaggtgacagcaaagcacaactcactgccctgctcacccttcctgagtccggcggcaagggtaactctgggagcatcgtagagggcrgagaagaagaaaccctgaggtcccattatgtcagccccttctatcacacgggaggagactgaggacagaaagggaacagagccgggtcaagccttcatagttgtatagtggaaattctggtctcctgactctgagaccagggctcctgtaatctgaaacacttaggcctctgtctgggagatgctgacttcccgtttgaaacctagcagctacatctcccaaactgctggtattaggagsctcttggtggcgagaagtgtggttatgtccctgatcccaggatgtccagtttcctcactggccccatgtgaagactgaaggagttgggcaccacttcttaaagttcagagcttgggttcaagggcccatccagaggcggcctcacatgtgggcgttgcacattttaaaagatccaaagaagggcctgtttcagaaatatctcctacatggtccatgatttgtcactcagtcgggcttactgaaatataataagcaaaaattcattttggttaacaagcgagaggtttaaaaaaagcggaacctcataagtcttcataggaggagtcatcacgctcagcaggagtgctttaatcagatcactctcctccttgcaagcttctggctgagttcagctgctttggcctgaaagtactgatggggtaggagaatgaacgagaggcagttggaaggtaaaaaagattctggagagtgggtcacgatggtgttcacgtatggagagttggggacaatggggccttttcagagaaaggtaacaagaccagtattttcctactttataattttcttggagtggaccaacacgtaggaccacgttctcagcctgacccctttcggactgaagatgtcatgagttggtgagtgatgggacgagtatttttgccaggctttcttctgaagtcttcaggggacattcatagactttatcttagtagccttytgatgtcccgaagggasaaacactagacggaggtggttctcttcattttaactgtgaggtttaagtgacttgccacaaaatttggccagggactgytgtgctggcctgccccgcctctctgcacagctcccctctgggtccaatccatcccctaaattacccctttatttccaggcctatctacctccatgaatttccacctccctgaatgtctttgccactttgggattctctgggtgtttttagctgggctattgttacctgctcttctctcccaagtcaggaagtctcatgctgtgtcctggaaaccctttcctctcrttgaagattatgttttgtctcctctccagctctcttatgacctaactccacaccactgtggccttcatagcagtcctcacttaatatcaaggtcctattataatattgctgtccatgaattaataacctcctcttgctaacacgagtcggcagagagcagccacgtggtttgcagtgggtgctcagaaggaggaggaggtggcggctgcagtcatggcrttgttatctcacacctgagctgggactggagtgttctgtccgctggaggagggctgggcttccatagacccacacctgggtgacaggagggtctccctgggccrtgaacgcatggtgggttgtcccatgggttgaatatcatggcgagaggtaaaaacatgcagcatgcagaccaagaggcctgggagcccccarcccggcctgcccaagggtgaggggcaacatgtgctgctgaggtaaggggagcctggctctgtttcctggagtccgtccctgcacttctgtcccacatggtatttgccacaaggaggcgtattatctggtttccgttgactgtaaggcatccgtgggatacctcagtcattcttatagcagccactaggtggtgggcctcaggcttaagtcagagctgacactggacggggcgatgtggacatgaaccctaattgtgacagaggctttgaatgctctgctagagagaggtttttcagccctgccagctcctaccaaggtgccatcttccctactgggtgcttaagctcattccctcccaagaacagtggttccgggaggtaagagctaccaagagtggggtcaacctgcatcttatgccctgcactgtcatcctgacccatcagctgggcttccagagatgcgggaacacctcctgaggttgggtgaagatgrcattaagcrgtggaggattcttcctatttccctccccccaaccgccccaacacacacatgctyacatacgattctagcctgggtccttgaaagccctttgttcarcccaasattgccctgttcccagggatttgtccagctccaggcctgggagctcagacttgtctggggagtgactgggtcacgtggagctggaactgttcagaccaggagcttctcgccctgcagggagctctggagccaaggtgccacagtccttcacctgggggtgacccrggcctctttgagaacccccaaggctaggccacaccaggacaggcacccagggctgccccttggagtcgggacagaagcgtgtctgcatgttgagctcagagtgggtttggctgactcttctggggctggtagttcttagttcttttattttctcagccccaacagaccggaggaatacaacatgctcacgaaagtagtttcccgaggggtgasgacggggaagtagagcataccccatggagagtgaaccgggatacgggagactgggcaggagggggcctgtggcttggaccagcccccagactctagttctgatcgatttctacttatgcccartatttggccctcacctccagagtrttaagtacatattaattttattcaatatagtgttcattttctttaattataaacataatacatgctcattgaagaacacttggaaaaaaattttaaaactgaaaaagaaaataaaatcctcccactcgcctatcccagctcaccacctggaggcagattctgtatttccttctagtcttttgtgaaatatatatacatttggaaccatatgtatatacagtttttcttcctgtgttaaaaattaacagcataagtatttctcacttcatttaagattcttccaaaggaccattgtaatagcaccataggatactggcgcctggtgattcctcartggatttagtcattttcctattaagtgtttccaatttttttttgcaatgataaataattctccatcaatctttgtccataattctatttccctcagagaaatcctttccttgggatggctaggtgtaagaatatgtgcatttcaaggcctctggacatgattttttgaagtacctttgcaaaaatgtccaggttacagtgycccagcagggcacgagagggcagagggcagtcagtgtctttagttgacagggaggagccatgtagatgggaacccatgtttgccaagccctggcctgggcataggatccctgtcctggcttggcctgcagtggaagctgtccccctggctcagccctggtcctggtgccagtcccagtgctgggcttacccgtaggctcaagtctcagacaacacttcctggagcgggctggaggagggctttagatcagtcactgtggccctgaggacttttggattcttttctcttaggtccggcatgagaacagatgtgtggccctggaaaggtgtccctgcttccatcagggcaaggagtatgcccctggagaaacagtgaagattggctgcaacacttggtgaggctcagtgaggggctgcgcyggggacccaggccctgcgggtggagtgagggtgcacgcggccacaggaccttccgcacttgcctccagccccctgtgggaacctggttactctctgcctttcctccgtgcctgtgtttctccatctgtaaaatggggagaatctttttcatcacctgtgtccatcctgcatagacactattcaacaggttagtacagtagcccttatccgaaatgcttgggaccacaactgttttggattttggattattttggactttgaaatatttgcatatacataatgaggtgtcttagggatgggaccyaaatctaaacatgacatttatttatggttcatatataccttatacacgttgcctgagggtaagtttatacaacattttaaatatgtatttaatgtgtatttagtatttttaatgtwtgtgcatgaaacaaagttttgtgtacattgaaccatcagaaagtaaaggtgtcaccctctcagccacccatgtggtgtcatgttggtgctcaaagttttgggtttcagaacattttggacttcagagttttggattaggaatgctcagcttgtatttctgttcagggagatgggccccagggaagacagggacctcgccccaccagtcattrcatttgggccaagctgccagtgggcacggggtctggagggtcctttcgttgcaggccttacactgcccatgagcacttcgtgagtgtgcttgcagtggcgtggtttgaggtgagggtggctggttgccttctcccttttccttggccatcctgcacgtaacccctcaccctgctcattcaccctgcctttgacttggtggctgtgcacagccttggaaagaggcctactggacagaggtagagagggctgtctcttgggcttgaggtctgagcttaccacctctgacgcacaagtgggcttcttgatgtcagctctggttacgggtggtggcagggagggacacgtggcagtgggcagatcactatagattttaacatgtagctacatacatcttaacgtgtagctatgcacacaggactgctcctggcagaagtgcgtacttcatcactcttttctatactctgggctttcccactgttctgtcttgtttttcccattagcctcaggctttcaacatcagtgtgtctgttttacagacaccctgtggccaatctcaggtagatgtggctttcagggtgaggctgagcgaattcataacaggaggcctaaagagcatccgggcctcctccctggctgcctggctcactttggacaaccccttcccttctttgcctcagtttcccccttttagggacagccactaggcttccctgtctcctgctgggcmccatrctgggcctatgaagtccacactccaygctacaggtcctcaacttccttgggcttcctggagggttgggaggcacccagagtattctgtgttccttcattgcctccatggcccagatgggcccctcaaacccaaggtgcccaacttgtcatctctgccatgactgctcctagtgtctgtcrggacyrgaagtggaactgcacagaccatgtktgtgatgccacgtgctccacgatcggcatggcccactacctcaccttcracgggctcaaatacctgttccccggggagtgccagtacgttctggtgcaggtgagaggtggggagatggggagagggtgctgtttctttctaggaggggtgggaggtgtggcctcaggttgggttctgtggatctgtctgcagaaacaactctggggtctggtttctactggagtacttcccagtccttcacagaagtgcctgaagcggtaggggatttgaagctcaaagtggttgtccattttccctctgctcacctggggacttataaaacgagacagaagcttgtttgttgttgaggattggtgtgggagaaaggctactgctagtccacattagcacagatgtggaattagaaaaagtcatctgttccttctggtagacacagcctcagtcagggtgcatagcttagggagtgggttgggctgggaagtcagtcccgctcagcctcccttccagcaccctgggcagtgcacagtctgcaggtgttgtgcagtggccctggacagggggatggttgaaatgacccctggagtttgcttcccacgrtatggctttgtggaattctccgccattttaatgtctaacttggtacaattcagaatgggaggagtgggaggatgggacacaggaaagtcatcctgcccagcagatgagagcgatccaggaatcctcacggtgagtgtgggcagcagcccctctgcctcccactccccactgcgtggattcttgtaagtttctctttctggttgacatcaactgtgtaagcaaggaagtatgagtgcttttctcaccagagctgaggcactgtactctgtgaagctttgaacaaatatggtccctctgtctccattcccaggaggaggaggggcgggagcttggtgtggtctgaatggaagaccacaaacccataggagccccagccccagaggctgagttgcaggagctggtgagtcaggcagcgtgggtgactgtggaccgaccactcgtgtagagcatgctgggcatggggcggagccaacagcagcctcctcagtccccacctcacacccgggctggcccasagaggcaggcagtgtgctggggacacagggcatgcagaccaggcagggaacctatgatccggggggatatgcgcccctttagagctttcccagagattctatatggaagtttcccagcctcagcagcaaaagagagggcgacaccagctttgcagaacaactrcccagcccatttcaaatctgaacatccaggaaaaaattaattcagtgcagcaaggaccagacagctggtcagcatctgctgctcccagcccttccctgcccaggccagctttcccaagtggaccagttttaaagactccccctccaaacggtgccccttgtgtgtggcttgttttcctttcctacagctggttctgttgtcttctgatgcattgtcctggggcccctcccctttctgccatcctcctttggggagtatcatcaagacctaactccctctttcagaaatctcagctgaagataaggacaaataaaacacctacacccttgtttcctcttttaaccttcgccatgcatcgacctaacacaaagccatttaacctgacaattccattaagttgaatggaatcttagaggtcagattgtgtgtgttgtatggacatatgtatgcatgtatgtgtgcatgtgtgtatgcatgagcatgtctgtgtgggtgtatgcatgtgcgtgtgtgtgggtgtatgcatgtgcgtgtgtgtgactgtgtatgagtacatgggtgtatgtgtgtgtatgcgtgagcgcgtgtgtgtgtatggctacgtgtgtgtatgtatgtgtatgctgtgtgtgtgtgtatgagtacatgggtgtatgtgtgtgcatctgtgtatgtgtgagcacgtgtgtgagtgtgtgtatgagtacatagatgtatgtatatgtgtgtttgagtgtatgcatgtgcctgtgtgtatttgggtgtatgtgtgtgtgtgggtgtgtgtgtcagaaaggtaagtggtttgctcagtgttaccaataagtggcagaatcaagattcacaccttgtttttattttttctttttttttttgagacagagtctygctctgtcacccaggctggagtgcagtggtgcgatctcggctcactgcaagctccgcctcctcgattcatgccattctcctgcctcggcctccctagtagctgggactacaggcgcccgccaccacgcccggctaattttttgtattttagtagagacggggtttcaccgtgttaaccaggctggtctcgatctcctgacctcgtgatccgcccgcctcagcctcccaaagtgctgggattacaggcgtgggccaccatgcccggcctcttttttcttttcttttcttttttttttttgagatggagtctcgctctgtcaccaggctggagtgcagtggtgcgatctcggctcactgcagcctccgcctcccgggttcaagcgacacactctgtttttctaagttgaacattttatctttctttttcatcacatcacaataatagccaccatgggggaggcatttgccaggaatgtgtccccttttgcttaattttctatgcaattgaccaacaaggaccagagctccttatcctctctactcatctcgacttggtagctcaggacccatggagctgtgtcaaaccatctttggttccatttctgggccagcagtgcagagggattcaaccagaattcagagccacaaagtgccctgtggtcaaactgtcccagttacctgggtgggactctaggcaaggctccagtgggactctaatgggctctaggcaaggcctttgagcctgatgcatccatcgaagcaggccacatgtcaccttccttccctccccctccttccccacccccaccccactcactgcaggcacctggctcatctgtcgtgggcgaggttgacacacctgagggcattcacctgggcatatcccccgtcccccagacacacacagaggcacatatgcgcagccatggacgtggcaagatcctgtgacacgtactcaaaggcctgtgatgaagagatgccaatcttctggtctggtgagagccagtggggataatggtcttctcctggcactcctctttccccaggattactgcggcagtaaccctgggacctttcggatcctagtggggaataagggmtgcagccacccctcagtgaaatgcaagaaacrggtcaccatcctggtggagggaggagagattgagctgtttgacggggaggtaagtgcagcctcatctccaccctcatgtcccgctttgtgcttctgccacttaataggaacattttccaagcattcatttagagctcgtgtgaatggaataacgcacagccattaaagaggatgaggcagagctattgcaactgaccgtgacgtattattttatgagaagaacaagtggcagaacaatagggatgacacaatcccattttagcgacagtgcagagtgtgtgtgaaggatgtgcacatgtgtctgcacaaacgtgggaagaaccagtgctcacctctagagtagggtggggactggagggtagccgggtttctttgtgtgtgtgtgtgtgtatgaagtgatgatgttatgggatatgtttcatatgtttttctgttcttttcagataaatactttatttttttgagatggagtctygctcttttgccyaggctggagtgtagtggtgtgatctctctgctcactgcaacctccayctctagggttcaarcgattctcctgcatcagcctccttagtagctgggactacaggtgtacaccaccgtgcccggctaatttcttgtatttttagtagagataggatttcgccatgttggccaggctggtctygaactccagaccccaggtgatctacctgccttggcctcccaaagtgctgagattacaggcatgagccaccatgcctggccagaaaggagctcaaaagaggagtaaactaattcagtcccctgtgtactaagaacttaaaaagtagttctcataagtgtacacaagactcccttaggagatcttgtttaaaatgtggctcctrgaactccatgctgagattctgactcagtaggtctgggtggggcccaggaaccygtgtttaaagttgcaggtcatccccaggccacagttttggatcckctgctttgactatgtggagtgctgtggagacccaggctctgggcacaaacttgtcctggtatcttcattttctcccatggcctcagcctgcagctctgccttcttccaaatacccaccattgacagcaggggatgggaggtgaattcttcaccattatggaagaaaactgcttagcaagcataaygtattaactgygagtcagcagtgtcaactscatttcaaagaacagctctatttagggcagagtggcggtgatgatgctgaacaggaggtgtgcagacatgtgagggatagatttgcacatgtgattagctctgcactgcmtgtgatatgttactaatgagaggacctctgcaaagggatgatggcagttctcagcctcagcctcagtctgatgaattggagagtccgccacacatgctgaaatggkcctccagggtacagcactggcagggattgggctaagtcagaggctcaggtcagagcccttcttgaacctgcagtgtgtgattcccagcactagcactgagcacctcagtttccttttycttcagctctgtctcctgatgacagtggctctggggagggggaggtggtgggatacaagaaaggtgagagtctactgcttatttttatagaggaatagatttttaaacaatcaactagagatgcttaaaatcattgccatgttgaaaacctatctaggagaccactatatttaatgactaattgtcaataaaatacctgctcattggtttcatagtactttaatttcataatcatgattttgctgctacctctgttaccgtctcttggtcatggatgcctggagagtggtggtggtgagatggtcacagacatgtcctggcgtggggctggccctgcaggggtgcagtggcaggtggggtcctggaggggtggcagtgcctgcactcgtgggcactgaagacagatgggcaggtgtagagtggagggaggatctggctgtcgagcctgcccttcatcctcctggatttcttgctttgtcttcctccaggtgaatgtgaagaggcccatgaaggatgagactcactttgaggtggtggagtctggccgrtacatcattctgctgctgggcaaagccctctccgtggtctgggaccgccacctgagcatctccgtggtcctgaagcagacataccaggtcagtggctttcttgcttcatcttgttggggacttggcctttggagtgttttctgctccctgatcgtaggtctctaaggacttgctttatgaatccrggtgctcctgtgttgggtgcatatatatttaggatagttagctcttcttgttgaattgatccctttaccattatgtaatggccttcttttgatctttgttggttcaaagactgttttatcagatactaggattgcaacccctgcttttttttttttgccttccatttgcttggtagaccttcctccctccctttattttgagcctatgtrtgtctctgcacgtgagatgggtctcctgaatacagcacactgatgggtcttgactctttatccaattggccagtctgtgccttttaattggggcatttagcccatttacatttaaggttaatattgtcatgtgtgaatttgatcctgtcattatgatgttcgctggttattttgcccattaattgataccgtttcttcgtagcatcgatggtctttacaatttggcatgtttttgcagtggctggtacyggttgtttctttccatgtttagtgcttccttcaggagctcttgtaaggcaggyctggtggtgacaaaatctctcagcatttgcttgtctgtaaaggattttatttctctttcacttatgaagcttagtttgggtggatatgaaattctaagttgaaaattcttttctttaagaatgttgaatattggtccccccctctcttctggcttgtagggtttctgccaagagatctgctattagtctgatgggcttccctttgtgagtaactcgacatttctctctggctgcccttaacactttttccttcatttcaacctggtaaatctgacaattatgtgtcttggggttgctcttcttgaggagtatctttgtggtgttctctgtatttcttgaatctgaatgacaatatcaacttttctttaggtttcttaacctacagcagcaaaccaatcatgcacaatattagtataacactgcagactattctagggtgttkccttatcattsagtcatgggccagcatgttttgagagctatttgtaaaattgctaataaccaacttttgagaacggttccactatttagggtccaacagtttgttggaacttgcatgatttctttaagtggcatgtatgtgacaagtggctctggctactctagccactggtttagtcaggcaggaatggcctccacagcatccctgataacaccatccattttcagcttgtacaagccagtgaggcagcactgccctcacttctctgtggcagcccatctcagtcccagaaagcattaacaattcattcattcatttattcaacaaatactgagttcctgtatgtgtcaaacrtggtcctaggcgctgtggatacagcaggggaaaaaagtttttttgtttaggggtgtgtgtgtgtgtgtgtgtgtgtgtgtgtgtgtatgtgtcttccatgtatttgtttttttattgctgctataacaaatcascaaaaacttgatagcttaaaacaacacatttattatcatatggttctagaggtyggaaagctaaaattggtgggcagggctgcattcatcttagaggctctgagagaggtcccttttcttgscttttttacattcyggaggctgcctgcattcttggcttgtggccccatcctccatattcaacgctggcaatgtagcatcttctactttttttctccttttctgcttctgtctgtcacagcaccttttgaactctgaccctcctgcctccctctgatcagaccctgtgatgacattcagcccacacagataatccaggttaaactcttcatcycatgggagccactgttttgccttccataatcctggtgcagattatatcctagcrggaatgttactatagatagtttgggctgatgagccctgtgragaggggatgtaagagcagaatctttggggaagggagggaatgagtcatgccagtatctaggsgagagagtttaggcagacggaacaagcacgtgccgaggccytaaggtggtaggtgtctgcagccgttgtacaaggaggtcagtgtggctrcagaggagggacttgggggtaatggtagttcacgagggcagggaggggcagtagccataccatgggggctactaggccatgggaagatcgttggccttttgcccaacagtgagaacattcttcctctatgtttcctggtgacttacaccccttgtaccaagcygaatgcagcttattgaagcaagatagaatacattttttctctttgtctcaacatcagggctctaagtatrttgtaaaagtatagcaccttttcttctccaggccaaatatttccagttttttctgtagtttttttgttttattattatttttagttgacatttaactgtatgtatttactggtgacagtgtgatatttcagtacatgtatacagtgtgtagtgatcaaatcasggtagttactatatctgttccctcaaacatttaccatttctttgtgttgggaacattcaaagtctgctcttccagctacttgaaaatatacaataaactgttgataattatagtcaccctgtggtgctaccgaacactagaacttatccctcctctttgtgtagttttcacttgtttctcactcattcgtaactactttttcagaacttgttgcatgttgcactccatgatgggtgaacatggagacaggtgagacatatcttcctgattacatttatgagagagcagaattctgcccagcctrctctgaacaggctgcacttctccaggcaaggggactcaccttcccagaggcaggcagttctataactttccctccttggacccctacacctccattggtggagcagtgtacctggctcctctctctgcttctatgcttgttggggacagtgatagttcccaccagtgatctcagggccaaggctgcctgattcccacctctgcccttggctgactatgtgacatgggcatgttgcctctctgtttccatagctttaaataaaatggggccagcaaggaagctcaggaatgggtcttggcaatggcaaggctttgctgctcacctcgggcctcctctgagtctctgtccygctcctcctcctcttcctcgaatgccctctgcctccattgccgccaggaatgttcccctttcccctgagccrgagagcatgctcctgggcttgacggtgctcatccctcaacttgtctctcaaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtacgtctgggtctctgtgtggacagagccctagagcttgcttcctggaatgtccctctgtccccattgtcatgggggctggaaggggggttgtgggtggtatgacctccaggtggctgcagggtgggaaggagggtctcttggatccttctgggctgaataaccccagtttgaccagctgacggctggcctatctcttgcctggttcccaggtgcctctggactcatcccctgccacctgccataacaacatcatgaagcakacgatggtggattcctccygtagaatccttaccagtgacgtcttccaggactgcaacaagctggtgaggaccttgagggtagtgggaagcagacggtcccaaggcttggcctggtggtatggacacagagtgtgaccttctaacgtggacactaccctcgtgtcttgacatgatctgcaccaagacaccacttcggctttttttcttggctttcaatctgggaaacaaaaagtaaaatcaacagtttctaggggaagcaatgcctggcaaaacatttccttctgcatgagaagtaactccccttggcatgtgccaaygcttctctttcagccccagtcttaggatttgttctcttattgaagtatcttgttttcaacaccagagccagagatttccttttcctgtcactgctgcatttgtccagaccaaaagaccttcctctcccacccccyaaaaccccttggtgcccatttcttgtctcacagaaattcttttctggccttaattttggtgattttgagtcctcgtattatgacttatttktgtgtcttcatctctaatgacaaggaggaattccscaaggttaagtgcagttgtctctctcttttttttttttttttgagacagagtctcgctctgtcacccaggctggagtgcaatggcatgatcttggcttagtgcagcctctgcctcctgggytcaagcgattctcctgcctcaacctcccgagtasctgggattacaggcacctgccaccacgcccagctaatttttgtatttttagtagagwcaaggtttcaccatgttggtcaggctggccttgaactcctgactcaggtgatctacccacctcggcctcccaaagtgctgggattacaggtgtgagccaccatgcccgaccatagtgcagttgtctcttatctgctgcatgtatgtgtgtacacacatgtggacatgggcttgtacatggacatatgtgactacagaagtctgtgtacacacacagccatgcacacatacatgctgctgtgtaacaccaccaatgtgggagagactggttgaaaacatggatctcaattctctttctatctatgcagtgattttcggtctctgaggactccaaaggatacttacattccctggtttggtggaaatcctgggcatctgagttggaagagtgaggacaggggaggagttggggacattgagactgttggaacgtcttggaaacaatgacccactcagtgtctgaattcattttctgtcataactgccctgaaaaagtccagtgtgtttagaggcgtgttttggggatgaggaagggttggaactggttgaactggatttggaatcagagtctaggccctattgtcctgcatacctgccccatagcactgcagtgaggcagctgcagggcctgatgtatttccccattctctttgctgaattgaggcaaagaaagacagtgaccagcacatatgtgtgtttgtgtttttgtaaaagcacccacatgctcatgaggctaagagtgggttgtgaggacagatgggtggctgagcagggaggtaggcagagggacagagggaatgttcttctggaaaatcctcaggctcattgtgttctgcagaaggccagcagcactgcattattcaactcttcttgctggaatgcagattagaaactaagaatcttgccttcccactcattccctctttgagaccattgagctrcatttctccttctacctggacccccttatccttaaattgaccatcagaacatttgcacccagactaagagccagagttcctgacacctggccataggcctgggccacctgaggctgcctttgcaggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgccrtgagtactgacrccctcatgttctcagatgccctcccttcttcccatgtgtctatgcttgaagaccttgtgagtgcagggggatatcttcatgggcgagagaagacagagtgttagtagggactggatggccaagggctaaggagggttaagacattggctgtgtaagaagtttatattacgggtgaggtgggacatggattcaaggcatgaacatgtggagacttttcttctggagagattctggcaggggagaagagggaatactgatgaaaagaaggaagtcgatttatgtctttaattaggcgtgattatatttgccaatatgagtgatcaactcatacattcatgtctatagaatcttgcttctttggacagaagcaacttaatgtttttatgtagaaaactgggccrggcacagtgactcayacctgtaatmcctgtgttttgggaggctgaggccagaggattccttgagcccaggagttcaagaccagcctgggcaacatagcaagaccccatctgtacaaaaattaaaaaaagaaatgaattcagaaccaatagattctggtttaggtgcttcaacaatccagaagtctctaatattggtgacgcccatagtcccctagttccccaacattatctccagatgsygcaggccatcaccacatgggtctgcagtcctggaggctttgcctgttgtggccacagccttgtctcctgtctacacagcccagagctkcgaggagaggaatctccgggagaacgggtatgagtgtgagtggcgctataacagcygtgcacctgcctgtcaagtcaygtgtcagcaccctgagccactggcctgccctgtgcagtgtgtggagggctgccatgcccactgccctccaggtgaggcctctatccctgggggtcaggctggtgggatgggatagggatggatggaaaggtgcttctaggtcttgcttcatctcagcctccacctgccacgtcctatctctgacctgcaaggctgctgcaggttccgtgggttctttcatcagagtcaggacagtcgtgatttttctcaagtcgagctcctccaaaatgcttttctgtgcctatttrtggsattctcayctaaagcagcccctgccgatagaactttctgcagtgggggaatgttgtattgaatgtaactgtgacgagtgtgtctgaggaactgaagttttgaattttattgaattttacttaatttaacgtaaatagccacacgcagtttgtgacgatcctatggtacagcacagctctagagttactgaaggtgttattcagaagagcagaaagagccccggagataagatttcatttgtcctgaggcttggggaggtgaggtagggtgaaggaatccccgctcccagttttgcagagggatcaatcaaggcacaagcaggagagatgctccttgagtgatggggtgacccctgggagtgcaggcaggaggagttggcttctagggcaggaggaggagttggctcctcccttttagttaaaaatgaggcttcctcgtgggaaaggggagcgttttggttcctaatgagagctttcttttgcagggaaaatcctggatgagctkttgcagacctgcgttgaccctgaagactgtccagtgtgtgaggtggctggccggcrttttgcctcaggaaagaaagtcaccttgaatcccagtgaccctgagcactgccagatttggtaaaacagattcctgggttgtttgaagtgatgaatcttattgcttctccaggggccagcttagagactaggttttgggtaaaaagtcctagccacatgagttgagagactgagtttattttatttgtttatttatttaattcattatttaatgtagtttattgttttgtttgttcctagggtttgcttctttttctttagggatggactagactgcttcctccacatatattcctccacagtgtttttgctcttaataggtttttaagtcctaacaggtttttgcttttctcactgaaggtgggggtatggtcacttattgtccttgtaggtcatgactagtctgagcacaggtgtccatatactggaggtggggactcaggagaggaaagtgagatggaacccagggccctcaggtaacatgaacgtcgtgggggccatagtcaaggtggcagggtgtggctgtcataatggggagggaaggtgctcgttgctctcaccctggcttctcactggacttgcctctgggaaactggcctttggggaggtgagaaggagtcctcagggtgagctctgagccctctgaagtcctgctcataagtagggagcatttattaaaatccagatctattcaacaccactccctgacactaatcaagccttctgggagcttaaacttgagaacgtaaattcgctggggaggggctatggtcacagctgctagagtcagatcctgccgccaccatctgtacaaacaagaatgaacactgcctggggtgagttttctagcaaacacaggaaactagaaagtatgtcactcatgcactgttaaccaaggattgaagcaataaatcttgtggatcacgggaaggaggaattaacttcctagtaagactctacctgcgcacactctttatgctgaaacagagactgtagggagcaaaggactgggtgattctgatgctggcttggggttctgtgccaaaagggcatgagagcttcgagccctctccccacctcctttgctggcacacgggcaggggcagctgccacggtgcacgctgaagctgcaagcagtgtgtggacagaagtcccacagcaggctggtggcatcacctggtatcaagccrcagggggacacttcccaggctcagggcgctgccgccttgtcagctttactgggagtgctgaaggccaggtgcctccaaggctgagagtccaaagaggagatggtcctggcccatattggtctccaccacacggycacttgatttcacctgtgggctggcaggccgtgccactttccgggacactggcaaaaaggtgatgttaccagcagagcctggaaatttggcatggtagtgtaggaatttgtgtgtggggggccactgctctactacagacttgtggtgtgtgcttggggctgggcacagagcctggccagtacctggcacatgagaggtgctcaccctatgtctgctggaggaatgagtgaatgtcttttcctakgcctgacaccgtggagacccctgtctgctactcccaaataatttgttctgctagataaagctggggttttgaatctttattcatctttctacaatgtttttgctccaattttttctctcttcgttagggcccaacatatcaaacatgttttaaaactcatgcaatttacattctgttagaatatgtactgtaaagcatttatcttcaacagaacatgtacaaacacaggttagcgtctacattttagtaacatttgttcttggagacacttgtaagaaggcttggattataaytaagtattcatgttgctaaagatgtaggttgaaaagaaatcagctttgagtggttgtgtggatggcctagaacaacgagtatattttttcatatcctaggatgggctaaagctttggtttctagaatcaaaggaagtcggctatgtgtgtgttttgaaggtggggggcatgctatttggggacagatgttaaacaatgacatctcacttggatgtggaatggtccatgggatctcaagttcaggtggaacagaggagattctgtgggaatatggaagtcrttgtacactgtagggctcagaagtgtccacaggttcttcctgaaccattttaatttcttcgctcttttctgcagccactgtgatgttgtcaacctcacctgtgaagcctgccaggagccgggaggcctggtggtgcctcccacagatgccccggtgagccccaccactctgtatgtggaggacatctcggaaccrcygttgsacgatttctacbgcagcaggctacyggacctgrtcttcctgckggatggctyctccaggctgtccgaggctgagtttgaagtgcygaaggcctttgtggtggacatgatggagydgctgyvcrtctycyagaagtgsbwcygcrtggccgtggtggagtaccacgacrsctcccacgcctacatcgggctcaaggaccggaagcgacyrtsagagctgyngcgcattgccagcyaggtgaagtatgcgggcagccaggtggcctccaccagcraggtcttgaaatacacactgttccaaatcwtcagcaagatcgacydccctgaagcctccygcatcrccctgcycctgatggccagccaggagccccaacggatgtcccggaactttgtccgctacgtccagggcctgaagaagaagaaggtcattgtgatcccggtgggcattgggccccatgccaasctcaagcagwtccgcctcatcgagaagcaggcccctgagaacaagrccttcgtgctgagcagtgtggatgagctggagcagcaaagggacgagatcgttagctacctctrtgaccttgcccctgaagcccctcctcctactctgccccccsacatggcacaagtcactgtgggcccggggctcttgggggtttcgaccctggggcccaagaggaactccatggttctggatgtggmgttcgtcctggaasratyggacaaaattggtgaagccgactkcaacaggagcraggagttcatggaggaggtgattcagcggatggatgtgggccaggacagcatccacgtcacggtgcygcagtastyctacatggtgacygtggagtaccccttcagcgaggcmcrgtccaaaggggacatccygcagcggktgcgagagatccgctaccagggcggcaacaggaccaacactrggcyggccctgcggtrcctctctgaccacagcttcttggtcagccagggtgacbrggagcaggcgcccaacctgktctacatggwcaccrgaaatcctgccyctgatgagatcaagaggctgcctggagacatccaggtggtgcmcaytrgagwgggccctaatgccaacgtgcagragcyggagaggattggctggcccaatgccyctatcctcatccaggactttgagacgmtccccygagaggctcctgacctggtgctgcagaggtgctgctccggagaggggctgcagatccccaccctctcccctgcacctggtatgctggcaccttgtgtgcaggtgggagggctgggcgagggctggcatggccttggtgctacatgcatctgccaagatacgactcgggttctaatcctggcttccctggtctgtgtggccttggttgaaacttgccttcaaagggcctgtgtttcctcacctccctggcagggagacaaactgtgatcctttttcgggggaagatcttttcttattgtgtgtgcttctataaattcaaaggtaatggaagcctattgttaacatttaaacaatgccaataaggagtaaaaaaaaaaaaaaaatgcaagtcttactttatcacacagcctcttccccacccaattccaccctctgccttcaaggtaacctctgttaaaggtggtgatgataagcttcattttgaccacactgggtgggtgaaattattccgagtagctgacattcttcagggcaagaccaggatgtcaggtgtcaggtagcaggtgcagtcttcagacactggagtcagactgccttagtttgaatcttatctctgctacttgctagctgggtaattttgggcaaatacttaacctctttgtatatcgtctatacaaaggatraggcaaatacttaacctctttgtatatcatctatacaaaggatacacatctttgtgtatcctcatctataaaatggggataataatagcacctacttgcttaaaatagtatctggcacatgacaagtgctcaaaaaaaaatgcttgctcccactgctgttactactaccttttactgacactggcgtctaatccattcctagttcctgaacatctttattcggtgtgtttgggaccatcccagaataataagccttcttttagtatcttttgagtcacacacttgtcagtacttttgtttctttgtttttgtttttattcacggccatagatttatttaaattcttgtaatatttctgctgaggaaaacaacaattacatcatttcatcaaatctcagatgtgctcagacactaacaggagcactaggcatttatagctggaagaatcacagtatgttcacctgccctgcaagatctgaggacacagcagctcattgtccagggaggggctgccgctccatttccttttgcagtctccttgtattgccaggccagtattttactcatttctagaagaatggtggccccttcttaccgaggaagcctatgcctgctgcttttatttgtagacatttaaacttcctttgggtagaattggagtcttctcagtgtctctaaatctgaggtagtccggacccaggaactccatctccccatcccctcctccctggcccacattgcccttgtactcacgaaggcaccccccgccccccttggtggtgccacgtggtcagcacgccctgcagatcctattggatgtcaggttgtaggcctggtggccattgtccctgctggcacctgtgtgctcaccttcctggttgtctttgcagactgcagccagcccctggacgtgatccttctcctggatggctcctccagtttcccagcttcttattttgatgaaatgaagagtttcgccaaggctttcatttcaaaagccaatataggtgggtgagcgaggcacctgaagcagcaggtgacgaagaggctctttttgtggctctacttgattcaaaataatccgcattttctcgttccgtttagggcctcgtctcactcaggtgwcagtgctgcagtatggaagcatcaccaccattgacgtgccatggaacgtggtcccggagaaagcccatttgctgagccttgtggacgtcatgcagcgggagggaggccccagccaaatcggtaacgttggtgccacaggctggatgcagaagctgcattctggttcttatttttggcataagtgactgtgtgacctcggccagtcactttgctccttggccttagtttcttctcctggaaagtgaggggctagatgctcttccacgtctctccagatctcaactgggtgttccttggagtttctgaatcattcagcttttaagtgacttaaggatccaccgttaagacagggtgtcgagccgcagtcagtactgacttggcgtgatctgttctccatcctcaggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagtaagaatctggtgtacagtcctcaattcaggagagcgagacttcagaaatgatagaggattaaaagtgggctggggttacttttggatgttgtggctgatattaaatatgctcaataccaacctctgtcctggtttcaaacagcaggaaattatccaaccacgatgtgattaggaaaccaaacaataaaaagtgtgtrttgatcctatatctttataactaattataatctttaatttctccacattttccctttgtgtccaggagtgatcatacctctatgccctttctttctaaagtaggattcgtggtctcttactaaaatgtcatgtctgaggccagagtgattcattgtagggccttgagaaccaatgggggctttcatgtatttagagtcctttcctggtaccaggtaatgggcttggcagggttgatggatgagagacaaaggatcatgctgtaggaaagggaaggatccagatgtccagccttgtgctccataagaacatgtgcttatcatgttcttaatatcaacaggatgtgagctgggacaggtggtagagtctagggaccacctcccagctgaagraggtctgggtgagtggagtgacattgagtcccctcgtggccacctggagaactgttcatctttcagaaccctgcctaggagtgctgtcagaaccctgtcttttctctgctgtcttcctgatgttcttcctgaggaagttatttgctccgttctctatgtcacatatgagctactmaaaatgtgcaaatcgtattgtattgtattgtatttgtaacatatctattccttgcaaaaaactgggagttctttgaaggcaagggaagatcttgcttatttttgtatcatctgtgtatgatgcacaaaataggtgaccatttaaygtttgttgagtgaatgaatgtgacatgtttatgaaatctatgattttagggtaaaggacactaaaagggaaaggatatatatttggataatataacgaacttacaagagctgaaaagctgctaatagaaaatccgttccaacctgaagcacattgcaaattcctagaactttctggagagctgaattgaggaatttcaggatggagattttttcyccttcagtatcaagaatccaaagaaagattttcactgggaaagaaagcagttgtggtcttgaagcagatatgatccagagcaagtcatttaaccgtccaaagcctcggtttctcatgtgtaaatgagcatgcacattctctgggctcagccctgtgatattttctcttctcttcttacatatacccccttggtggtctagttcagtgtcatgggtctaaatacatttatacatctttgactttgaaattcgtatctccagcctcacctcaactcagtttgcatgctctaataggcaaaactaaactcctgattttcacatctgtctttcttatcttagaaaatggcaattccaaccttccagttgttcagttcaaaaagctcagcatccttgattcttcttccttttccctgatacctccatgcaagccacgaacaaactatagctccatcttcaaaatacttcgagagtcacacctccccacaccatgtccactagggtcacctcaatccgagtccccatcatctctcacctggactattgaaatagctgtctaactggaaccccagcttccacctttgtcccctgcagatcattctcagcacagcagctgcagtggccctttaatatcaaaatcagctcctgtccctctgctctgtagtcttggctggctttgtttcattcacagaacatggtgagcccttactgtggccaatggagcattgcctgatccatgccctttccctctcttgcttgtccctctctccccagcccccgggagcatgcagtcacatttctgctctggggcctttgcactcactcttctctctgcttgggatgtccctccctcagacatcctcttggctccttccatccttacatcaggtttctgctcagatgccatcttttcaccaaatgcttctccaactgccatatatgcaacgataacccacacctcagccctgggcattctcatcccccttatctcattttgtttttttcctaagcatttatccacatctgaaattctatatatttactttgtttgtgtgtttgttgtctatctctccatgaggacgggggacagggagggactttatgtgcttggttcactgctgtacccctattgcttacaatagtacctgacacagagtagcagctcattaatatctgttgactgaacatcttcctcatagggctgatgtatgtgaccagcctggaaaacatgaggctgtattcagatgctggatataacgtcaggccagtccattttgagccttcttgcccacagatcctttcttgtctctttgctaactctaggagtgacagtgttccctattggaattggagatcgctacgatgcagcccagctacggatcttggcaggcccagcaggcgactccaacgtggtgaagctccagygaatcgaagacctccctaccatggtcaccttgggcaattccttcctccacaaactgtgctctggtgagtcttataatacctttcttacttccctcaaaaaaaagttccaaaataaacccgccaaagaaacaaaaatagtattcaagagaccccagggtgcccatgcataagatttggccttgaatgaagattattatatagaccaggacctttaagtttctgttcatgggaggtgtataccacaagcccccatggggccagcagaaagctttctgtgtatggtcctatttccactctaattgtccatgtgaacttggcagagagagcctaagcttatttgtgtagagggatcttggacaaaagaatcagaagacataagcaaggaaccccagcgttccgtaggtatagtcttcttccccatgggcctagactaactctcaacatgggtataaagggctttagaaatacgataacacggagactcatatcaaagtaccatagtttaagttgattttaggttagaaacttaaaaaatatgcttttggccaggtgcagtggctcacgtctgtaatcccagcactttgggaggccgaggcgggcggatcaygaggtcaggagatcgagaccatcttggctaacacagtgaaaccctgtctctactaaaaatacaaaaaattagccrggcgtggtggcgggcacctgtagtaccagctacttgggaggctgaggcaggagaatggtgtgaacccgggaggcagagcttgcagtgagccgagatcgcgccactgtactccagcctgggcaacagagtgagactccatctcaaaaaaaaaaaaaawayacacacacacacacacacacgctttttttgtggcgggggcctgggtttgtatattttcccgttactagatgtaagtcaaaacctgcataaagctactgtccttcgggggaataagtcaatgcaagtttgcccttaaagggcaataactctatgcaagttttgacttatagctaataacattagctgtacagagagatggcagctctcctggtaggaatcttcaagtagatctctttcaggtttccaggatcttgcttcatctccccaccttccccatccctggcgtgatctacatgtgaaccaagataatgacagcgtaagctgtagttattgccatattatcgctgttgttggcatcataattattaataactgcagagcatgtctgaagaaccacaggatgaccacctcagcctcatgtccctatgtctccactgttaaccttgttcagattcttttcagagttgagttgacttcaaaaactagaccaggttgcttaagcagacattgtgaatggttcagaatttctgggtgaaagatgggaactaaggtcttatttgtgtctgttgcaggatttgttaggatttgcatggatgaggatgggaatgagaagagggtaagttcctttctgttgactttgaaagaaaggttagagatgtgtttggggctcttgttcccactggttaatttttcctcctttggtcttagtccagtgcttccttttactattatcttgtttttgcgggtccatctgtacatcttgtgttttgcttcctgtctcatgtacaggrggcctccttgctgtgtaggcctgtgttcaattctaggggtcagttgtctggcagatgggcttagagttggagtacctcatcttattccctgcctgaatctgctgttttcttctgcagcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgagtcctttgcttctccagccagggcagcgtcaaaggggcagtgcttttagcttggctgtgcagaaaagtagagcaggcacccaccagcccagaagtaccctttccctcatcaccacatgcacagtgctaccttcactcaccttcctttcctcctgtgctctttggacatgcatgcagccagtctcagggatcactgccctctttctctgtctttggaaggcacttccccagattatgcataactggaaggaagaattgcttttctgaggtcaatgctcagcttggctgttggcaagtcaacctttaggaatctgtgtattcagggtatagcagtggaagtatagcagtragagagacgcttccagaaaactctccaaccacacctatagcaacagtacatcaccaaggcggcctggattaagaggaggaaatatttaaagtccatctcatgtacacttgtggagagcatgtcatccatgggctgggttagccttctgtctcatgtttgggagcaatgactgcttatggtgaccatgactcagcagtggattgtaacctttatgctgaacaggcataactggtgggatgcaatcaaaactgtatttatagctcattccccctttagaatttatttagtgagataaatttccctcttggtctaggtgaaaactccaccagactttaggtttcttctgtttattcataaagaattctatagttactttgtcagaagacaaagtctcagttgataactagatacccactcttgcgtaataatcaaaactttgaatttgattagagttaaaacacctcccagttccaatttaggctgcctgcctctgggaaggagggtatggtcagctttcctctgtacaaagagctttgccttttgtgattaaaagcatatcctggaaattactcgatgtcatttcaaagagagcttcctaatacttcactgtgtaccataggttacccaactgttcttctatggatgtgcgtttaggctgtttccagtgttttgtaatgacaagcaatgctgcaatgagtaaacctgaacatacgaacgaattttcatatggttggaggtgtgtcttcagggtagattcctagaagtgagattcttgggtcaaaagataagtgcatatgaagttccccttagacattcccagattctcctctaacaggtgagatgtggttgtgcaaaactggaatgtccatcagtttggttttcgatcagcgaggtatgagagtgcawgcwtctccacggccttgctgagtgtgttgttacagtttttatttattttttttgcaaatttcttacttttcaggaaagaaatagtatctsagtgtacttgaaattcatttctctaatgatgagtgaggktaaacattttatcatatgtttaattgccattttttggtctaattttrtgaattttctgctcatgccttkccccatttkcccattagaaragttgtgataaraaacacatgagatctaccctattaataaattttccagtgtacaataccatattgttagctatttgcaagttgttgtacagcagatctctagaagtttttgttttgtgtgrctgaaactatgcccactgaacagcaacttcccattttccccttcccctagcccccgcaaccaccattctgctttttgcttctatgaatttgacgattttagatacctcctgtaagtggattcatgcagtagttatccttctgtgactggctcatttcacttagcttaacatcctccaagttcatctatgttgtggcatatgaaaggatttccttctttctaaagactgaatagtattccattgcatgtatataccacattttctttatccatttgtccactgatgtgcatttggattrtttctaactcttggctattgtgaataatgttgcagtgaaygtggaagtgtataagtayctttttgagatcctgatttcaatgcttttggatgaatacccagaagtgggattrckgggtcatatgctaatactagttttaattttttgaggaaccttcttactgttttctgtagtcgcgacaccactttacattcctaccatcaatgcacaagggtttcartttcttcacattcttgttaacacktggtatttcctggtgtgtgtgtgtgtgtgtgtgtgtgtgtgtgtttgataatggccattctagcacgtatgaggtratacctcattatggttttgatttgcatttccctgatgatcagtaatgttggatattttttcatataattgagtttttggatgtctctttggaggaatgtcttttcaagtcctttgctcatttttaaattgggttatttgcattttttttttttttgctattgagttgtatgagttcctaatatattttggatattaaccctttatcaaatgtayggtttgcaaatattttcttccattctgtaggctgcctttttattctgttgattgtttctttggctgcacagaagctttttggtttgmtgtagtcccacttgtctatttttgcttttgttgccttgtttttggcaatgatatccaagaaatcgtcgccaagaccaatgttgcaaagttcttgtgttttcttttaggagttttataatttcaggttttacgtatcagtgtttaagtttgattttgggttaactttgtgtatgatataaggtaagggtccaatttcattctttttcatgtggacaggttcattgttagtgtattgaaacaaatggttttgtatgttgattttgtattctgcaactgaatttgttttaacttcgctgaatttgctaacaaatttttggtgaaatctttagagttttctatgcatatgatcatgtcatctgcaaatggagataattttacttcttttttgatttgggtgatgttcatatcttcttgattcattgctctagctaagacttctcgtactatgttgaatagaagtggtgagagtgggcatcyttgccgtcttcctgattagaggaaaagcttttagttttgcactattcggtgtgatgttagctgtggtattttcattaatggcctttattttgttgaggtaattttcttctattcttagtttgttgaatgttttaatcatgaaatggtgtttgaattatgacaaatgctttatctgtatctgttgacatgatagtatgatttttatcctttgttctgttaatgctatgtatcacctttattgatttttagacgttgagccattctcctatctgagggataaatcccactccgtcagagtgtattatcctttgattgtgctgtttaattcagtttgctgtcattttgttgagaatttttgcatctgtgttcatcaggaatattgacttgtagtttttttttaatgtaaagtctttgactttggtatcagggtaattctggcttcataaagtaggtttcccacttcagtgttttggaagagtgtgagaaagattggcattaattcttctttaaatctttggtagaattatccagtgaaagcatctgagctcttatttattgagagattatgattaytaatttcatctccttactaatgatggggctgttcagattttctgtttattcatcattcaggcttggtaggttgtatgtttcagggatttattcatttctttaggttatccaatttgttagtgtgtagttgttcatagtagtctcttactaacctttttatttctgcgctatcaattgtaatgtaagctcttctatttctgattttatttatttgagtcttctctttttgtcttggttaatctagctaaagctttgttaattttgttgacctttaaaaaaccaattctaagttttattgatattttgtattctatatttcatttatttttcctcaaatctttattatttccttccttctgctaacttacggcttagtttattcattttctagttcttacattgtaaaattaggttatttgtttgagatctttcttactgtagacatttactgctrtaaactttccttttattgcttttgctgtttcccataagctttgctatgttgtgctttagtttttgtttttctcaaaatattttctgatttttcttttgatttcttctttgactcattggttgttcaagagtgttttttaatttccacatatttgagaactttctgaaattatttctcttagcaatgtctcattttattctgttgtcagaaaagatacttggtatgattttagcctccttaaatttgttaagatttgtttcgtgggctagcatgtgagctattctggagactgttctatgtgtgtttgagaagaatgtataatttgctgttgttgggtagaatgttctgtatttgtttgataggtccacttgggccatagtgttgtttgagttctctgtttccttattgatcttctatctggattttttatccattattgaaagtgagatattaaaatctctcactattatgttgttctatatttatcatcacttctgtcaatatttgcttcttatatttgtgtgctttaatgttgggtgcaatgtacttatatcttcctggtgaattgatgcatttatcactatataatgtccgtttttttgtctcttgtgaccatctttgacttgaagtttaatttctctaagtatggctacctgtgctgtcttttagttaacattggcatgaaatatctttttccatcttctcactttaaacctatgtgcattcttaaatctaaagtgagtctctctcttgtagacagcacatagttggatcttgttttatattttatttatttatttacttaatttatttagatggagtcttgctctgttgcccaggctggagtgcaatggctcgatctcggctcactgcaacctctgcctcccgggttcaagtgattctcctccctcagcctcctaagtagctggaactacaagcacgtgccaccatgcctggctaattttttgtatttttagtagagacggggtttcaccatgttagccaggatggtctcgatctcctgatctctcaygatctgcctacctcagcctcccaaagtgctgggatcacagacatgagccaccgcacctggctgttttattttatttttaaaaattcatttcagccacttcatagcttttgattggagagtttattctacttatacttaaagtaactatggatagggaaggacttactgttgccattttgtaattattttcagtcagtcttgtagcttttttgtccctcttttctactcttactgcccttctttgtgtttcattgatttttttgggtaatgatgagatttgactccttcctcatttccttttgtgtatcttctatagatattttctttgtggttaccatgaagcttacataaaacagcctatacttataacagtctattctaagcttataacaacttaatttcaattgctcacgaaaactctactcttttactgcctctcccccactttayattattgatgtcacaaattatattttttaatgttgtgtattcattaactgatttttatagtgatagttatttttataagtttgtcttttaagtactataccagaattcaaagatttacacattgtcattatagtattaaaatattctatatttgtttatatatttacctttaccaggaattttacctttcatatgttttcatgttgctgcctagcattcttttatttcaacatgatggactccctttagcatttcttataaggcaggtatagtggtgatgaactctttcagcttttgtgcacatgagaaagtctttatttcccctctatttttgaaagacagttttgctagacagagtattcttggctgcccgttgttttcttttgaatagatcatccatctcccttctggcctgcaaggtttctgctgagaaatttgttgatagtctcattgtggcccccttttatatgaaaagttgcttttctcttgctgctttcaaaattctgtttttgtctttgacttttgacaaattgattataatatatgttgtagcggacttctttaaattcattctagttggagtcttttgggcttcttgaagctggatgtctattttcttccctaaatttrttcattatttctactttccattgggttttaatcttattcgttattttaaatatttgaactattagctcattatctgtgatataggttgcagtactatttattgacatgttaatatttgccccagtggtgtgagataagaataataatcataaaccaaattttcatatgtgcatgggcttatttctgaactttttttctgattccacttgttgtaagctattcatataccaaaaccacattgtcttaattaccacactgtcttaattaagaggaaatacctctaatattttgtcattaaaggctttatggtatgttttattgtctggtagcactagtacctccacatagctttattctaaaktgttttcctggctattcttttatgtttgttttttctgtatagactttagtgtcaacttgtttacctccataaaaagtttgttggtatttttattggaattgcattaaatttatacattaactttgggagaactggcatttttatgatgttaaatcatcctatccaagaacaagtttgtccacttattcaagctgacttgtctgtcttctagaagtgttttcaggtttattcatttgggttttgcatatttcttgctaagtttattccaagtattgaatcttccttgttgcaattgtaaatgagacttttttcttctccattatgttctttaactacttattatttgtgtatataaagggtattgatatcaatatatataacatctatatatctatatataacctatatatatctgtatatgttaattccatatcctatagctttactgaattcttttattattgagttagttttatcatggattctctagggttttctgggtatgatggtttgtcatttgcaaatagaattgtttttcttttttgtcaatttttgtgcctccaattaatttctcttgtataattccattaataaactttttagtacaatgttgaatagcagtggagtatcttgcacacacacacacgcacacacacacgtgcacacacatatcatgtattttatattatgaaagtatccctcaattctcatttttgagtgtttttttgtcaagagtgattgtggaattttggtgttggtgaaggctttttcagcatctatggagataatctcttgattttttttctttaaatatattgatatggtatattatttgaagraatttcctaatgttgatcccacttggctatgctttgttattttcataatgtggtgttggattctgtttggtaatattttatttagtacgttggttttgacattcataagtatttttggtcagcaattttaacactacttatttaaattttcagtaatatacatataacataaaatttatccttttaactatttttaagtatatatccagtgacattatcatgaatgaggtcaggagattgagaccagcctggctaacacacggtgaaaccccgtctctactaaaaatacaaaaaattagccgggcgtggtggcgggcgcctgtagttccagttactcgggaggctgaggcaggagaatggcgtgaacccgggaggtggagcttgtagtgagccgagatcttgccactgcactccagcctgggcaacagagcgagactccgtctcaaaaaaaaaaaaaaaaaaagagagagaaagaaaatccacattgttgtgcaaccatcaccaccatccattgccagaacttctttcatcttgtgaaactgaaatgctttattcattagacaatgataccccatttcccccttcctccagcccctggcaacaaccattttgctttctgtctctctgaatgagactactctaagcacctcttttgagtggaattatgcatttttcctattgcgactggcttattctgcttagcataatgtcttcaaggttcatccatgttgtcatcctttgtgtttggttgatttttttttttttgtagtgaaacattttaactcccgtttcctttcttttgtgtatattctataactattttctttatggttaccatggggattacatttaacatcctaaagttataatgctgtactttgaatttataccagctcaactttggtaacagacaaaactctgctcttatacagctctatccccacactctttcagttattgatgtcataaacattacatctttatacaytgtgtgttcaaaaacatagacgtatataaattttaatgcattagcctcttaaatcatgtagaaaacaaaaagtgaagtcacaaactaagattacaataatatccagaacttttttggttcctttttatgatttcaatttctttattgaaatttccattcggttcatacatcattttcttgattttgtctacatcttcttttagctctttgataatttttaagacagttgttttaaagtctttctttagtgagtctaccatctggtctttctcagggatagtttctgttgatttactacatgagacagattctgccaatgctattgttgtctaggtggggagacagatatttggtgcttcttactccaccatcttccccgtctcccaccctgtaggttttttgttttttttttgtggtgggggaatactgtcttgatctggtttagatattggtgttaaaactggtttcattaaaagctttaagaagttttctctccttttcagtactctggaacaatttatggagcatcggactatcaggtctttggaagtttaggaaaatttccttgtgaaatcatttggggttggtattttgttttttgtttcttttttttggtggagtaactttctttaattcctactaacttactctaattcttccatgtaaattggtgtgcttaagatttgtcttttatctacaggagttaattttgttaatctccattttcctagaaatttatccatttcatctagattttcacatttattgtatagaggtcttgaaagtagtcttttttttaaactaaaattttgtttattgtttgtatatactctagggtacaagtaaaattttcacagtaatcttttataatatcaaaaattctttttaaatagcgattttcttttgtcatttgttaatttatatacatgtytattatcttttttcttgatcaaattaactcatgatttgtctttctggayttttttaaaaatcaagatttcaatttatttattatgtttactgtttttatattctctactttatkgatttctgcttttatccttgctattttatgacttctttccttgaattttcttttagtttaccttttgtgcttttctatttaattggaactgggaatttcattcattttcattgttttatttttattgacagaaatgtttactgttatgaattttcctaggatcactttatatgtatcccaatgagtctgatatgtagtgtatttattatcattattttctaaagaaattctgtactatctgtttttattgtccctttcacccaggatttatatcataaattaaaaaaatttccaagtgtaaagatctttttaaacaataattaaaaaatttttaattttactatactctgacgagagtatctgtaatagttctactttgtggaagttaccgttattttcttcgtgatctaatacatgatcagtttttgtgaaggtgtattctctattatcagggtgtagagtatgagatccctcgctctcttcctgtcacccctccatgagaactacatattttgattttaatgtttgtcttctatagtcttacttaccttttccccattttatctatctggttctgaaagggatgtctaaaagtatcctgttattagtttgtctaccaatgtctccttgcttctcctatagtttttgctctatgaagatgttgtctggtgcatagatattcacagctgttatggcttcattgtgaattatactgttcagaatgctcttattagtcacatttaatcttttttttggctagaattttactttgtctgatatcaaaatctccatccctgttttcttattgtttgatatcctttgtctgtccctttactttagcctttctgaattttagttatatagcaatagttgggtcttgcctttgagccgaattgaaaacctttttgttttagtagacaagttaagcccattctcatttattgccatcttgtgtttgatcttctttcgtcattatattttataattgtttgttatatatttttcatttataaatgtggtgatacgttaaggtgtctaggaaggtttatgcttttgttcctgtcattacctttgaagttatacctttctaaaatgccttcaggcccatatttttaaatttaagcattcattaatcagtttttcagtttttaatagcattctttaacttctacctgtggctatccaacaatcaatgaggttattctaacttttcttgttccctcccctctcctcccattgtcgagttctattatttctactgtcacagcatataacatttgcacattagtcttccattcttcgttttagttttagatctatgactatataaataaaaatgctcactttagttgttttgttaacatttcctagtcatctcttagttggaggaaatgttctctagtagatttctttttttttttttttttttttttgagacagagtctcgctctgtggctcaggctggagtgcagaggcgcgatctcggctcactgcaagctccgcctcccrggttcacgccattctcctgcctcagcctcccgagtagctgggactacaggcgcccgccaccacgcctggctaatttttcgtatttttttttttgtagagacggggtttcaccgtgttagccgggatggtctccatcacctgacctcgtgatccgcctgcctcggcctcccaaagttctgggattccaggcgtgagccaccgcgcctgggtctctagtagatatcttaagaagggcttatgtgtacagaattccattaattcctatgtatttaaaactgtttttctatagcattgatgctagaagggcaccttggctgaatacagaattcttgattcacattttctttcactaaatttctgaaaaatgctgctccattgttgccttgctttgtatattgcttttgaaaattctgataccaatataattmttttgtccttgtaaattatttgatctttttgcctgaaggcctggaaaattttttctttatgtttgaagtctaatagtgtactgtaatatgtctcagagttgactgttttgggttaatttttccggacatctggcacatgactcccatacatagatttggttcttttttgatttccagaatgttttcatgagttatattctttaagtgttagttctgttccattgttttgttttctcttttaagagtccattttttctcctgtcttacattttcattactgtctctttgacctttatactttcttcattaactcattttcattctcttgattggtttttttttgcttttctctgatgctctttattaaattyttattttgatgtcatcttccttgggtacttataatttagtctttatttcagagttgactttgcacttttattacccacccccaccaagttcactgagttctatttttatttattcttgtctttgttcatttctcttcttagtttttgaaattctgattcaaggtggttttcatttgtgcagatgtttgagtatatttaattcagtttgagtattgtctcatagttttcttctatgtcataacattttgttttttgttttttcctttttgtggaattttcattagatgaggagtgttggttctcattttctgatcttttgaagaagcttttatggacttgcttaatctgttcattttgtgaattttgggttttacaagatttctggttcagtgaccctcctttctattagtatagaaaagtcatttccttagtggtgtgtgtgtgtgtgtgtgtgtgtgtgtgtgtgtatgtgtgtacatgtggatcctgaaggattgtgtggcctctgatttttcaggtttttctggaccctgactttcccgtttgctttatttttatgtctccagtcactttccaagcacctttccatttytttttgctcccagtccccttgaaactatgcttttcaggttgtcaccaaatattgcgtgtgtttttagcacctgctctggtctgttgggatacttcaaaatatttttgcccttaggataggcttttctttctggtggtagtggtggttatagagaaattttaggcttgctgcccactctcttctctcttcttttcagttctccttggattgtccttgctcatgacaaaggctaacagttagaggatgagggatttttgctgggtgggatttggtgttttttctcttttactttatttacggctattttaaagtttggatgtttttggctgggtgcagtggctcacgcctgtaatcccagcactttgggaggtcaaggcagatcacgaggtcaggagttcgagaccagcctggccaacatggtgaaactctgtctccactaaaaatacaaaagttagccaggtgtggtggcgcatgcctgtaatcctagctacttgggaggctgaggcaggagaatcgcctgaacccggggaggcggaggttgcagtgagccaagatcgcgccattgcrctctggccttggtgacaagagtgacacttctcttggaaaaaaaataaaaataaaaataaaaataaataaaatttgggtattttcttgttttctacttatgctgaaagcatgcttttttcatagtaatttaatttgttcttattgttcttcactgtgttcagaggatatatatctccctacatatttatttgccttgtagtttattttattctcatgaccgttggggctggctccttgacttgaccatatatatatatatatatatatatatatatttttttttttttttttttttttgacggagtctcggagtctcggctcactgcaagctctgcctcccgagttcacgccagtctcctgcctcagcctcccgagtagctgggactacaggtgcccgccaccatgcctggctaattttttgtatttttagtagagttggggtttcaccatgttagccaggatggtctcgatctcctgaccttgtgatccgcccgcctcggccttccaaagtgctgagattacaggtatgagccactgtgcccggccaacttgacaatattaatagctgaagtattagggcccactttggctacctggacgtctttttgaacatttgtgttttgctaacaattcactttagtatctgatatcattacattttgacaatcagccaaaagttttaatataatattcaatcacaaatatttgtattgtcacttggaaagataatgagtaagaagatgttgaagaaaaggagagagatgagataaaatgatttcaggagatatttatgagtgatatactttactctgtgataatattttataactgtgcagtaacattttgttatataactctaatgtattaatttttaattggttcggcctaactttctctatgtcctgaacattggaatgtgttaatatatatggctcattaaaactaatcactaaactggagtataatgtgatggtttgttgggaggtaatttggtattctggagatggaaggacctcaagttttactatacctacaatacagcaatttacaaactattgaatttattttgtgtcttattcataaagatttggagatctgtttgttaaacatgcacatgtgagtcatgcactattaggtaggcatttcatctatattgcaactaattctcacaagaatactaaaaggtatcgattataggcctattatgcagaggagataggagaggatcagtaaagttaagtaactgatccaaggtcacagtgcaagcaagtgaaacagaaaccaacccctagtttctctggctgtaaagtacccattacacagtcacagttcatcttagggtgggcagagccattctcactaacttgccttgtgtgagctaagaccatttctttgccttgtgatttattccatccttatggcagttgggctgactccttgacgtgacaatatcaacagctgcgtgttggggatcacttgcagcatggatgttagtaagccagtagtattcagtactgtcacttggaaatgactgactgctcaaggacataggggatttttagtagaacttctggggaggctgcttagctctgatggtgcttccagacccatcatttgtcagtggttgtgctgcttgacagtaacccccatagggagaggttggctcaggcttgrctatgagtgagggatgttagtggggcctccctgctccaccgaatctgtgtctcagctcttgggcatgtattcacctgccattgtagatgtggtcgtggtttgtctggaaagcttatctccaactttacttaggtccaagattagctttcaaatcatttatggtggtggtgccttcaatgtgaggatttttaccaaatcatcttatgtaggtgcaaaatgatcagtattcaccaatartgttttaataggaatcttgagaatttgccaattatgtgaatgactcagggtcaaatgagggagcattgagactcaaccattttttttttttttttttttttggctctggaaatatttctcctgtgcgatctcttaagggattaagtcaacatggtcacttgtaccattaccttagtcacttggcagctgaaaggacacgtgtctttaggtgaattttctttacaatgagatcatgagctcatagcttgcttagcttttcttaatttccacgagtcataacacccctggaacttaactttgttttctgggccaaggcatccctgtagaatggattattcacactgtacatttaaattttttagaagtgtggttctataatttgccacattttatgtaacaggaaaatatttaatggccaagtgttacttacctaaacctctctacctctcagagccccagtttcctaatctgtaaaaaaaggaggaaattgttctatatgacctcaaagggcctgttccrttctctactgtatttatctgtgtgcaacttggtcacacctgcctgtctgcatgtagtaggcatgggggtttggataacgtcgcatccatcctctgcttctctstgtccaggygtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgagaagtactttctgtggatccrtggtaaggcaatagaatgtcaggaaaaccacctggacctggtggcagttgcttttagttgatgctcttgttaggagctctgccttctgcttaagtggaggagaggagtaccactttcttagaggggtttattgccatccccttgtcttggcgtgatttcatgttgttccgggctcagatttgcaagatggaatcacttttagatagcataaaattgtgaatttagtgccagtttctggcactggtggagaattgggattggcatcaggattgttyactcggaaggtattatgagtccaatgcctaaaccctgtaagctttccaaagggaaacatttatggcctaaattaggtcttttgaaaatatttaaggcctacataaaacgtcaggctccaaaatttgaaaagaaaactgcaaaactgatatatatatatataaatgattgattaaatgcttacaaaaggttacactatgccaacttctttacttgttcgtgtagaaatcataaatatttcattgtgtgaaaacaacttgtaagctagattttctcacttcgcaagaattcctgaatttgaacaataattgcagaaaaatcttagtcatatatcaagtgagtaactcatagccaaaaattaaaaaatcaaaatgataaaaaatccttccaaaaattttacagcaaaattatattcattgtggaatgtgagtacattttaatgtgtttgatatgatatatggtggggctgcccaagaaagagcgtctagtggcacacatacacacaaagaagacttaaagtggtcccattaaaacaccagtgtccaaccttttggcttccctgggccacactggaagaggaattgtcttgggccacacatacaatgcattaacactaacgatagctgatgagctaaaaaaaaggtctgggcataattttctgatatccaccaccacagagaagcaaaaatgtccttgcattcaaagggttggacacagctgctagatgctcttggagacactgctctgatgagttggcaataaggcgactttcccagcctgtcttaaaggcattgcccttccctgttgagtcacatagactcaaggttccttttaatctccaggcttttaggttcttggtgcatggccacccgtacagtattacaacagcctgttttctggtcaagctctgtaaagtcaagctctgttttctagtcaagctcttctttatcttagaagagctgccgacaaatatcaaggtttgtggctgatgttgcagttgagtgtgatgaatgtgcaggaactctcggtaacttccctaaaaacctaggattcctcattgctaggactacggatgagctctttcttctttgtgcaggtgacggtgaatgggagactggtctctgttccttacgtgggtgggaacatggaagtcaacgtttatggtgccatcatgcatgaggtcagattcaatcaccttggtcacatcttcacattcactycacaaaacaatgagttccaactgcagctcagccccaagacttttgcttcaaagacgtatggtctgtgtggtaagaacattttctcaactcctcttctccccctgctatacatttataaaccttacttgctctactctgaggctcttggatgcttatatttcagggtctagtagcgagggtcagattctggtgaggatcaagaatggcctgtctctggcatcaatgtttttgtacccagggccactcagtttatcttttttttgtttgtttgtttctctagggatctgtgatgagaacggagccaatgacttcatgctgagggatggcacagtcaccacagactggaaaacacttgttcaggaatggactgtgcagcggccagggcagacgtgccagcccatcctggagkagcagtgtcttgtccccgacagctcccactgccaggtcctcctcttaccactgtttgctgaatgccacaaggtcctggctccagccacattctatgccatctgccagcaggacagttgccaccaggagcaagtgkgtgaggtgatcncctcttatgcccacctctgtcggaccaacggggtctgcgttgactggaggacacctgatttctgtggtgagtctccaagttacctctgaaaatcctggagaccagctaactgggcttgctcagcctctctgtgccccagattctttatctggctaataaggatgaaaatccctgtatttcgtatgacctggrattccagttaggatcaaataagatggaagatatatatatacatatacatatatgtatatgtgtgtgtgtgtgtgtatatatatatayacacacacacacacatatatatgtatatatatacacacatacactctgcaygtagaatttttatgtaaattaatgcatggtcctttccattagtatttctatagttcagacaaatgcgattttaatgtgttagacacatataggcatctgtaaagggctgtgtaaccagtcacattgaatttgaaattccaccaagctttagcacacrcttacagtgtagtccatgcctgagcaggattttgaagtgcaagtagaatcattggttgccaagagtcttctcagttataaacactgcaggattgctagtgcagacagcccctccccaaggtcagcttccctacctggacttggcatttatttaaagtacaggggaaactgaaatgaatcagatatggctcctgtccctcaggggtgctggagtgaaaagaatactgaacttgaaaccctcagtcatcaaatataatcctcgactatttttttgagggaaatcaatatgtacatgcctgttagagcctcagagtttatcatcatggaactgtcagcagctctgagctgggtctggaggacttgggcatcctagtcccagctcagctggtggatggactgttctcttagtctttctggacctcagtttctgcatcctagaatgagatagttggcctagataacctgtaggttccttagggctcygattttctgaggccatgtggatgatactgcctcctcccaatcagcctgcaaatcaaggggcaaatgttagtttctaagttactggaagcactttctctgcatactgatttctttgtgtacctcctggttatttactgtgcacacagagggaaatctttggtgctccaaatccttggaaacttcgtccatcacctgcctgccttggtgccttgaggatgtgaggaagttgttgagcgaatcagaacgagggaaatgaatcaccttgtagcttctctcccaaggcagttctaagctgtgtattcctaatttaaagatgcttttcaagcataaaagacatatgtattcaaaaaaggacaacaaaacctactaaggacacacaggttcacaacatttgttaggactagatttggctgctagtagcagagaattaaaattttctgtcatacaactgatcggaggcggtggctccagctgattctgggcctcaaactggattctagttccttgctctgccctcagttgggtgtggtctttttcttcatggtctaagatggagttctagccatcacattcatgctccaaggaggaagctgagggaaggagggaagagggacaaggagcatgcatagctgtcttttaaaatggactcctggaagctgccatgggatactatactttcttttacagttcattgggcagaactagtcatgtgactacacttagctgcaagaaaggttgggaaatatagtcctcattctggtggtcatatgcccagcctaaagttctgtttctatggaaggtggggaggatgaagattggtggaaaatagccgtctctgccctggcaagtttgtctgatgattaaccatgttgaatcagctgtgcccatttcactctggctggtgtgggcctttgcaagtgacctccttctctgtctacagctatgtcatgcccaccatctctggtctacaaccactgtgagcatggctgtccccggcactgtgatggcaacgtgagctcctgtggggaccatccctccgaaggctgtttctgccctccagataaagtcatgttggaaggyagctgtgtccctgaagaggcctgcactcagtgcattggtgaggatggagtccagcaccaggtaggagcctgggyctttcacttcccatggggctgcttccctcttgggtcaaaagggagatatgttcaccagtgattggcctcttccaactgtggcagcagggttgactcttacggggatcattagggatagggaggcagtattgtgtaatggccttgcattcagatagctcttggttcaaatcctgcntctgtcatgtattatctgtgggattaaacatcaaagtgttgttaccacattattattatgattgttattactattgtctttatgattatagtcatttaagcagaatgatacagaaatccaggagggaaagggaaaagaatattttgtgtcataatgtctgccattgttaagagagattatgtaccttgattgtgctaaacmcaatatattcattatctyagtgtttttcaaaggtgtattttgcagggtattaacagttacttgtggtcaagtgagtttaaagaacaccagctaaccatagttaaacaggyttctttattgcagaactctttagtctttttaatatactactgtaccttgcagatatttaagagagtttttgtttctcaaacttatttgatcatggagcgtgtgtgtgcatgcgtgtgtgtgtgtgtgtgtgtgtgtgtgtgtgtgtgtgtgagaatcccttgggactgggattccacagaatacattattgtatcctgtgtcactcataaatacaaaaatcctatgaagaaactaagacctaaagagctcagtaagttacccatggaaacaatttataagtaatggagttgatctcagaatttgaagctctatgtgactccaaagatctggctctttccactatatgaaatggcccttttgctgcatcttttttgggctgatttgcttgggagtcactgagtcatcaaaattttttttttttttttttttttttttttttttttttttttagctctwtgggagttattgagtgtattttgaaagcatatttaccagactcctccgtcttggcctaaaatggctgtcatctctcttcaaagttgaccccgtgtatatttgtaggatctggggcagtgtgtgtctgtgcacatgtgaacgtgtacatgtgaatgtgtgcagtggccctgtccttcatscttgacagtgatactacagaccgtggtagagatagaagcatatttggcttctaggaaaggagaatgtgttttgtgatcatggactgcactcaagacctaatgtcttcatcgccaaggaggaccattcttgctaagtggaccaagtagagtgacttaccactatgttcaaccacgaataggagaactcatggtaaatgtagctaaccagcctgcagaatagtgaaaacaacatttcagtaactacactattctgtccctgatgttataagccaggatagggaccattttatatgattctccccaaagctctrtagggtcataatcgcacatcctattgaatggatgagactgaggctcaatggcatgaggtgataaagctgggatttatattcatarcatcagtcatcctatagtgtcctagccctgccattgacctcactggaactgtgagctgaactctgggctaactcatgttcattggagcatgggtatccattagggctattacttatagtcacttatagtgatctcatctgctctagtttagttgttgggctttgtcctagtggatccaatttgtcctcaccgtggaatagatgagctaaagtcctactctactgccatatttcaacttgccaagttaagtaattgcctgttctgtgatattccctaaatgagttgacaaaaccttatattcctctccttgatttgtatagctcctgagctcctgcagggcttgaatgatgtggaccaatttacatatggggctagaaacctgtggtaatttcagaccggttttactagtagtggcaaaatgcttgctctcagaaggagacagaaatgatcttttccttggcgttctgtgatgagaagtgagctcaagtttgcagcatttctggctcatgagtgtcaaatgtctgcaaggtcctgagagcaggaagactgtgaactttatcttagtgtctccaaacccctatcctttgcttctcctytctggtgctattttcccctttcactgcccgcctcatcttcagtccaacacattagaatatgcattcaagttgtataaagtttccatccaaatattttggatgtagaaaccgtcttataaatatattttaaaatcaggtaaaataaaattagttaattgaaaactttgaaaacaacacagccacttttagtgatttcagaaaatacagtttaaatgaatgaaaacaaacatcatatccagccacgtgcattttyaactttgactttcaaagcagagaaagaataaaaacctaatgtgaagaacatttccattaaagaaacttttttttttaaactgaaaaataaagcccagaaaaccttttattaagggaaataaactagggtataaaactattgtagtaatttcrgaagagcaaaatattcactagttttcatagctcttgtttattttacaaaacagagtctaaagaggtgagtctttggagtaggatcagaagggaccaagagcctgcacaggctgtccctggctcagtggagctgctggtggtggtgggtgctgtagtgacaggcacaagtttagcaggaaccttgtccatggcccagaagctctggcccgtagcctccttccctctcccttagtctctgctgtccctagctgggctcagtgtttgcatttcatttgcatcccccatcacattggctggtggtgggtggtgcatgatgaattgcttgtgtccttctttgaccttgggccttgaaaatgtcagttttcccaccttattctctgcaggccgatctttgtcaccttcattcagactttaactcctgctggctctcataccggttctggcctggtgatagtcacgcctgggccctggaacctggcgattgcractgcctgcstgcagttggcctgggcttgtgcagcagtgccatctgccggccgcgttgctgcatagcctggccaggcctggagagccactacggttgcttttagaagcttggccttagcttgttttttaaatttttwatttttattcttttccctgccttgggcaggccttaagcttcctgggaaatgaaaatccccagcggaggaggttggacacctgcttttggtcatctgttgtgtgttacccattctcaggatagttggaaaattgtgtgatttattcttgagtttaaatatctgaggtctgcrtttaaaaggagagaaaaaagaacactgaaacatatacagaacatgactctctccttccgcatcccctcatgtctgccaattcgaccccctgccccagccctccgaggccagcgccctgggcccctccctccaccttcccagctggagtggcagccgctgtgtcttttctggtttttattcctagtccttcccttttccgtcctgcatgctgtcgccagggttgtctttatttagctcttctctgtgaggcagggcctcctccattgtcttcagccacctgcctcacctgtgatgccgggcactgcgggagtgttccttcgtctgtgcctttgttagctgtttcccacctggaattcctcctcctttcccctttgcccaagtcttcctgtgcttcataggtgcacccttgtgagactctctggagtgcccaatcttagtggactctccttttgcactcttactgctcttttattttttatttttacaaatagctttattgagatataatttacatgccacaaacagcacatatttaaagtgtacaatttgataggttttgacatatgtacacacctataaaaccattgacataaccaagataatgaatttccatcccccaaaggttagcttatgcccttttaaatatatccctcaaccctagacaactactggtctgctttctgtcactatagattcgtttacattttctggaatttcacataaatggaatcatgcctacgcacttcttttctgcctggcttccttcacccagcataacgcttttgggattcatccatgatgctgtctgttttgatagttttctccttctcattgctaggtrgtattccacggtgtgtgtgtatcacaatttatttttctcattcagattttcacgaatgagtcttatttcctcaacctgactgtcagccattcgagggctaggayggtgtgttcagacctgcccaygatgggcactgtgtytgytgatgagaagcagttgtrctgcaagaggctaggcctgtggtgtctggggccagaatgctaagttcgaagcctggatgtgccacttggtcaaatttcttaacttcttggtgtctcagtttcattatttgtaaatatagatactactacttatctggtagtgttattattaggaaaataaagtacataaatgtaaaactcttagaaaaatatcttgaacatatttattattagttacctgtgggaggcagcagagcatggtggtttaaaaccatggatttgggccgggcatrgtggctcacacctgtaatcccagcactttgggaggctgaggcaggtggatcacttgaggtcaggaattcgagacccagcctggccaacrtggtgaaatcctgtctctactaaaatacaaaaattagytgggtatggtggcacatgcctatagtcccaactatttgggaggctgaggcaggagaatcacttaaactcgggaggcagaggttgcaatgagccgagatcatgccactgcactgcagtctaggcgagagagtgcgactctgtctcaaaacaaacaaacaaacaaacaaaaaccaaaacataaaataacaaagaaacaaaccatggatttggattcaaatcctcactctgtcgctgtgcctgtgggaacctagcaggtgccttagctttctcattggaaaagtgagggcagtggtaaaacatatcctcaccgtaggactgcagtgaggattacatgagtgatttaaataaagycctcaacacagtggcacacagcaggtggcatctgaatgttagctgctatcatttattgagtgagtgaaaggtgtcaagggcaggaccagaggrrttaatcctgaaggagggcagggcactttgggggaagggggccttacttgkgggtatttgatcttccttcttagctgactgattgctgactgtggaagtaataagtaagaccttcttgacctgggaacttcttagaggcctttgagctactggataagaatgtgtttcttcaggggcaatttcacttgaatttaattttaagtttaaatttaactttatggctgaatccagagggagactgagtcctggctctgcttcttattagtggagctctttgctgtgtaccctgtgctaatcacagtttctcactccttacaacagtcctgcaaggcaggcttgagtacgctcattttacaggtgaggaaactgaggcacagcggaatgcagcctttgttagagttcaggagttcctgacttcaaagccttgtgctgtggggctgtgtgtaccttcgagaaggctgctctctgccctgggccgtctcccatttgaaaaatcagagaactgcactcaggcctctaaagtcactgcgggcrtcaagaatgtgatgctttcaagagttttgctgtcctccccaccgctcttcctaccctattgtctgaagtcaatttcagaaataaatggatttttttccccaagcaacaacccaatttctcctttggcttgagaaatgactagcagtgcgatccaagaactctcatttttctttctttgcttggttttagcactgccaacagagaaggctgtagtgaaaatttccgcatgttagtttacaaagcaatgtggcaaccacctttctgaaagccattagaacctcacaacctcctttcagcctgcttttgtttgcctgtgaggctctgtcagagggctgggtcagggactggcccttgccggaggcagggagagctgacctctgtgaattctgggcttcgtacctagaatgtcctgtgccctttctgaacctygctttgccctcagttcctggaagcctgggtcccggaccaccagccctgtcagatctgcacrtgcctcagcgggcggaaggtcaactgcacaacgcagccctgccccacggccaaaggtgagagtcctccyctccctggtgccttcatggaggaacaagggcccctgcaaggccccccagccacccatcttcacctctggcagagcagactcaaacactggcacctagagtcctagagtgggtgggcttccttgcccagcctgcatttcccatcactgggcctgggagccccattctgcacctggggtcgacattctcagattaaccctcgcctctggtccccagcaacgstcagacttaagagtcccctggagggtaaatgtgagggtgtcaacaggaacatggggacactcatctgtcagaggtcccgtggcctggatccttgtgggatgacsrtacagaactcctactagttttcagtgagcaagaacatttcaaatccctctgaggctgtcccaccactaatttctctgacttttgtggccgttcctctcctctagctcccacgtgtggcctgtgtgaagtagcccgcctccgccagaatgcagaccagtgctgccccgagtatgagtgtggtatgtgtcccaccagggggatgtctccagggcccaaccctagccccagggggcaccaygttgaaggtgctgaaaggtgtctctgttctcaggcacagggtgtgtgaaaggaggtgggtaaggaccgaytggatactccaaaaaartggaaagggttacctctggagaataggatttgcttcctagaagaatctactgtaaattactaaacacaggtttgacaggattaatacaagaatggggtgattactggggactrtggagatatactgaagaaaaggtcaygccaaagcaacccattttcattttcaataagattttgaggctgctagatatagagaagaccacacactgggcaccttgagttcagcaggttgtttgctagaggttttcatgctagccttgcaggctgctctgtgaatagtgggctgaataatggtataagtccgtgaattcagagctgatggaattacggttagcatggcaggaaatcattagtgcctttgtcccagtcctgtccagtgtgtttattgcttgtacagatgaagacctaaagcacaggcttgtacaatttgcagtgatgcagatattgaagggagagcagatagatcaggggacagtccaaggaactaaaagaaaatcatataatcggagaaacttatttgtactcrtgaaattgatcagaaataaatagaagtcctgtaggggagggagatgtggcttgagaacaattaatgtaaaggaggtcttagaatgttagcagtagagagaactagagggatcatttacttcaagcccctcattttatagacattactagtctcctacaatgtgccgggcactttgcccttattattttgtgaactcctcagactgatcctataaggtagagttcccaccttccagaagaagaaacaggtctagaggatccaagttgacttggctgagatgtgaaagccctagtggatgataagaataatcagtatgtgacttggattgatctatctgtctgtctgtctgtctatctatctatctatctatctatctatctatctatctatctatctatctatccatctatccatccatcctatgtatttatcatctgtcctatctctatctaacctatgtatctatttatcatctatcctgtctctatctatcctwtgtatctatcatctatcctatctctatctaagctatatatctatttatcatctatcctctatcatctatctatctatctatctatctatctatctatctatctctattgtatctagttatctatcctatatctatgtatgtatctatctgtctgtctaatctatctaacctgtgtatctatttataatctatcctatctctatctaacctatgtatctatcatctatcctatctctgtctaacatatgtatctatcatctattctatatctatctgtctatctaccctatgttttatcatctatcctatctctctctaagctgtgtatctatcatctatcctctatctatcatccatctatctatctatctatctaatgtacctagttatctatcctgtatgtatgtatgtatgtatgtatctatctatcaaatctatctcatgtatctagttatcattctatctatctatctatctatctatctatctatctatctatctatctatcctaacycatgtaatctctgtctccatcatcatcacttacctaaaacagtagaagtctgcatgaataggaatgtagcatcccactcacaggtaataaaagagtaacctttctgaactctgcatggaygtctctctttctggccctcagtgtgtgacccagtgagctgtgacctgcccccagtgcctcactgtgaacrtggcctccagcccacactgaccaaccctggcgagtgcagacccaacttcacctgcggtaaggcctctgtggatgaggaggggtggtgtggcctctctctgctggtgtgagggaggccatcctcctcagggacctcttccaagatcacgtcatttcctgttttctacctagctgaatctgggttgggagtacatctggaacagaggggttagggtcacacctgcacggaatccttccggctgcacgctgctgaaggataccaggtgtgggcacagccacaggcacctccgtcttgggtttatgaagaagcagctggggctgagatgaggaggcctccraatctaatctttatttmtgcccatcctcctgtatgtcatcaaggggagggaatgtttccttgacttcccctcatcattggatcttattcccaaacaaatttatagtttttygcctctgaaggtgtatatatgtaatcactatatactgtaacttaaacatagcgatggactaaaataagacacgacaagaaaccaaattctgtatttacctcccgagaatccccactctaactccgttggcgttcttgtcctgctgatgtggacactcacccgacttcctagatgtgagacttcaaggtgggaggagagcacattgtgtttgaagggagctggaaacaggcaaaggacacagggacaggatttggtcttttaaaagtgacattgtggctttgacaagattgctggcaatctttcattccacactgattgctggcggacctaaagtgtagggtattgttctaggtactgaggtggggataggatcacagaagctcctggcatagaacagtgcttagcagggcgtggtgtacccagacctactggacttagagattctacatctgacacctctgagaatgaaggaacccgccccttccagatgtatgtgggaaagtgatagagcagggattgagcagccttcacttctmctccattagagttcctagcttcacatttccctttttgattaatgttcatatttttctgcagatggactgcttttggtaacattgaataactcccagcccgtgagcttggccctcacacatttctgacttaatcttctgagtctaaagctccctggcaccctatagcatagctgaatacttacragccctggctgggcgcagtgctcagtgtggccttgtcctaycctcagcctkcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaacygccaccaatgactgtggctgtaccacaaccacctgccttcccgacaaggtaaggactgcttggctattaactatcagttaatagtttactcatttatttattgctgtyagtttatccttctatccacccatccattcatccatccacctacccatccaatatttgctaagcaacrtgtgctcctcatggaagatttgcatcctacccagcattcccttcttgcccaaaccaagtgctacaaggcttggttggggggcagtcagcattccagctcagcctgagtggaaatttagttaactcaggaggcatttcttgtgagcctactatgtactaagcatggctaggtgctgaggttacaaataatgtgcaggacatggtctttacctttataagcttattttaggttagctaaggaaataacatgattgcatggattatttagagatcagttaatagttatacatacatgttgagatgaggtcttgctatgttgcctaggctggtcttggactcctgggctcaagtgatcctcccacctctgcctcacgagtaggtgagattacaagtgcacaccaccacacctggctacgagcagttaatagtttactcatttatttattgctgtcagtttatccatctatccacccatccattcatccatccatctgcccatccaatatttactaagcaactactrtgttctaacagaattggcactgtgctaggtgctatgggagaaatgttaagatgaagttcctatgtatgcccttgttagtatatatgacaatagtctataaactgaatataataaagtgtcaacgaatggtacagattttcattacaaacagcagtcttataggtgaaagagccaccaagattagctatcattaaagatttaattgatggagtgggaaagtgaagggcgcgaaagtggcggagtgagaactgaaatgagccagaactgcagcaggaagacctgagcatagttatagctgctgcattgaggggagtcctgacatgaatgacagacaagctgcagtcatctctccttggagcctgttagggctggaacagatctttatttgtctggaatgcttaagacctctcttcccctctggacgctcttccagctcagggattctaagcacgcagttttggagaagcgggaacaagtctaggaggctacagttgctgctgctgctttcttatatctctgttctccttctcgtcttcctgcccacccctcctgccttgctgtttttctattaatgtttcttgtgtgtctttaatctatagtaatgccactccccatttttatgcctttgatttgttggggaagctgggtcatttgtcctgtagaatgtcatgaattctggatttgactagcagccaccttatggtattgcataatgtgttcctctatcccctgtatttccagtagactagaagttagacccaggggattcattacattcaaggtcaatgcagtagggaggcaagaatacctgatcaagggtgccatgtgcatcacacccagaggcacataatgtccagctgtcctcctccctccctccctccctccctccctacgtcacttccttccytccctccctccttccctccctccctccctccctcactccctccctcactcctttcttccttccttccttccttccttccttcctttctttcttttctttctttctttcttttcattcgttcttcttttttttttttgagatggagtctcgctctgtcgcccaggctggagtgcagtggcgcagtctyggctcactgcaagctccacctcccgggttcacaccattctcctrcctcagcctcccgagtagctgggactacaggcgcccgccaccaygcccggctaattttttgtatttttagtagagacacggtttcactgtgttagccaggatggtctcgatctcctgaccttgtgatccacccgcctctgcctcccaaggtgctgggattactggcatgaaccaccgtgcctggcctcgtttttcttttttttttgagtcgctctgtggccaggttggagtgcagtggcacgatcttggctgattgtagcctcgtactccctggttcaagcgattctcttgcctcagcctcctgagtagctgggattgcaggcgcacaccaccacacccagctaatttttgtattattagtagagacgggatttcaccatgttggccaggatggtctcaatctcttgaccttgtgatccacccgcctcgacctcccaaagtgctgggattacaggcgtcagccaccatgcctggcccagctatcccactttgagagataggactgattatgtgttcagatgaagcaacctatttctgcattgtgaagtttaccccatcaacaatttatagttttactatttataagtgtttgttgtctaagatttattatgtcattaggagtttcaaaattgtgacttttctctacttctatcatactgattgcatttattaactggaattctcccgtaagaaagaactttctcccaactgctttcagttaccctgaaataaaattactttagacaaagtagaataagtgcttgattttttcttttccagttttcatagccatgagttgatgctctagcaactgtcaaggacagcgaaagaggttttttgtttttagcttcattatgaactcatggattcttatgtgtttgatgtgtgttgattcattgtaaactttatttttttttgatattcaagttgtcctccctggggtaaatgggggctcttttaagttggctctggagcctgttggcatggcctcatgagtctttcgtagctktcttgctttctgaaacaataaggcgtgctgggctcaccctgggcatttcctgccctagtccttggatctgccattttgacaaaagtccccctaccttttagtgaaagtggtatttaggcggtatgatctgggtgccaagaatatttatggctctgggttgccattgccttcagacctttttggtgaacagagcttagaaatgcatattttaagagaggataaaaactcgtaaatttgtagtggtatttctgattcaaatgaaattacaggactttacttccttgattttttgcttgtatcatttctcttctaagttgaaaattctggtttcctaacataattaactacttatttgctttatcttgcaatatacctgtaatagtttcaaaactaacctgtaatcctagcactttggsaggccaaggtgggcgggttacctgaagttgggagttcaagaccagctggccaacatggtgaaaccccatctctactaaaaaatacaaaaaattagttgggtgtggtggtgtgcacctgtaattccagctactctgtaggctgaagcaggagaatcrcttgaatccgggaggtggaggttgcagtgagccgagattgtgccattgcactctggcctgggctacagagtgagactttgtctcaaaaaataaataaatacataaaatttcctttcagttcttctagtcctaaaaaaaaaacctcattgggggatatttgtgtaaatactaggttttgaagtcatttgaaataactattataattatattatgatgtaatatatcatataattattataaataataattatgtgccactgacgatatctagttaatatttcaatttgttttccatttttagggattgctttttatttcttttaaattttaaaattactatggtgtaaaacacttaaatgattttaaaccccaaattataaaacaagacatattcccaggagtcttactctgtgttttctctaccttattccttcctccaccctataatttatatatgtgaatatatataatatataatatatatatatakagagagagatagggtcttgctctgtcacccaggcacaagtgcagttatgcgacctcaactaacttcagcctccaccccctaggctcagacgatcctccccctcarcctcctgagtagctggaactacagacatatgccaccacatccggctaatttttgtatgtttttgtagagacaaggtttcatcatgttacccatgccggtctggagcttctgaactcaaccaatctgcccgcctcagcctcccaaagtgctgagattacagacatcagccaccgtgcccagcctttataatttttattagtttttctctttttgaaaatataactgaattttatacatgtatatttcttcccatttctcatagaaaggaagcatattatgaattatattttaaattgttctttctcatttaacaatatttgatggagattattctgtatcagtgtgtagagatctgccttattctttcttatagctgcatagtactccattgcatggcagcaccatagttttgtttcaacaagtcccttattggtggacatttgagttgcttcagccttttgctattacaaattgcagtaacaaacagccgtgtgcatctgtcattttgtggtcttgccagtgtgtctttgggatagattcctggaagtgagattctgggtcaaattataaatacacatttacttttgctaagtattgctaaacaattcttctccatagggatggtaacattttcctgcaggccttttaatagaacaaggggtctcattcartaagttcattatacagaagctagaagactgagaagataaatgataatggtttcaaaatgtttgaactgctattatgacattcacagggtggagacccgttttgcataactttggagggcatacttgggattaatttcaaaactgtcattaagtcccgtgatcaaacagcttccttagctcctcattccaacaaaaggatgtccgagcattgtctgtggcgtgcatcccagactttccacgtttccctttcaaccagcctttttcatctgttttcccacatctctaccagagcctattgttcttcccaataggatcccttgtctctcaaacatatcccctgctctgtgtcccagagtctttacttgttatgttcctagtcactcgtgggcaaggggacatgcattcatagcccctgcccaatttgctcgtaagtgggcagagggctcgatgaggatgggctccaagtccaaggacattactgggtctgggcatgtgggtacagcttctcggtgacataggaaggagtgaagtgcagttaaggcaggaagaagggagaccaaggcagccagtgtgttgtattcaagtctgtgggaccatgaaggcctcacgaggggccacccctgagagactggtcatagcttttctaaggctggtgggcagggaaaggaggaggacgaaatctgctttataagcagccctgcatatgggcggagaccacatttggttttatttattgccacattctcagcacytagagcggcttctgtgtagtaggtgctaactcaccgcttgtttcaatgaaacaaatgagttcactyaygaaaacttatgtctacaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcggtgagtggggcaggggctgggcatgcctgcagctatcagagcgggaaagtagaggagggcatcttaggaagggtaagaaaggttctttttttttttgaaatggagactcgctctgtcgcccaggctggagtgcagtggcacaatctcggctcactgcaagctctgcctcccgggttcacgaggaagggcaagaaaggttctttagtgacctctggttcaaggctaggggtgaggaagagggagggggttagggctgggtaagaagaaaaagcatgagcaaaggatttctgcgtcatccttctgcagttcagtccttggctaatggtcacgtctgttgtatggccttaagtctaaagtactggtggagtaggtttgagcagagacatggggaggactaaatgcctagaaaagagracttgaagttttcctttttcttccaccctcatgtatcaccttcgcctgtccctagaacaaatgtatgctctgaattttctaggatcgtccttgtttcagtttactctggtgtttccacatagactgttgattttcagaccatgtttataayttgaggtacggaaaacatgatccctgtttcccaaatccagttcgtggtggctgcccctgaggctcctgtgtgtgctggggtgccctattcttgcatgtttaggatggatcagactggagaaaaagggagcaacaatctgcagggaggactgtgggtaaaattctgcttgctggtttaatgcgattattattactacattattatcagcagataatgatgttaagagaagaggtgccagggcaggcgagcacatccatcttgtggttgcttttgcaaatgtcaatggcagtgaaggcagagttcctgaaggtgttttcgaggtgaatggtttgacggaggagggcctgagggcaaatcccgaaacccaggcccttcacctgctattctacytgcatttgggtactgagagtgagcggaggtgctcagtacctttgggagaggatgacgctgtggtatccaggtgttcctgtgggaaacactaagttttggaaaccctttggttttcttctcctctcacaggcsatctgaggccagggaaataacttgctgtcaaataaagagagtgctgcttagaggtcatttttagaaaattgacaaccaatatatttcgtgtttcagtggggagttttgcttgcaaagaatagaacccattcaggctagctacaataaaaggggatttgtagaaaagatacaggaggatctttcagacaggaagtgcaggatttgtaggtgggcaccgtggtcctacagcatgtctctccatttgtcctaagagccggtatttctgtccgtctgctccagctcctcactgcaggccagcttcctctgtgcagaagttttgctttctcacacattttgtttacacacagctttgttaaatctcacttcaactccacacagcttttcagatccgtggttcatccctgtccagtctgacttagttggtctttgtgtttcatggatcaacttctcaagaggaaagttgacaggcccagctcagcccttggatcgggtccgctgtccagttcatgctctggtccagtcaactattgggggagctgcaggtcctggggtataatcctggctgcgtagaaaagctgggggaagtttcaaaaagaagatgagtagggaggtcagggcaggagtggmggaggaaccatgtctagaactcttgaccgtgtgattgctctagggaatcgagtgccctgtcttagaggctgaatgttcacatcttctggggaggagaagggagcctcatggtttaaaatctcaggggacgtgggaggctgggcttcgatctgtactgtgttgagtgaggtgggagcttaagtaagttacagatggtctcagacttcattctgcaaagagggtagtattgttagcattattagctctggtccgacctcagaggcacttgggctcatatatgccggtccatgtgttgtctaggttgtgacagaaaagaaagaacaacactaccatcatcaccctgaagccacagtctgcagaaacacactttccccaagctcctccatagttctctgctcttcgtgtcagaggaatggtggcaggcaagcaggggcattggcggcttctcaggaatgttctaagcgggcctcaggcgatggccttgcttccatgtccatagtgagaggaggcctgcacctctgtacaagcctttgaggggattttccatgaagcctgatggccatctgactcctcaccygtaggctcctgaatgaggctcagtcaaggtgtaggaactgtattctgagaagccaaaggaagtccattagatattatttactctgtgatactcctcaggaagaagaagagggagggctgttcttctcagtatcagacaggaaacagggccaccccagggaatggggttggccagaacctctgtagctcatatgaagcctgtggacactggagggtcctgacccgagcccagagctcgtcctgttaggctggtacaacccgcaactccagtgttgcaagggccagtctgacccaggaagtcagcttttcaaactgtgctcctcagattgcctcagaggggacaagtgaccagagcttggcatctaccacctccatttcagttatagcaattgtgcttaaaggattgtgctgctagatacattcataattwatttttcagtgcatatgttttcaggttgggtggctagtagacctacttagtttcattcttatttgggaaaccaatgaaaacagggtggagaagagagccaggagaagggcctgggatgtgtattttgatacaagatatcaaatgtcgatataagcgagggaatttgttggaggaagggaaaataaagaattgaaaaatataggttggaccctggttgtgcagccagaaaacagggttgctgtggggtatggaggggaatcttagaaagatggaaatttggagggatggctaaaagtgtctgggtttgagaagctagtggggctgtgggaacagacatctggcctgggagccatccgtaatattgacactgtttgcccatggtgagaggcaacaggaaacaaaaataatatgcgaatctcgatcattcagccttctagagaggcgyacgagaatgacagcagatccctaaaggtattaattactgtcttctgtgttctttgagtctttgtttctgaccccctgagaccttgttttttttctttaatggcattttgaatgttctgctgtatcttggagggtgtgtacacagattgaggcatcctaatttgttgtctcctccrtagtacctagtacatcataggtgcacagtaaatgactagaatcttggctgataaaagcctggagacagctcactgcacactgctgggaggtgggcggtgatatcagtaggtctygtggagactgggtggggttgagccaagtctcaggagtgttgagaccgtccagagagaggcacacgtgttgtgcatcttcagattcggccctgctggggagagtgcttggggagcagagcaggctgccatccacacccgtcctgaacagctgtggttactctttctctcttaaggacacagctccaagatggaacgtagtcctgggttcttttctcttggctcctgggacaaacacactgtcattgctttgactattctttctatagacttttcagaggagggtttcagtccatgttcatgatgctttagccagattggaggaccttctagaggcaagatgggctgacaaacttccaggatgctggtctccctggcatgctttctggggaagctttgtctgttgctctctcatctcacttttcttttgtaaagaacaccgtaccctataaattactaggtaaatgtcaagtaacctcttggggaagcccaaatctgcacgttggtgagcagtattgggatcgagtgttcgtcttgtatgggaggctagccctgcgagagtggagactggatcccagtcatcctgagtgtgcctcccggtcagtgagggtccctagagttggccatgataagggccagattagtaagctgctgctaagggaactctgggctgtctttaatgctcctatggactggatcatggtctctctcaaagtgggatctttcagggggcagaattatatctctgcagctgatgtaagacttcgtttagtgacctggtggttgctgcttcttggcatggccctgaggctggttgacaacaaagatgaaaatgcccagaccagtgatcacttggcacaaccccagggctcagtacgcaggaggcgtaggtaagagcccctgtgtctttgctgctggcctgtccttactctgttttttctgcttttccagggcttcacttacgttctgcatgaaggcgagtgctgtggaaggtgcctgccatctgcctgtgaggtggtgactggctcaccgcggggggactcccagtcttcctggaagagtgtaggtccaggcccccgggacggggaggagggcagattggggccactccagggaccagcgttgaccttggtttcatctcattccctgccctttgctttccccactgggcatttyacccagctgttggtgttatccagatgccagctgggatgacctgccccttaggaasyagttaagacggcctcagscttcccattttgtagattttgggagaagcccagggccctcccrgggggattcatgctctctcattcacctgtgaatctgaggtgctgtggctgaggggctggttttgggatggcctcaccacccctccaaagtgccacaggctgcaagtactgttctggaccacatcaacccaggcagggtcctcagaccttttcactgatttctactgaaacctccttggtggttttagggaggtggaaacctttacaacccagaaaaggaacagtatttcccacagtccctctgttatttctgcaggtctggctggggcatcttgccagccccccattgccccactcttgtcctctcctggctggctcacccccgccagtcccttcttctaacacagagcagttcagctgtcccccatgtgctgccaggttctctcttagactctgatgctcatcaagccattttcttaaacacagaggattccgtctttggcrgttttagtccagatgctaggagaatcacagttctttcagtctggtcagaaggataaggtgggtggtgccaagtcctggcagccttgggagctggtgctgggaacaggtgaactgcccatatgggccttgcctctgtcttccccagcaagaccaatgcgcttcccttcgagaggaaggccaaaggtctgctatcttgtcctgagcctttccmatctcctacccaggcccattgcctttctcctccccagtgataacagaatgactcactgggctttttcaggtgagtttccacctccccctctagtccgagttgcctatgggttctcttccctgtgttctcccctccccaccttttagtgcttctgctcccatgtgccctggatggaggcaggttttgtttcttctccccagggtcaaggtccagctcagatcaggggctgccccatcctggtggggctgagagctggtccctttgcgctcagtattcctgcccctttccccatctctcatctcccttcaaggcctaccccaccctgcccctcatcagtgtttgcaaagcataaggtgacctgggcttctctcctctacctcaagtctccatcttacctaaaagacttgggtgttggcaawggctttgctgctgaaccatgtcaggggtcagcggggggtggtggcaatgggtcctcttaatgagccagtggccaaggctcagtgagtgagtaatcagaggagggagaagtctggagggtggaatcaggcctgcagtgggaagatttggccacagggagtcaggagtggggggtgaagagaatggctgcaagtgtttggcattttctacacctcatctggaaggagaagaaataagcaggcaccaggagaagtaggtcagggcctgagatggcggcagagggcacctagttacatatctgggtgctggccgacacagagggcactcggagtgacattttctggggaagatcctcctggtgacttttctgaaccatggtcttgggccctttcagcttcttgcccgtggtgacaacccttggggtcaggctacccatgtgcagtcttcgtggacagattgcagggctgcaggggtcccaggccagccttcccgggcttctgccagctccctgtctccccttaccaygggaagtggcaccagcctgggaaatgggttgagcttcccggctgcaccttcccactgatggcccacagtgctgcttcttggccggagtatctgagctcagctcaaaccaatgctgaggaagggagggtgagtcccctggcttctccaaggtgcttgcctgggtgcctcagtcaggtgattttgacccaaactgtttgagtggtgctcactgagacgagccccactcatcccctccgtgggccctaccctgtggtgggacttacatgttaagccaggcttcacgtctagaaaccaccttcctgagagaagagcacattcccamtgggaccctgggctccagccctgccccagcttgttggactaactctggtgccctgcaggtcggctcccagtgggcctccccggagaacccctgcctcatcaatgagtgtgtcygagtgaaggaggaggtctttatacaacaaaggwacgtctcctgcccccagctggaggtccctgtctgcccctcgggctwtcagctgagctgtaagacctcagcgtgctgcccaagctgtcgctgtggtaaggcatgcaggctggggctgggctggaccgggcaccacctttaagcctctctttccacttttggctcctgaattctttgcctttttagcaacttagggaaatggataggaccgaaatcttcccatctgctcctactgcttttatgagaaagcaaattaaatgggaaaaccataggaatttcctgaagatcactacatggcaagactgggattcggccctaggcttctctgatttggagaccacctttgwaatgctgtgacgtttcacccaggggaaggcgttcaacttgccaccccaacgctgccaacaaacagaaaaatggcaacaacaacaaaaactagttctttctaccatatcctgctctgaattttatttatttgtttgtttgtttgtttgaggcagattctcactctggagtgactggcgctatctctggataggctagagtgcagtggcactattttggytcactgcaaccttggcctcctgggttcaagcacttttcctgcctcagcctccgagtagctgggattacaggcgtgcrccaccacactcggctaatttttgtatttctagtagagatgtggttttgctatgttggctgggctggtcttgaactcctgacctcaagtgatctgcccacctcggcctcccagagtgctgggattacaggcatgagccactgtgcctggccactgaattcttgaaactgaaattttcaagagtagcgtttcrttgtttcataaacccaaacatcctcccattcatcccatctcttaaatgtaaattcacataagcaagcgctgtcacttggagaacgtacggggctcttctcattgtgggctgcatggggaagggaggccgctgtgggctccagcagtaggacccccagcgctgggttgtggggtggggggaaagggccgaccgatacaggagggaggcccagacacggaggaggagccccaaagagagcagcctgctcgccggtctcaccagggtgtgttttgcccactctcactctgcacttttctctcccccagagcgcatggaggcctgcatgctcaatggcactgtcattggggtgagccgctgtcctcttctccagagcaagtggtggggacagggaagggggtactgtgggaaggggagcaggcaagycattgtaaagcagaaatgaaggaaaccagagagacccaaccccagctttccactgcctgtgggacgtgcctggcatcatggagcccaggctaggaccatcttcctgactctccgggcctgtctcacactcacttcctggcccccacctcaggcacctgtgcatttcttctgtgtgcagagaagcactctgaagtcattgtgcacgttttagtttgtcccctctgccactacctgggctgcctctttggcatgaaagttctcactcttaccatctygatactggaggtgggaggacgggaaggcagtgggccataggagacaggaggagcagcagagcgatggctcatgggagctatgggtgggtgggcaggagacagggtatgagagtgaggtgagtggggggttgggggatgctggggggcctgaccctggtgcctctgcttccagcccgggaagactgtgatgatcgatgtgtgcacgacctgccgctgcatggtgcaggtgggggtcatctctggattcaagctggagtgcaggaagaccacctgcaacccctgccccctggtaagagaggctcaatggggaccgagggcatggactggacgcgtgtgggacccaggcagtgggacctcactgcggtctttaaataaataaatctctcattattttctgattataaacaataattgacaataataaagaagagactaaaaatcacccacccaaactgcatgcctcagaaataattataattttagttttataagttgcaaacattttcttcctgagttttcagaataaacacagtatttgccaggcttatgatactatgtttacaattctgtatccctttatgtattttaagaaacagcaccaccgttctttgaaaatattaaaaattagtcaacaaatatttatcagacacctcctatgtgcaaggctctacacaacattcctttgaatggatgtgcctcgtgtatacaaccaagctattattgcgggacatttggatggtttcaaatatttcaccctgtttttgccaggccatgctgacgatgcttgttctgaatacttccttgaggtggttctgagaggtggactcctcgttcctagtttgggagatgaaactggcattccgtgggtttcagctgtgacttttagtaacacctcactgggaagttttgagcccatggcggcagggcagggcctgcaagctcaggaggggccttggcttcttcctcaagctcccttctggatgtggggcttctgctgttttagaaaatgccattggtcagaggagtctcttgtgagctagatgcatgaactatggcgatggctttctcagagggtacagggaagtgcttgtctccctcagctcggtgagacagtcggggctgcagcaaggtggagaggagcctcttataagcaggcagcacagtggccagaggggagggggtgggggccaagaggtcgtgcaggtgcgttttacactgttgaggacaagggacaggtagatgttctacatctgtgttcttcatggcaattagaggtatcatgctcaaagtatgggcttaataaaagaagtatggagcggatgggtctgtaggagacacagctgtttctgagagaatgattcagagagagcattccttaattaggaagaaggtaagtatgtggttttccttttgcttattttttaaaaatcccagttgatgttttaggatttggggcccagttgtgtgcacacgtgtgtgtgtgcgtgtgtgtgtgtgtgtattgtgtaacaaccctcctagaacacatctgggcttccatatggaacgaaacaatgctgcctggagtcgtgtggcatccctttttcctgggatgtccactgaagtccaatcagggcagtcaggagacagcaggccgcccacctcaatgccagcctgtggagacggcactgcagcctgctctctggagggcaggcccgctcactccctgcagtgccctctggtgttcagagggagccacagccgcttcctccgtatctggagaaatccacctttagaatccagtctcagatgtaggtttccaaatactcaaaaatccatggccccatttggcctgtgtattcttcttctttttctccagaattctggtatctcccaggggagtgcaagccacctcctctctcttgagatcccttagattcgccctccctctatgcatctctcaagccttgctgaatccggcctctgctgatcccgttctagctcagcgtcctccgctagtcttactacgtcttctgccacgaagggtctctgggacacctcctgggttgggggtagctgtggtgaattaggtctaggtaggtcggcttgaactgcccacgttgggctgaagtgccagtgttgcccgagatgtgagtcttccgttgcctcccagggaagccagtgctcttacctaaagggagagcagcaggaggcagtttgtgctgacaagtggttgagatgaggcttgacagctgactgctcaaagaaagcatgaggaagagaggtcactctgctgtggaaccctggaaaggcrtcccggaggagggcaaccctgagtggaccttgagcaatgaatgggttgaatgtcgaatagaccttccagggaagggcatggtgaatgaataaccggcagccagaagccggggtgagaaaagggaaacacggggagatggatggaagggctgcgagccgtcgatgaaatacatggaaaggggccctgaggggtgtgcaaggcagttttaggaggacaactgtgtgaggaaagcaggactaattggctgctcagacctaaacaagtgaactctggggctggctgggaacttgctcagcaggaggaggaagaggctgctcctgagaaggatgtttcctgcggtgatcaaatgttctggggaaaacccaaagggcagctctgccctccccttgaacggggaaatgtggaacacatacccccagccagcagcagccaggaaatccagcagtgcccaaacaagtcctgtccatcgtgtgcagctgtggtctggccctgccgggtaggagacatgctgcagagcaggctgttccctccattcacttccatgctctctcctccctcccttgcttcttccaagcccctgccacacccttaacactgttgcccccttcggcttattttctgcctcctttccctyttcttccaaatctttcttctcgcataactgccctccacctttccttttcttggcctaactttgccctctgcctcctgctgtggggattttgcctccctgactgccctgtcctcactggcttttccttctgcctgctcctgaagacacgccaagttcatggcttgatttatgagagcaaatggtttaaattaatctctgagcaagcttactgactcctaaccttgaccttgggacaggtcgtctgtctgggtgctccaaattgacttggtgattcataatagaaaagcctcaggaccccaatgaatggatctctgaatggtgatcactaaatgtggcaaaatgagaaaaagaatgacaacagagttggtttctcacaaagctaaattgattctttaaaaaattctgggattatgtgattacgttctttctgttttttgggggtacgaaggtggaaagggtcaaaagaactataatttgtttttcttctgaaagcaamgctaataatttttagggaatgatgagacagtagatggtagcttggtagctttttgtatgtatgtatgcatgtatgtatgcatgtatgtatgtatgtatgtatgcatgtatgtatgtatgtatgtatgtatgtatttttagacagagtctctctctgtcgcccaggctggagtgcagtggtgagatctcggctcactgcaagccccgcctcccaggttcacgccattctcctgcctcagcctcctgagtagctgggactacaggcgcccaccgccatgcccagctaatttttttcttttttttgtatttttagtagagacggggtttcaccgtgttaaccagratggtctcaatctcctgacctygtgatcygcccaccttggcctcccaaagtgctgggattacaggcgtgagccactgcgcctggctgctttttggtttttattttattaaaattgtttaaaacactcttactttgcaaaataaaaagttgccagccctgtttttctcccagtcctgtgtctcgaagctgcttctttgtccgatgcagatataaataaggcgctcttaccttatgccgcttcaacaagtccctagctgcgctgagctatgattgcaccacttgccctccagcctgggtgacagagcgagaccttgtctcaaaaacgaaacaaaacaaacaggaaaacaagttcctagctgaacttacctcctctgtgagtgtaggggtgccaagtaggggccagatgctggggatacaagagaacagcagagacacaatttgcaacttaccatgcttctcagggagaagttttttccagcattctatgggagttccagttacttcctcaccaatgcttggtattgtcatgcttttcaattttagccattgtgaagtgatatcttctagcattttttccttactgcttctctaatttcagaatcttctagtattttaaatttgcatttctctgttggctaatgatgtggagcatcttacatacttattggccatatcatcttttgtgatgtgtttgttcaagcttttggccatttttaaattgggttgtttgccctttaatgattgattatgagtttttttctgtattttggatactagtcctttataaggtatctaatgaaatattttctttcagccagtggctcagcttttatttttcttaattgtgtcttttgaagatcagaagtttaatttcgataaaattcagtttatagatgtttttcttttatggttagtgctttttatgtcctgtttaagaagtttttgtccattctaaggtcatgaagatagtatcctatgttttcttttagaagcattatagtttagttttacttttaggtctatgatccatgaggaataaattttaaatgtggtataaagtaggggtctcccatgtggctatccagtgggtccagcaccatttgttgaaagatgatcctttcctcattaaattatgtcggtgcctttgtaaaaaatgaattgctggcygggcgtgctggctcacgcctgtaatcccagcactttgggaggctgaggcaggtggatcaccaggtcaagagatcragaccatcgtggctaacatggtgaaaccccttctctactaaaaatacaaaaattagctgggggtggtggcaggtgcctgtaatcccagctactcaggaggctgaggcaggagaatcacttgaacccagggggcagaggttgcagtgagccgagattgtgccactgcactccagcctggtgacagagcgagactctgtctcaaaaaaaaaaaaaaaaaaaaaaagaattgcctgtgtatgtatggaccaatcgctaggctcctttttttctgatcctttgtctatccttatggtctcaccactgtcttgattactgtaactttatggttagccttgaaattagataatttaagtttttcaactttgctgtttttcaagattgttttgggtatttaatgtcctttcaatttctrtataaatttagagtcatcctgttaatttttattaaaaaaatgtttaaagtgtgccggattatattgaatctataggttaatctggagagaagggatgtctagacaaggttgagtttttcaatttatgaacatagtatatctcttcgattatttaggtcttgctctcagtctgtgctgctgtaacacaatacctgagactgggtaatttgtaaagaacagaaattaattttttcactgttctggaggttcaagattgaggtaccagcagatttgatgtctgatgatggcctgttcctcataggcagtgctttctcatggcatccacatgtggcagaaggtggaaaggcaaaaggcactagggcattccctttgactttttttttttttaaataacagcacaaattcactcaggagagtggagccctcatgacttaaatcacttaggccccatctcttaatatcatcagttgggagtttaaatcccaacataggaattttgtagggacacacacattcacatcttagcagtctcctttaatttttctctgcaatgattttttttgtgtagatgcacaaattttgttacacttattacctagtatttaaagtttttggacgatattgcaaatggaagttttttttaaattttatgttttgtttgttgcttttayaaaatyagtttttatattttgatcttgtattcttcagccttgctaaattcacttattagttgtagtaatagtgttttttttttttttttgagggggcagattcctaaggattttcttcataagcagttatgacaccttcaaataaagacagcttttacttcttcctttgaaatctttatacattctgttttgtttttcttgttatcaaactggctaatataatcagtacaatattgaatagaactgatgggaatattttctttctgatcttagagggaattaattcattaagtatgatatagttgtgtgttcaacagcagcagtgcccaacctttttggcaccagggaccagtttcgtggaagacagtttttccatcgactagggtcagggggattgttttgggatgagtcagatgcattatgtttattatgcaccttatttctattattattgtattgtaatatataatgaaataattatataactcccataaggtagaatcagtgggagccctgagcttgttttcctgcagctagatagtcccatctaggggcgatgggagacagtgacagatcatcaggcattagattcccataaggagcacgcaacctggatccctcacatgtgcagttcacggtagggtttgggctcctgtgagaatctaatgctggctgctgatctgacaggaggcagagctcagttggtaatgtgagtgatggggagtggctgtagatacagatgaagcttcactcattggcccactgctcacctcctgctgtgcagcccagttcctaacaggccactgaccggactggtactggggccccctgtcctatagcatattgaagaagttctcatctatttttttagtgctgagagtttctacaatgaattggtttaaattttgtcagacagttttgctgtatattttaagatgaccatatggttcccccttaattctgttaacatgaggaattgcatggattgatttcaaatggtgagccaacctttcattcgtttgatgaatcccctttcttcatgacgtgttatcctgtttcacatccagtgctagatctatttgctcatattttgttaaagattttaatgtttatgttaagagtgttaggtttctaattttcttctctttaatgcttttgttagattttgatgtcagggttatgctagatccaacaaaatatggtggtgttttctaaagagcttatataaaattggtattatttcttcctaaaatgtttggcagatttcatcagtgaagcttactagacttgaagcttttcatgtggaaaagatttatatataaaattcaacttttaaaataaaaaaacggattttctatttcttcttgaattagtttggtaaatcagtttttcatggaacttatccgtgtatttaagttggtcaaatttagttacacaaagttgtttataacatttccttattatacttttaatatctgtggaatctgtagttgtaaaccttctattatttctaatattgataatttgtttctttttattttcttgattaatctagctagagattttcttattttgactaatttgtctattatatattaattattattatattatatattattatattattaatctttcaaagatccaacttttgcctttgttgttttactttttatatttttcttttctattttattgatttctgcccttatttttattatgtcttgtcatttaatgactgggtctaatttgctcttcttttactagcatcttaatatggaagcttagctcatgattttctaatacaaaatttaaaatataaattttccttcaagaactgtttttgctgtactcctcagattttgatatattgttttttattaccgctagttaaaaatatttattttttgatccatgggttatttaaaagtattttatttaatttccaaatatggtggtgtgtttttcaatactttattgttgctaatttcaatataatttcattatattgaaattggtcatagaatataatctctaagatttcaaaatcttgacatttatttacttttttatccagtctctgtttatccatgtttacatttttatggcccacaatttggtctgtctttgtgaatattctgtgtgcatttgagaagaatgtatgctctgcagttctggaatgtaatagtttattatttccaactaggtcatattggttcttacagttttccaaatcctctatatcttcatttgtctttttcctacttgtttttatcaattactgagagaacataaaaatcactgactaagattgtggattagcctatttctccctttagttctatccatttttgcttcatatattatgaagttctgtagatgcatccctcttaagcattcttatgtcttgatgaatctattcttttgtcattatcaaataacctcctttattttttatttatttattttttgagataggatctcactgtgtcgcccaggcctggagtgaagtggcacaatcatggctcactacagccttggcctcctaggctcaggtgattctcccacctcagcctcccacctagctgagactagaggtgtgtgccaccatgtccaactaatttttgtggagatggagttttgctatgttgcccaggctggtcatgaattcctgggctcaagcgatcctcccacctcagcctcccaaaatgctgggattacaggtgtgagccaccgcacccagccacctcctttatttttggtaacattcctcatcttaggctgtctctagtcctatctaagcttggcaacaatggaccaagataacaaactaagaattacagtcagttattcactcattcaacatatatggtatctactatcatttatccaagcagagggatcaaattagtgaaagaaaacaggtaaaaatcctttccctgcttcccctaagtgaagagtaatcttttatgtttatttatttattttttgagacagggtctcactctgtcttccaggctggagtgcagcggtatgatcatggctcattgcagccttgacttcctgggctcaggtgatcctcccatctcagccttccaggtagctgagactacagttgtgcaccaccatgcctaactgattttttgtattttttgtagagatggggttttgccatgtttcacaggctggtcacaaactcttgggctcaagygatcttcctatctgggcttcccaaagtgctgatattacgggcatgaagccacctcactggccttgtttggtattaatacacctatatcaactttcttattttgactaatttgtctattagatctttcttctcaacctatctatctaaattaaaagtgcgtctcttgaaaacaacatactaattgaattttgctttttaaaatctaaaggtgacaatctccatttaatgtaattattgatatggttggggttaaagctattcttctgttattcattttatctgctgtcttctttgttacttgttctgttgttaattcttttttgtcttttggttcaactgagtttttcttttttttcttttttttagtactatatctctttattggccttttcaytgtatttcttcatattactattttagtggttgctctagacttatcacagtacactttgattgaataatataacatttcatgtacaacrtactttttccataatttgtacatttgttgtcatacagtttacttctacataagaagagagaaattccacaaggtattgctattatttttgctttaaacagtcatttgtcttatatggaatttaaaaagtgaactgaaagtggtgatttatatttacctacatatttataattttcagtgctcttccttcttatatatctgaatttccatattatatcatttcccttcagcctaaagaacttcttttagtgcagggctggatgacaacacatttctaagatttcatttatctgaaaatgtctctattctgccttcatttactgaatatagaattctaggttgacgggtttgtttttaaatttcatcactttaagtatgtttcttagtctttggcttgtgttatttctgatgaccagtcagccgccatttttattgttgttttcctgtatgcatttccccccttctawtggatgctttaacagtttttctttagttttcagaagcttgagtatatgcttttgtgtaattttcttcctaccttttctattttggattcatagtttcctggatttgtgggttgattttctgatcaaattgagaaaaatttcagttattatttccttaatttttttctgtttcattttgttttactgtctttctgaaactctaattacacgtacattcacgtgttgcttaacaatggggatatgttctaagaaatgcatcgttaggtgatttttgttgtgcaaagatcgtggagtgcacatacgcaaatccagatggtatggtctactayacaactaggttatgtggtataacctgttactcccaggtgacaaacctgtatggcatgttactgtgctgaatactgtaggcaactgtaacacaatgattagcatttgtatatctaaacacatgtaaacatagaaaaggtacagtaaaaaatatataaaggataaaaatgacatactgtatagggcacttaccaagaatggagcttataggactggaagttgctcttggtgagtcagagagtgagtggtgggtcaatgcgaagacctaggacattgctatagtctataaacattgtacacttaggctaccctaaatttactacaaaatatttttctttcttcaataataaattaactttagctcactgtaacttttttacttataaagttttaaaattttaaaagctttttgattcttgtaataacacttagcttaaaacacaaacacattgtacagctgtacaaaaatattttttctttatatcctcattctaaaagctttttcctatttttgaaatttttaatttgtttaacttcttttttttttttttcgagacagggtctcattcgtcacccaggctggagtgcagaggcattatcatagctcrttgcagcttaaactcctgggatcaactgatcctcctgcctcagcctcccaaacaggtggaactataggcatttttttatctttaaacttttttgttaaaaatgaaaactcagcacgcacagtagtctaggcctacgcagggctggaataatcaatatcagtcttctgcctccacatcttgttccactggaaagtcttcaggggaaataacactcatggagatgtcgtcttctgtgataacaatgccttcttctggaatactcctgcaggacctacccgaggctgttttacagttaactttttatatttttaataagtagaaggagtatctctaaagtattcataaaccagtaacatacattatcatcaagtacataattgcatgtgctatacttttacatgactggcagcacagtaggtttgtttayacctgcatcaccacaaacatgggagtaatgtgttgtgctatgaagtcaccaggtgataggaatttttctgttccattataattttatgggactgttgtcatacatgcagtctgttgttgactgaaacattgttttttggcccatgactgtttattattaaaccattgatactgttccactggtccctggggctccctatttatattttttacatctttattcctctctatgcttcagtttgggtaatttctatygatctgtcttaaaattcaaggatcttttcttttcttgtgtcctgtctgcagttaatccaatccagtgagtttttgatttagagtattgtgttttctagttctaagatttccatttgatttttttcctaaagtttccagattgttcctaaaattccctgtctatttttccattatatctgtcatttcctctagactctttaacatatttatcatagttattttaaagttcctgcctgctacactagtcacaatagcaaagacttggaaccaacccatatgtccaacaatgatagactggattaagaaaatgtggcacatatacaccatggaatactatgcagccataaaaaatgatgagttcttgtcctttgtagggayatggatgaaactggaaatcatcattctcagtaaactatcgcaaggacaaaaaaccaaacaccgcatgttctcactcatagatgggaattgaacaatgagaacacatggacacaggaaggggaacatcacactctggggactggtgtggggtggggggagtggggagggatagcattaggagatatacgtaatgctaaatgacgagttaatgggtgcagcacaccagcatggcacatgtatacataygtaactaacctgcacattgtgcacatgtaccctaaaacttaaagtataataaaaaaaaagttcctgcctgctaattgcaatactggggccatttctgtgtctgtttatattaagtgataattctcttggtatagatcaaatttttctatttctttgcatgaaatttttttttactgtgtattagacattggtggaagatatgttgaagagactcttaattctgttgtttctttataataaaggttaagtttggttctagaatgtggttagattattggtggttcattttgaactatagaagtcttgatttttaaactacattagggaaggtctatttcagcatttttcttagccctaggctgaatattttagtcctgagacacagtgtttactgtgaaggcttgtcccttatgaagttccagtagaaacccaggtgtttacccagcccctccaactcgttagaattcagacrgcaaactctctcccrtgtggtgtgtggtaactgaaatttctgctcaggtgtttgagctttccagctgtygttttgtctctgggctccttgtaggctctcctatagatgtataattaagggatcaaccaaagagttcagaggagtttatttgcagatttaggggcttcttgtttctgacttcctcttttctgacattttccctttagtttccagctattctagcagttccaaactgtctgctgagtcctcaggcagatacaactacagttttctgcttgagttctggctgtccagtgccatacagacggccctcatgggaaaagccatttaaacatgaatcttgtccattatggttccttttttcaaggatcaaataatctagactttattcttgattttggtcttcttccagtgcttttgaacagttggctttaaatatttcgttaattgtttataatcatcatctgcaggaaggttagtccaatacaagccactgtgccgtaactacagccagaacctcatcaaaagtttctaagctgaggagkcacaagagtagacgtaggctttaagaaggtcattctggcagatgtgtggtaacctgtagcaggggagcaagaatgaaggtaggaagacaaaataagactattaccagagtccctggtagatgatggttatttagactcaatgatgaaagaggagactggtcatgacaagcaatggatgagtttgagatacatttttggcaagatttggtgataagcaggggatgagaaaaaaggggaagtcaaggataactctcagatttcttktttgaaagactgggtgattaacrccacttaccaaaatagggaataccagagaaagatgagatttgggacaaaaatcaaatttccttttggatgcaagtctcaagatgacaatagaataattgtccagtaaacaattgaatttgtaagtctgaagctcagggaaaaggtctcatttaataggwctggctgctacaacttgagtgagatgtgcacatgcagagtgaaggaatgctacctaggggactgagaactgacaaaagctggttggagytggaygttgactttcygaattctaggtgaaactactggatragagagatgagaggccagcaaaatcagcctacttacaattgggatgttttaaggaggttaactatggctgcttttyccccctctggatgcagggttacaaggaagaaaataacacaggtgaatgttgtgggagatgtttgcctacggcttgcaccattcagctaagaggaggacagatcatgacactgaaggtaggagcaagctgaatgcagggctccctcacatatcaccatcttgcttccttttttggaaatttttcttcaaggaagaggggctaagtttggttcagtattggcttctttttctatttctttctgattatataaagaaaagatagatgacttattgcaggcacagaattttctcttttatttagttattttgttgctcttcttgacaagagtgtacttggtgtagggcctcacaatttggagttgattgatcttttttttttctttcttgagatggagtctcgctctgttgccaggctggagtgcaatgtcacgatctcggctcactgcaacctccgcctcctgggttcaagcgatttccctgtctcagcctcccgagtagctgggactgcaggcacgtgccaccacacccagctaatttttgtagttttagtagagatgggatttcatcatgttggccaggatggtctcgatctcttgacctcgtgatccgcccacctcggcctcccaaagtgctgggattacaggtgtgagccaccgtgcctggcctggaggtggttgatctttaagattttctctacccttgggcgtctgtaagactggacaggccatcagcgtgaaacaaactctggtctatgaagtccggactagctggtggggctgggaggtagttcccttcgttcatctctagttcagttatcagctagccagtttrctgttgctatatctcaatccttcaagcatttaactggtcggaagagtctacatagcagccctgttcataggatacaagctgtaaaactgggactccacttctggtctgtgttctgggtgtgggggctttattatacactgtcttcttgtttcatggttctgcagattgtttcgtcatctccatggagtcaagctcatggtttgaagtggctttgtgaaccaaacactgtctctgactttacccactcctctttccttccagcgtgatgagacgctccaggatggctgtgatactcacttctgcaaggtcaatgagagaggagagtacttctgggagaagagggtcacaggctgcccaccctttgatgaacacaagtgtctggctgagrgagtgagtactcattctgctttcctctttactgtctcaatctctaagaacaagattcttctgaatagygtgcatcccagctccggcataatttctcagtgtctgaggcacatctctggcctagttgaagaatcagtgagattacgaaatcaaagcctacggagagataaaattctctgcaatataggatgttttaaaaaaatattttccttaagggaggctgagtgtgtgattcttgaataaaatgtgagatcaaactgatttttagtctccctgggaatgaagatcctgatgactcaactggaagagaattcagaatcatcaaaattgtttcagcctggtcaggtagggtggtcaagctgctcacatttatgataggaaagcatagtttacatctgggcacttaagcacagggctgtgagttcggagctaaaaattggcccggagtgacctgaaagctgtctactctgtactgtttgtgcctaacctgmaattttgctgttttcttagggtaaaattatgaaaattccaggcacctgctgtgacacatgtgagtgcgttactaatatcttgtcccttgaaacccatcagagcaagtcyaggggctctttgcagcttgctccttgaaacccattagcaagccgcatgactgttctttggagtaagctttatttcagaaagatatttcgtgaccactggtcagtcattatgttcagtcttgcagggagcagcctcccctccttggatgtcatcagactgccctcttgaactcccttttagatcccatggagcaatctctttccccttttcctgcaaactccctcctgtctccagcttcttatgtgccttttccctcataggatctttgattgctcatagtcctatcctgggacgatatgttccctctctaaccaaagcttcttgaagacaggcaccttggatctatgatcctgacagagtagactctcaacacatatctattcatgagtgtgctaaagctatctcaaagagaaagcgaagccaccagctggctgacaacagcccacatgtgctgtgggggctggtctaagtttatcaccccctcttcttcactctgagctcctctttacctcgtagttatgtcctactgattggttctcattgctcacagcagcagctttggagacgagacacaaatctgcacatcagacagtgttcttcccatacatgcttgtgtttgtgagcacaaataactttcaggatcccaatgctaatgccataatttctgaatatagaattacttgcctggactaagattttttgttttagattagggtatttcttttctgccctgggttcacaggtccatgcttgtttacagatagagaaaggaagagtgaaaacatgaatactttcagtgttcaatcattcattcttgacagcccctgcaattgctgtaaccaaatctcagatcgaggaagcactctgaaagcatgtctttctatgattcccatttgaatggtttaagaatgtgaagtcaggaaaccatcagagaagaagaattctctctaggcacactgcacgtggaatttgattaggagactgttacctacaaaaccaccacaaagggtctttgttggtcaactcattcaagaggcttcgagatctttaataaggacaataagccaggctcagggccttaaatccacagcaacatagtatagtatgctggtctaaatgttttttttttttaattcatcctcttaatgtaattggcaggctttccctttacaatgaaattatctagaaattaggaggcagactaatatgtagttagggttgatttagatttcgagccatctaaggacagaaaactcccagtgttcagactggaatggtgagctgggattaaatttttgaattcccagtgggccaagtagagattcagatctgaatgccactaacccctgtgtgaaaggaaacccccatgtcagcaacctggagtcagcagtacccgaagagaggccttcacaaaggtgcctagggatcttctcggtccccagagaggcagggtatgcccttacatcaccatkacttcgcctttcctcttaccccaaggcaggaatgaagagatagtaattatacttattgactacttcattgcccattagcttctgaatgtagttacaagcacaagagggttgctttagccatgtggtttttagagtctacaatgatacaaaggcaagtcttcctcattttacatcaccatagcacagtgaatttaggctcttcctgcaattaaaattgtaccattaagtgagttaagtccagcaataactatatctctgcatatttcgggccaggaacagctgaggtgaaccaggataactgaattccctccctgtggctggctttatttggttactgtgaaagggacctatttccagcccagtgagggcactggggctgaagagtgttctctagaaccccagccagtcctcaagtttcatctctcacctgtcctgtaggtgaggagcctgagtgcaacgacatcactgccaggctgcagtatgtcaaggtgggaagctgtaagtctgaagtagaggtggatatccactactgccaggtaagggctctgcttcaataagggctgggtgyggagggytgagcctccgtgttcggatacctatccttagttacattctagaaggatctggaaaattcgcagggaagagaagggaaataaactggaagcatttttttttaagcaaatgttttattgaagtaactggaaatttttgactccaggaaaaaaacaaaaatggaggaaagactcagcaantcctttacagaaaatggagagttatttatgcaagatgggggccacaattcttgaagatcagtcaaacatatataaaattttcctgcataaaacatgcataatcaggcataaaacattttatgcattaacatgcataaaaattgcagctagaggggtgtgggtatgatattattaccatagagaagaggacatgtcagacctatgatcttcctttacaaattgcctagctgtcctgggtgcttctgggtgagatcagacctgccttgcttggagggggtcagggagaaagcaggctgccccagagccctgcctaagccaggacttcccaccatygtgaagctcccatcttcctctgctttcttgcagggcaaatgkgccagcaaagccatgtactccattgacatcaacgatgtgcaggaccagwrctccygctgctctccgacacggacggagcccatgcaggtggccctgcactgcaccaatggctctgttgtktaccatgaggttctcaatgccatggagtrcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaaggctgctggtgcactgtgtcgtagggctgagatggcaacggtgggcaggggctgagttctgagacyggttctgaggaaggaagcacaggccccatctgcaagcctcagtgtcagtgtgagatactgccaacytctggggaagagtgatgtctttgcctccaggggtgggaaaggcatagcatggggtaggcctcttctgaaactcagcacaaagtaaaagggattttcccagcaacactggattctccagtctctgaatggaggggcttctgaacatagcagaggggtgggtcctggagccaggctcctgctgagatagatactattgttgtcacatggctggcagtgtggagaaggtgtctgaccaggtgtgcaaggatttctctgagcccgtggctcacagggttcctgtgtacccatagtggcccctgtgggagggagaggtgctgacgactgatggggacctggaaacagggtgctggcaggtgcagtagtgtggtcacccaactcagcctgaggccatgagccccagatttggaggcagacctgggctccacacatggccctcgctcagctgtgtggcctcaaacaagccccttggtggttctcagactcagtttcctcatctggaaaacaggagtgttgttctcactcataaggtggtaaggataaacaacctcagcctaaaatagggcctgcaagtccttaggtaactgtaaattgctctgtaatcatgtaagaagtggcgagaataacaatggggagatcaaggctttcggtagggaataagagactctaatgttaacagcagagcattagagatttcctttgtggtgagggctggaccggctgggtttctatcaggctttatgcttgatgccaaggtcctacatactccagacatccttcagtggaagaggaagtggtgtagataacaccaaacatcatccagtccccaaatcactaactggtactgtcacttgcagttagagatggtccttccttaaaatgtatggaagaattttcatgtacatgctggcaagatggtggggactcttgctggggagaatacccatgagaaagaaggggatgtcctggattacaagaatttgatgaagaattgattttcattccaaatacttttgacacaggagagactcagctcattgaaagtactggataatggaatcaaaagggacttagacatcatctagtccactgtccctcctccactcctttacaagtgatgaaagcagctcagagaattcaagtgacttgccaaaggtcataactgctgggtggcagggccaggttcagaacccaggtgacttgacacctgcataagaactcccaggccaccccatcagagccacaccatccctgttgcttacactcctcccgtgctgacatggggaccagtgactgctgcacccttaagttcccaccacttctgttactgcctgagcttaaccttaagagaagccacattacaggaaaatggcatagattatgctgagtaggcttggtggggagtttagtggggcagaagggaggaagaatggatagaagttttatgtaactactcagtaattcaaaggttactgtctctccatccatcaccccactcccaactttgggtagcctctaaggtctctcttggtaggaaaccagatccagggacagggaattaactgtcactcttctgactgatcgcctaacactctagctggggacaaggtgttattggaggcatcagctctggagaaattcagcaggaaggctaggctaccactgcagcataggtggttgattttccaactgcctgtgtcttgctagcttgaacttctcatgtttactgatatgtcattttaccgtcaagaaaaaagctgaatcggaaaactgcatgttttgattattttaaaaaaacccaaaacgatggaagagagctgggtaaaaaggatgcaagaagagaaacttgtggggctagtgtgtgcggagcggtgtctcggcagtcttcttttatttacaggtattccaaaggcactatctgtacctggtttcagggaccctcttttttactcaccctcagaccaggcaagacagagtgccccaaagtggatgttttaaggggagtctcaaggaaggagtatatagacactaagaaactgctggagggaaagaagaaagggaatgaatgaaagagcaatggtgaccatttttcaatcgtttggggattgaaaagacataacggtccctggaagtagacagggagaaaggggttgttagggacagaaaggagcagaatagcagagtgttatgccacagactccagggcaggctgcctgctttggaatcctaggatcctcttagaggcaagttacttgccatttaacactgcagttctctcatctgtaaaatgggcacactgcagtgattgcctcatatacttattgttaggattaaaataactaccatagggaaagcactgagaagggtgttgggtggagaggaagtcctgtagaagcattagctggtagtacttgcagtggatggaataaaggcctgggttgggacatcacatcttgtggttttccttctgctctgccctcgactgtggtgtcacttactcccctttgcttccccaggctccttctctataaagtgggatctatcatgaccagcctaccttatcaatataggagagaaaatcttcatgcctgaaggtcagtgatcacaaatggcatacttgaccttaacatagtacttcttcattttgggggtccatggtattaatgaacttgttttacttctgtgcatcttggagttgcagattccatcgtgcagaagggccctttggaggtcttccctcccatccccctgcccaggtccgtgaactgtcccggggagctggcactcctcttcccctctggggatggagcttccatcatctactccctcaaccttccttaaccctcctagcgtctcatgggagagctcttataaaatggacccctcctcctgcctctggcagcccctcctgttttgcggtcccttgtgcacttactacctgcctcttctcccttttgttctgcttaacctaggggaaggtgaggacagctggtctccacctagtatggagacaggtgtgggagatccgccgtccaggggctcgcccccactcccgccccagggctaactcttgggcagtggatgaccctttggggcggcgggaagaaggttttgctggcaggattggaaactaatcagccagacagttcatgagataatccggctgaatttttacactcgaagcaggttgtggggcgttgccccggctctgggggagcagggagcgtttactgtctcgcccctcagccccacggacccgagtgtgtcctggactcaacccggccgcgggaccgcgctccattctcgacgccccgctcccagcacccgggcgcccagggcgcagcggggagagctgggctgtggctgcgcggcgccggcggccgggagggatgggggaggaggaggcggcagccggcgaggggcgggcgcgccgggacggagctgagccgcgatggaattagccccgcggcggcataagcctgcccagaagcgcgcggccgcgggccggcggggtccgcgtccacatcatggcgactcccgggccgcgcggtgagttttccggctggacctggtcctggtctcctacaggtggtaggagggagggagtgaaggaggcggcatccgaactcccactcttcgggattggggacccccaagggagcctgggcagggtggtgcgggaagttgaccccgtttttccagggtagggactctgagggacgtctatgtaatttccgagacgttttttgttttttgttttgttttgttttttttttaactcaaggagagggaaggtaggacaacagaggtttgggcggccgcttctctgtgattggttaccaatccccacctctgtgatgttgcctctccttgttacaagtcctggggacgtttagcctacagcatctgaaggtaagtaaacaataagtaaacaaccagccggactgggtttaactcagcaacggtccgctgaggacagagcaaatttgactttggcatccctggagtggcctctcagtttcagaagttttttccagtgtcttacccaaaaccgcattcaggaagggttccaagatcaggcatttacaccccaggctgcagggaaacacagctataccttcccgagggacttttcttagaagaaaagcaaattgaggtggagtatggagaagaaagacgttattttattgcttttgggcaggactgactttgcctgggacagggactttgtcggctgttgtgtttctggtaattcttgagacaggcatgaagagggaggtgcccgctcctttggcatgaacaatgagctgagtgcactgggaggtggtgtcagtcacagtcctgatactttgtgagcagatgtggagaaataccaccccgggaccatgtggaacctcgtctgggacagaaggtcccactgagcaaggtcgggtctcagcccaaaggcaggtggcaggtggagggaggatcttagacaaggtgaaggtgcttccagaggactgtggtcctcttggccctccacctgccgagcctttgtccttggaacctggcatcagagcccctgcccagtctctctgtcaccctggctcagctgctgggcatccagggctcatttgctcctctcagtgtgtcttaacgtgcacccgtcatttccggagccaagcacctgattcgatcctttccagcaactgcttctgctgtctgagttgcctctatgtgggtaccagagccactctgctggttgactgtagagactgtgtgaggggtaagggtgggatccaaacacacacctcaagttctagtccagtttccaggtgtgccatctcttcatcttccattgtggggcaaggctgcagggtgagaggcatttgggcctactggggagtgtgtctataattttctgtaacaaagacctaattttctggaaagctacccattctgtgggctgagagaagcccatcccaccctatgtatgacgttgctagagcacatgcatagcaggtatttggctgctagggacggtgttattgtctctagtacacggtataatccatctgtattgtttaaaaattgttttaaaaatgtcagtagtttttagggtacggggttttgcttttggttacatgggtaagttctttggtggtgaattctgagattttagtgcctcctcacccgagcagtgtacattgtacccagtatgtaatcttttatcccttatccctcctcccacccttacccgctgagtccccaaagtccatgatatcattcttatgtctttgcatcctcatagcataactcccacttatgaatgagaacatatgatatttagttacccattcctgagttacttcacttacaataatggcctctagctccatccaatttgctgcaaaagacttattttgtttcttttcatggccgagtagtattacacacacacacacacacacacacacacacacaaacacacactcaaacacagacatcccacattttctttattcactttttagttaatgggcatttaagttggttccctatctttgcaattgtgaattgagctgctataaacatacatgtgcatgtgtcttttttatataatgacttcattttctttaggtagatgcccagtagtgggattgctggatctaatggtgttctacttttagttctttaaagactctccatactgtttttctatagtggttgtactagtttacattctcagcagcagtgttaaagtgttcccttttcatcacatccatgccgacatctagtaaaatttttgactttttagttatagccattcttgcagcagtaaggtgggttatctcattgtggttttaatttgcatttccctgatgattagtgatgctgaacattttttcatatgtttgttggctgtttatatatcttcttttgagaaacgtctattctccatcactattcgtaactaagtggttagcgaaggcctctcttaggagatgaatttgaacagagattgcattaaatgaaggaacaagccatgcagatatctggaggattgtctagcaaaggaagtaaaggca

SEQ ID NO: 17645 - DNA, 103660 bp, Homo sapiens
  misc_feature (1)...(103660): n = A,T,C or G, or insertion/deletion polymorphism (see Tables 1-2)
gaccctgtcaaaaataaataaataaataaaaaggaaactgtaactataaaggtagtctgtctctttgtaggaaggctgaaaatacttgtttgtacatagtgctagaagagccttactgttggaatttacagagggagaagctgagatatttgctcaaagttgcttgctactcaatgggaatggtgtttgggctgaaacgcaagttttttgggggcaaaaaacttgcggtgagcactgtagcctcgacctccatggctcaggtgatcctcctgcctcagcctccccagtagctgggactaaaggcatacttcatcatcacacctggctaattttttttatttgtggagacgaggtcttgccgtgttgcccaggctggtctcctgaactcaagcgatcctccctccttggcctcccagagtgctgggattccaggcatgagacaccatgcctggcctactttatatattttcaatgtactatttctgcattacatattttatgtactttttaatatcaatagtatgtctgtattagaaataacaatgtaaaagtgaaataagcactgggagcgtccaaagctattttaaaggtgttgggggtggccaggtgcagtggctctcgcctgtaatcccagcaccttgggaagctgaggcgggtggatcgacttgaggccaggagtttgagaccagcttgggcaacatggtaaaaccccgtctctactaaaaatacaaaaagttagctaggcatggtggtgcacccctgtaatcccaggtacttgggaggctgaggcacgagaatcacttgaacccacgaggtggaggttgctctgtctcaaaaaaaaaagaaaaaagcgtttaggagaagctgcggctgataaattacaaatagatgggttttcgtctgacctgctaatcttccactagatggcgtcattgtcaagtgtctgtaatttcaaaagcgctagggaggaaagactgcccattaattgtttatgccttaacactttatttttattttcgcttgtttttcttttgagtcacttgaaattaaagaaaaaaaagctgaggccaggcacagcggctcactcctgtaatcccagcactttgggaggccagtgaggaaggatcgcgtgagcccaggaattcaagactagcctgagcaatatagtgagacctcgtctctgcaagaaatacaaaaaattagccaggtgtggtggcgcacacctgtagtctcatctactcaggaggctgaggtgggaggattacctgagcctgggagatgaaggttacagtgagtacagtgagccgagatcacaccactgcactccagcctgggctacagagcaagactctgtctcaaacaaacaaacaaacaaaacaaacagacaagaaacaagttgaagttcccttcagaaataccctcctgcttcaagcctatagagggtaaaccaaatgaggtgctcgttaaaagaatttagtccttacatgaaaaataccatcaaatgtatgtagagtttcttttagtcctgcagaaatgcatacctgataccttgattatcacagagaaaaatgtttttggctactttaaaatgttccataattctgagcaggctggcagtcctaccttttcaccatcaaaaaccccccattatttttattatgtatttatttattttatgttttgaggcagggtctcgctctgttgcccaggctggagtgcagtggcacaaccatggctcactacagccttgaactccagggcctcatcctcccaactcagcctccctaatagctgggactacaggcatgcaccaccaagcccagctaattgttttgttttgttttgttttgttgtttgtttgttttagtgatggagtctcactatgctgcccaggccagtctcaaactcctggactcatgtgatcctcctgcctctgcctcccaaagtgttgtgattataggcatgagccaacactcctggccccttcattatttgtattttataaatctcattattgggaatattttatccaaaatagcattaactaagtagtcaatgatttttctatttgtatttatatgtatatttgattaattaaagtccccagtagataagggacaaccttgctaaattgataaaactccatccctgccgggcgcagtgactaattcctgtaatcccagcactttgggaggccaaggcgggtggatcacttgaggtcaggagttcgagaccatcctggccaacatggtaaaaccccatctctactaaaaatacaaaagtaagctgggcatggtggcaggtgcctgtaatcccagctactcagcaggctgaggaagaaaattgcttgaacccaggaggtggaggttgcagtgagctgagatcacaccactgcactccagcctgggtgacagagcaagactctgtctgtctcaaaaaaaagagagagagagagagagaatgcatctccttccttcttgaaatgcccagattgccgtggtcatatcattgatgagctaagtaatgggattcttgggcttataagtttacagtggctgaagcctccactgtatggggcagtttttgtgaaatcctctagtaccggaatggcaccatggaagtggaaggaatagagtggaatgtcattgagtcttcctcattcaaaaaaaagagcccctttgcagatatagctgtccatatccatgggttccagattcatggattcaaccaaccgtggatagaaaatattcagaaaaaaattccacagtttcaaaagttgaaacttgaattttccacgtgctgagtactatgttgaatcccccacaaacgaaatgatgtgcagcatcttatgtggttttataagtaatctatagatgatttttttttttacttctccttatggagcagagctaactcataggcagtacacctagagttggccataagtaatctagagattattttaaatatacagaagggtgtacctaggttatatgctaatactatgccattttacagaaaagacttgagcatcctgagattttggtatctgtgggggtctggtacaatcccccatggatatcgagggacaacagtattcacaaagaaaaaagtttaattacaccaacagcacatgtaattaagtctccaagactccatctccgatgaggtgaatttaaagaatgcgttattatgattttggtagttggtcagaatttcgtatctggatagctgagagccagacctactagcaagtagctttgtgttgaccatggacaagtggaactgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttcctattggccgggcgcagtggctcacgcctgtaatcccagcactttgggaggccaaggcgggtggatcatctgaggttgggagttcaagaccagcctgtccaacatggagaaacactgtccctactaaaaatacaaaatgagccgggcatggtggcccatgcctgtaattccagctactcgcggaggctgaggcaggagaatcacttgaacctgggaggcggaggttgcagcgagtggagatcgcaccattgcactccagcctgggcaacaagagcgaaattccatctcaaaaaaaaaaaaacgtatttcctaccttggtggcttctatgggttcctgggaaggtgggatggtttttgcagttgtattttgctagaggtgacagtggggaggaagtgcatggarggtaaagctgggggtttttttgtttgtttgtttttgttttctttgagatggagttttgctcttgctacccaggctggagtgcagtggtgtgatgttagctcactgcaacctctacctcccgggttcaagcaattctcctgcctcagcctccctagtagctgggattacaggcacctgccaccaggcccggctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaccataaaactcacccattataagtgtacaattaattcagggtctcttagttaggcttgcacataaaatacaggatatccagttaaatgtgaattccaggctgggcacagtggctcacacctgtaatcccagcactttgggaggcctaggcaggcagatcagttgaggtcaggagttcgagaccagcctggccaaagtggtgaaacccccgcccctactaaacatacaaaaattagctgggtttgtgttgcgtacctgtaattccaactacttgggagactgaggcaggacaatcgcttgaaccagggaggcggaagctgcagtgagctgagatcgcgcacctgtaattccaactacttgggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggtctcgaactcccaacctcaggtgatccacctgcctcagcctcccgaagtgctgggattacaggcgtgagccactgcgcccagcccagcaaatactttcttagtgtaagtatatcccatgcaatatgcaaggatgtcccatctgagacatacttatattaaaaatagtatttattgcttatctgaaatttaaatgggcatcctgtatctttattgacgaaattcgggaaccctacaatttgtgaagacagagttgtacaagcatcaccacgatccagttgagcacattttcttcacccccaaaagttccctcttgcccaatggcagtcgtcctccgatccctctccaagtcccaggcaacctctggtcggcatcctgtctctatagatttggagaagactgtatttttaagtggagagacttggctgttacataactgtttagcacccgagtatttgcatgaagagtttcatttcattttttcaagtggaaccatggaggagagtggctgcccaaggtggggtttgtcttttgctgtctgagtggcccctgggatgcaggtatgtccattatttaaatctcttggtgtttacagaccacatgggtaacccctgttgtggcaaggctgagggcctcttcacctgtcactgagtgtggggactcttttcaggcctgggcagggcaggaagtctggaggggatatcaggtgatcagagggccattcgagaatgctgcaggctacagtgacaaaatgctggtcctgggctatctgagaccagtcctggaatgacttaactaaattaaatcttatgaatcaaggtgcctagcaccgtgcctgttgcctaaagtgtagctggaaaatagtctcccacgaatccagagtgacatttgctccatacccagttgggcctaagcctctagatctagagatatccatgaagaatggctcttgctttaagaacttaattctttagtgactaatgtttctagagcattaaccgcaggcaagcattttctaagagctttacatatgttaatgtccaatcctcacagacacactgtgaggcagatgctcgcattctctccatcttgcctatgaagaaatcaaggctcagagaagttaagcaaatcccctgaggtcacacagctagtctgggcctagaagagccttttctcctactattactctgtgttgcttcataatatggtgtaagttctgtgggagcccagaaagcaaggcatctgagctactgggaaggagggatgagacaagtaccctgaggagttagctgaccaaggaagcagggaacagcatttcaagcagaaggaacagcacatgcaagggttacaggcaagagaccgtggcctgcataaagagtggctgatgacgtttgggataaacgacttcccagaacatttcaaaaaaactcaaatgttttctttggggaaaatagtctgattttggcaagagaaagaatctcagaagagagccttgagaccttcaggagctattgttaacttggtgaattgtctctggtgcatctctctccctcacaaggcctgtttgttcttctgtgataaaagggctaatagcacctgtgctgtgggctcatttaatagaacacagtcgtgtgtagggcgtaatagaagagaatggaatggaataatgtaggtggcatgcatcgagagcttcgcatgtggtggccacccaggtgtggcacagccctgggccccgacgcatccgctcgggcacccatgccttactgacacattgaagaggagctgggaatttgttttccatctggcagagccccttccgtcttcctctacctgcggttctgggggctcagtctggagaggcgccaggcggctaactgactctggcattgggaatgcgtttgcagggagccaggggaagggagaagtcttactgccggctccctccaggctcccttcctcgtgatttatcactatggaaactgagctcctttcctcttcgcgctgccggctggtgggggtgcacattgttgatgccgttgccccacagatcagaagttccttcctctttcctgctgcagaaatgccacagtaacctacgtggcccaagaactgcagctcacacctgaagagcccagtcttgggaaaaacaatctcatcggattccccaggggttacgggggccttctgggtaagcagagccggcctgagaacaatgtcaggggagaacaatgcagccagcgggctgagctggtggccctgctgttcctcttccttcagcttccctagttgggggttaaaaatggatttacaggcagtcgcaagtatatcatgttaggcggcagaaaactgaaactcagagtctcttagtgtgggcaaagtctcccgcgacaacccacttgctgcaggtgcccagccctgcatatgcccacccatgacatatgcccacccactgcatttgcccactcactgcatatgcctacccatcacatatgcccacccactgcatatgcccacccactgcatatgcccacccactgcgtatgcccaccccctgcacatgcccacccactgcacatgcccacccactgtgtatgcccacccactgcgtatgcccacccactgcacatgcccatccactgcacatgcccatccactgcgtatgcccacccacagcatatgcccacccactgcacatgcccacccactgcacatgcccacccactgcatatgcccacccactgcacatgcccatccactgcatgtgcccactcactgcatatgcccactcatgacatatgcctgtccatttcatgtgcccacccatgacatatgcccacccatgacattcccacctagtgcgtgtgcctatccactgcatatacccaacccctgcatatgcccacccattgcatatgcttgcccattacacatgcctatccactgcatatacccatccactgcatatgcccacccaccgcatatacccactcactgcatatgcccatccactacatatacccactcactacatatacccactcactacgtatacccactcactacatatgcccacccactgcatatgtcctcccatcacatatgctcacccactgcacaggcctggtgagagctggctctgctggacttggtctggccctccgtaaccattccttagaggccagtgcctggattacagcaccctgggcatggcatcacatgtacctgtgccaggtcctagactcaaggacacagggcaaggggggattccagagacaacaaaggaagctccctggccaggaagtcctgagacactgccaggcccagcagtccccttgctggccacacagacaagacatggccaacctcagggcctcagggtccttctctgtaagttgacctaagggattcctctgtagcctcatcctatgggggatgggagagagggagctaagagcacctcctacttgcccatctctctcttaagagaggttcatctaagagtagctttctggggaaactggccttcaaacgacctgggagaaaaacatttcatttaggagctgaggcttgtcaatgcatctcacaatgatttgcagaaatcccctttacctccctgaatatacaagatcttttctaggtgcaaaatgttcctgtttgttttccgtttagaatttccccttattgggagcatattttctccctctcaccctcagagaaaatttccaggttccttccacattctaaagagcaatgtgaaaattcaaggttttctgttttgttttgttttgttttttttgagactaaatctcggtctattgcccaggctggagtgcagtggtgcaatctcrgctcactgcgacctccacctcccgggttcaagcgaattctcctgcctcagcctcctgagtagctgggcccacggmacgtgccaccacacctggctaatttttgtgtttttagtagagacagggtttcaccatgttggcaaggctggtctccaactcctgacctcaagtgatcctcctgcctcagcctccaaaagtgctgggattacaggtgtgagccatggcatccagccctattttttaaatagaaatatttttattgagataatagtacatttgcatgcatttgcagtaaataatacagagatatgtgccagtttcccctaatggtaacattttgcaaagctacagtacaccatcacaaccaagttttctgggttttgtttatttgtttgttttgtttttgagacagggtctcgctctgttgctcaggatggagtgccatggcccaatcatggctcacagtagcctccacctcccgactcaagcaatcctcccacctcagcctcccgagtagctgggaccacaagcatgtacccccatgcctggctaattaaaaaacaaaattcatgtagagatggggtgtctcactatgttgtccaggggggtctcgaactcctgggctcaagtgatcctcccgcctcagcttcccaaaatgctgggattacagtcaccagccatagcgctggctgcaactggtccatttttaaaaagctctaattaaagcacgtccttgacatttgggaggtattcatccacaagcccagatgtgttctcacattctgagtattaggaatgtttacacaggctcctgacgtggtcctaaatcacatgaatctcatttctgtctagaagcaccatttcctgtgcatattctcataccccaacttggctgcctttttgatttttacgtatctatttatttcaattgtgtttaatcaggtaatgaagctctaaagaaacaggaaacatggagacagtggtatagaacaaggtgaaggattacatccttgcataaccttggtgaatacatatgttacattcagtgtatttcaactgtttcagactttgatcccttccatctttgttctagaccaaagatttttctattgtggagtatttcaagaagtcctgaaatgtttttctttctgttttgtgtttttttttttttttgagacagagtctcactctgtcacccaggcttgtgtgcgatggcgtgatctcggctcacctctgcctcccgggttcaagcaattctcctgcttcagcctcccgagtagctgggattacaggcgtgcaccactatgctcagctaattttttgtatttttagtagagatggggtttcatcatgttagccaggctagtctcaaactcctgacctcagrcgatccacctgccttggcctctcaaagtgctgggattacaggtgtgagccaccgcaccgggccctgaaatgtttttcttccagaggccctgtgtgaggaattagggctcagggctgaaggcaggcagccagcatcaccacttcagctgtgggatcgtggacaagagtactaacctctctgagagtcttgtttctctcttgtaaaaagagggtaataacagtaactgactcataggattaaaggaaacgtgagaaatatgtaagcactcaataaatattagttattattatttaaataaaagctccatagcggagtcttataatttttaggagtaaaatcataactctcatgcaaatataatatgaacatgtgtcaaatattttatttaacttatcaattaatgagtgaaccagtgaaatgctataacttactcaaaggagaatcaaagaggatatgtatatatgattagattgattgaccaattgatcattagatatgcagatatctaccatcagggatgctaaaatgagttggcttaaaagatgtaaaactggttgggtgcggtggctcacggctataatcccagcactttgggaggctgaggcgggtggatcacctgaggtcgggagtttgagaccagcctgaccaacatgaagaaaccccgtctctaccaaaacatacaaaattagctgggcgtggtggtgcatgcctgtactcccagctactcgggaggctgaggcatgagaatcacttgaacccaggaggcggaggttgcagtgagccgagattgtgccattgcactccagcctggacaagagcgaaactccgcctcaaaacaaaagatgcaaaattgctcaatatcattaggggaattatcaactgcatcatccccactggtcacaacttgcatttctctggacaacctggaaaattataagatatctcaaagacaatgaaaggcacagaaacctcatagagtcagataagctggaagaatgtgctagattgcctctactttttgttgaagacacccaggaatgttttaggcctatttcaaaccctttcacaatttttcctgatgcttgttcatttgatatgaggtcaaaggacaatacttaacgtgacccatatccctatagagttttatgatattgaggcccgcagtggccttatgaggagcaatctacaggctggtgagctgaggcttggtagacttggctcacatgagttcagaagtccacaaacctcccccagggcagctcatcctccctttcttttttcttttcttttctttttttttttttgagatggagtctcgctctgtcacccaggctggagtgcagtggtgtgatcttggctcactgcaacctctgcctcctgggttcaagtgattctcctgcctcagcctccctagtagctgggattacaggtgcctgccaccatgcctggctaatttttgtaattttagtagagatggtgtttcatcatgttggaccaagctggtctcgaactcctgacctcaggtgatcctcccgcctcgtcctcccaaagtgctgggattacaggcgtgagccaccacaccccgccagctcctgctccctttcatggtgggtggtgcaaagcaggattgctcttggcccctcaaggccaaactaatgaaactgtgctacgtgcaactgatgcagggcaggtgaactccagaattggggcttagcctggcagggttcttggctttgcccaggaaagaattcaagggcaagctaggggagccggtggtgttagacagcaacttttattgaagcggcagtgcacagcagcagcagacagactgctccttgtggagcagggctaccctataggcagtgtgcccagagcaccagctcagggcagttctgcatcatatgtgtgcccatctagttatatgcaaattaagggccagactatacagaaatttctagaaaaagggtggtaacttctgggttgtcaggtcattgccatggaaaggggtggtaacttccggtgttgtcatggtaacggtaaactgacacggcacactggtgggcgtgtcttatggaaagctgctttctctcagtccctgtttagctagtcttcaatttggtccagtgtccaagccctacctttggagttgagttccgccgcctacctcagaacatttgtagagccatttaaaaaggaaaactctctaatgtgaccctttgtagatccactttatgtctgataaggaaaggttggaattctttctgctgtgtaggcacaggttcagggccacacagcccttcccttctttgaacaccggattagtgcatcagggagccccggcgtggtggattcaggctcaaacactggaaacagtccagcaaaaccttgacctatagagagtgaagggcacagggccaggggaggggagctctttgcggacacagagtgacttctttctctaacctgccttttgggtttccttggcttttccttcctcctcctctcggatgaacttgtgagaatgaaggtgcatgtctgtggcccatgctgggtcctccaggcatggtgggctctgggagggccatggctgaggagcccaaggaagccaggcccgttgctttctcacctgaggattcgtctcagaaccatgacacagtcaaatgagaacagaaaccccactctaaggccgggggcagtggctcaggcctgtaatcccagcacttttttgggaggccaaggtgggtggatcacttgaggtcaggagttcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctcaaaaaaaaaaaaaaaaagaaaaaagaaaagaaagaaatcccacttcaaatctctactagaggttgcttgaaggttgctggaagggagatgtgagagcagacttacaccactctgcacagagaaaaacccatgaaaaacttgtgtctccctcagagtcatggtagtggccccagcgtccctgacacccctcccaaagtcaaccagtcagtctctccctgtttccctcacccccagatcagctcctttctgcctcatcctgggccttcatccttctgttgtccccagacgaccccaccgcccctggggatagactaggctgcattttgcttttctttctgtttttggggtccctgtcattctaaagtttgtccagccaatctgcttaggtttccacagtgggaacacagacacctttttttttttgagacggagtctccctccgtcacccaggctggagtgcagtggtgcaatcttggctcactgcaacctccgcctcctgggttcaagtgattcagcctcttgaatagctgcgactacaggcttgtgccaccacgcacggctaatttttgtatttttagtagacatggggtttcaccatgttggtcaggctggtctcgaactcctgatctcaagtgatccggccacctcagcctcccaaagtgttgggattacaggtgtgagccaccgtgcccggccagatgctgtttttttatgttgtctgggcagtcatttgtgcgctccatgaacagttgcatggtcctttttagcatcagactagagctatgattcccagcccacagtgacagaggccacctagccacctttgcaatggcaaccacattgacgatgacagtcttccttccttttcctttgtcttcagctgtggcaatcagcgggacactgctctgacccctggcattggttttgacaaatacttggctccttgttagctttattaataagatgaagagatatttgacagctacattctccccctaaaagaagaaggagtggcccacatggcttctggagttcttgggaactgacacaaaacttgcctcttggtggaggctgggtttgcctcaggtgggcccagaggagactccgcagctttaggaatcacctccctctctctcagctggctttttcttttttctttttttgacagagtctcgctctgtggcccaggctggagtgtggtggtgcaatctcggctcgctgcaacttccgcctcccaggtttactcgattctcttgcctcagccctctgagtagctgaaactacaggcgcatgccaccacgcctggctaatttttgtatttttagtatagacggggtttcaccatgttggccaagttggtctcaaactcctgacctcaagtgatccacctgcttcagcctcccaaagtgctgggattacaggcatgagccactgcgcctgacctttttgtatttttttaatagagacagggtttcgccatgttgcccaggctagtctcaaacccctggcctcaggtgatccgcctgctgtggcctcccaaagtgctgggattacagacatgagccaccatgcccagtctcatctggccttttaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttcatataaaacaatgcaattatttaggctgtgcaggatcggggtgtcaggtacttttcaggtctgaggtgaggccgtgggcagggcagcttctacccacctcatctcaactctcccttttcttgctcagtgtcacatrtaggaccagttacataatttgtgggtctagtgcaaatgaaaattcaaaattatcaggaatttcaaggtggcgacagcaaggcatcaaaccaagcatggcagcttctgagcacagggcccctgtgacggcacgggtcacacatctatgaagctggctctggtctcatgactcatgtgtgtcaggtcagggactgggtctgagccttctgcccagaaaggtgctgtaaaaggtcagtcacagaagccttgtagcaagccaggcagacacaggcaggcagatgtggtgctgggaacttggttgatgtttcacctcctggccctcagctccccatctgtaatatgggtcatgatacccctgtggtaggctgctgatgacccccaaggatatcaggccctgacccctggaacctgtgaatgttgccctatatggtgtcttagtttgtttggactgggtgccttagaaacaacaaaaatgggccgggcgcggtggctcacgcctgtaatcccagcactttgggaggctgaggcaggtggatcacctgaggttgggagttcaagatcagcttgaccaacacagagaaaccccatctctactaaaaacacaaaattagccaggcatggtggctcatgcctgtaatcccagttactcagctggctgaggcaggagaatcgcttgaacccgggaggcggaggtttcaatgagctgaaattgtgccaytgcactccagcctgggcaacaagaatgagactccatctcaaaaaaaaaaaaaaaaaagaaacaacaaaaatgtatttctcacagttctggagtttgggaagtccagcatcaaagctccagcagctccagtgtctggtgaggcctacttcctcatttatagatggctgtctctctgctgtgtcctcacatgatggaaaggactagggaattcttttcttgccttttttttttttttttctgttttgagaaggagtcttgccctgtcacccgggctggagtgcagtggcgcggtctcggctgaccacaacctttgcctcctgggttcaagtgattctcgtgcctcagcctcccaagtaactgaggctacaggcgcgccaccatgccagctaatttttgtatttttagtagagataggattttgctacgttgtccaggctggtctcaaactcgtggcctcacgtcgatctgcccaccttggccacccaaagtgctgggattacaggcgtgagccaccgcaccgggcctagggatttttttatggtccctttcataagggcaccagtcccattcatgaggcctccaccctcatgacataaccacctccaaaggctccacctgcaagtactatcacactggggagttggttccaacatgtgaattgtcgcggggatgcaaacattcagtttgtaacatgtgggagaatgggatttgcagatgtgattaagttaacagttttgagttggggagattatctggatgggctccaaatgcaatcacaagtgactttaccagagaggcagagggaggcggggcacattggtttatgcctataatcccagcactttgagaggcccaggcaggagaatcccttgagctcaaaagttcaaggccaacctgggaaacatagcgagacctcatctttacaaataattaaaaaattatctaggcatggtggtgtgtgcctgtggtcccagctactcaggaggctgaggtgagagaatcactggtggtcaaggctgcagtgagtcgtgattgaaccactgcactccagccttggaaacagggtgagaccccatctcaaataaataaataaataataaataagggagattagacacacagaagagaggtgatgtgaagattgagcagagatttgaagatgctggccttgaagactggagtgatgcacccacagaccaaggaatgccagcagccaccaatctgctcctgtaagaggccaggaacagattctcctcccgcagagcctctgcagggagtgtagccctgctggcagcttgattttggtccattcatacttattctagatccagaatggggaaagaataagtttctgttgttttaagccaggaagtgtgtgggtatttgtcactgtagccacaggaaatgaaaacataccctctaaaatttttaaaataacagattcattgagatatagttcacatgccataccatttacctatttaaagcgtgcaattcaatggtgtttcatatattcagagttgtgcaaccatcaccccaatcaattttagaacattttcattatcycaaaaagaaacctgtattctttagctatcttgcctaatcccccagccctagccaaccaaactactttccatctccatggatttgcgtattctggacattgcatagaaatggaattatataatatgtggcctttcatgtgtagcttcttccacttagcatgtttttaaagttcatctatagtgtagcatgtatcagtatttcgttccttttgttgttgttgtttagagacagagtctcatgctatgacctgggccagagtgcagcggtgcaatcctagctcactgtagcctcaaagtcctgagctcaaacaagcctcccatctcagcctccagagtrgctgggactaccggggcacaccaccacaccaggctaatttttaaaaattttttgagagaagttggtgggaggtgaaaaaaaaaattttttttttttggtagagccagggtctggctatgttgcccaggctagtctcaaactcctggctttaagcgattctccagcctcgggctcccaaagtgctgggattaccggtgtgagccaccatgccctgcccagtactttattctttttattgccaaataatattccattatatggctataacacattttgtttgctcattcatcagttgatgaacatttgtgttgtttctatattttggctattgtgaatactgcttctataaacatttgtgattttttttttttttgagacggagtcttgctctgttgccccaggctggagtgcagtggcgcgatctcggcttactgcaagctctgcctcccgggttcacaccattcttctgcctcagcctcccgagtagctgggactacaggtgcccaccaccacgcctggctaatttttttgtatttttagtagagacaggatttcaccgtgttagccaggatgacctcgatctcctcacctcatgatccacccgcctcggcctcccaaagtgctaggattacaggcgtgagccaccgtgcccagccctataaacatttgtgtgcatgtttttgtgtggacgtgttttcagctctcttgactatatccccaagggttgaattgctgctggatcacatggtaactctatttttaattttggggaaccaccaactgttttcaaagtggctgtatcattttacaatgccatagtagcatatgggcattcctgtttctctacatcctcatcaatatttgttgtctgtctttttggttatagttatcctagtgggtatgaagtggtatctcattgtagttttgatttgcaattccctaatgactaatgatgttgagcatcttttcatgtgcttggggtcattttttttttttatcttcttaggagaaataatctgctcaaatccttttttttttttttttttttttaagatggagtctcattcactctattgcccaggctggannnnnnnnnnnnnnnnnnnntctcattcactctattgcccaggctgggagtgcagtgacatgatctcagctcactgcaacctctgcctcctggggaacaagcgattctcctgcctcagcctcctgagctcctgagtatctgggattataggcatgtgccaccgcccggctaattttttgcatttttagctgagatggggtttcaccatattggcccagggctggtcttggaactcctgaccttgagtgatcctcctgcctcaggctccccaagtgctgggattacaggcgtgagccaccacgccctgcccctttgccaattctttaaaatggttgtgtttttgttgttgagttgtaacagttctttatatattcaagatcctagacccttatcagatatattatttccaaatattttctcccattctgtgaattacctttcactttcctaatgctatcctttgcaataaaaacatttttaattttaatacagtctagtttatctgtttttgttattttgttgcttgtgcttttgtggttttgagaacagaatgcacaaacacctgttttggcttcagtgcctgggacatggtggtgctcttcccaggccagcggccaggccactcagggtggaagacagtaggtcccttaaccccttgggctgttgtgtgcctgatctgttgtcaggcccttcttcattaggtttagaagatacagtcatcagaagaataaaaccactgtctaggtaaaagaaatttttaaatatataatatgaatatcttcttatttataccagtacagtttcaaaatgtaatttttttttttttgtggaggaagaggtctacaaaggcaaaaatgcctatggttatgagtcataatacaaccatgtcagccaggtgcggtggctcatgcctataatcccagcactttgggaggccgaggcgtgcaaatcgcttgagctcaggagttcaagaccagcctgggcaatgtgacgagaccccatctctacaaaaattaccaaaattagccggatgtggtggtgcatgcctacagtcccagctactcgagaggctgaggtgggaggatggcttgaacctgagaggcggaggttgcagtgagctgtgatcacaccgctgcactccagcatgtgcaacagaacaagaacctgtctcaaaaaaaaccccaaaaaatcccaaaaacaaaacaaccatgtcccttgtaactggagggggcctcctgcaggggatggaatagcacagactcctccacaatgtccctgcctgcctcccttttgcccagctgcccaactttgtgaggggccagaccggggtggtgagggcagcatatggtgggtgtggaagaaaaggcactgagcgctgccccttgggttcactaagtcagctgagctccagagcagcgattcagatgtggcaggcccagccaaaccagatcaacaactgttgttattattgttcaatcataactattgttttttttaaactttttaattaattattattactttttgagacaaggtcttgccctgttgcccaggttagagtacagtggtgtgatcgtggctcactgcagcctcaaactcctgggcttaagcrttgctcccacctcagcttcacgagtagttgggaccacaggcatgcaccaccgtatgcagctattttttatatttttttgttgttactatgttcttactgtgctctgctggttaaatgtgctttcaaaggctagctcttgtttgatcttcctaacaagcctattcaatgggtagatgggcacattattcccattatataggtgaggaacatgagcctcagagcatttaagctattaagctgcagagaacagacagggaacccaggcttctgatttacgcattagtgcacgttcactcccaggctggggtgtgtcccaaacccagtggatgggggctgttgagtctggctcatcaactctccaagactaatgagatctgaggctacaggtgggggaaatggaacggccggtgaatctcatttccaatcaccattgtcatgaaataggtggttggcctgctgtgccctccgacatgtctgttgcccacctgcctccgccttcctccccccactccacctccagttgctcagaaaaaccacttcctgaagtttattccagcagacagctttttctgtgcagttaacgagtcgctatgtttcggatctgcgttacttccccggtatttgaaggcaggagcactgcaggtaggaataactgtgtgtctgtcctccttcaattctgcttggctgagaagaagcgaacaacaccatgggagaaacagggtcctgggtgagtttgttaagcctggtgggaactcctggggtcccttggttatgtaggagtcagtctcttgatcagttaccaagaagccaaagccgtgtgggaacctttgcctcaacccaatcaaggaatccaccaaggtcaaggggaagaagtgaggagaaaggagaggcccacaaacgaataaaaacccattcaatttactatattgaaaaaggccaggccaggcatagtggctcatgcctataatcccagcactttgggaggctgaggctggaggatcttctgagacaagaagctggattccagcctgggcaagaccctgtctctacaaaaagtaaaaaattagctgtgcgtggtggtgcacacctgtagtcccagctacttgggaggctgaggtgggaggattgcttgagctcaggagtttgaggctgccgtgagccatgattgtgccactgcactccagcctaggagacagagtgagaccctgtctcaaaaaaaagatgttggctgggtgcggtggttcatgcctgtaatctcagcactttgggaggttgaggtgggcggattgcttatggtcaggagtttgagaccagcctggccaacatggtgacatcccatctctactaaaaatacaaaaattagctgggcatggtggtgcacacctgtgatcccagctactcgggaggctgaggcaggagagttgcttgaacccaggaggcagaggttgcagcaagccaagattgcggcactgcactccagcctgggccacagagcaagaccctgtctcaaaaaaaaaaaaaaaaaaaaaaaaggccaggcgcggtggctcacgcctgtaatcccagcactttgggaggccgaggcgggcggatcacgaggtcaggagatcgagaccatcctggctaacacggtgaaaccctgtctctactaaaaatacaaaaaataagccaggcgtggtggcaggtgcctgtaatcccagctactccagaggctgaggcagagaattgcttgaacctgggaggtggaggttgcagtgagccgagattgtgccactgtgctccagcctgggcaacagagagagactctgtctcaaaaaaaaaaaaaaaaagaaaaagaaaaaagacacaccaaagataatgataataataataaaaggtacatactgtatgaatctttacaaaattccagaacatggaaactaatcagaaagcagatcaatctttgcagtggggagggtgcagagggcaagggagacgaggggcataggaaccttttgggggtggtggatgtgtctgcttccttgattgtggaggttgtttcatcagtatacacatgtcaacacttttctgagtgtatactttaaacacagcttattttatgtcaattatataatacttcataaagctgaacagaaattcaatttcttaattaaaattttaaaggtaatactgccgggcacggtggctcccgcctgtaatcccagcagtttgggagaccaaggtgggtgggtggatcacccgaggtcaggagttcaagaccagtctggccaacacggtgaaaccccatctctactaaaaatacgaaaattagctgggcatggtggcacatgcctgtagtcccagctactcaggaggctgaggcaggagaatcacttgaaccctggaggtggaggttgcagtgagctgagatagtgccactgcacaacagcctgggcaacagcgcaagactccatctcaaaaaaaaaaagaaaaaagtgaaagggtaatacagtcacatgatttaaataacaaaagtacagaaagctttacaaagaaaagtccccaactgctcagtttctgccacccacccctctgccacagataataagaatcctttgcatccttactgactttctacaagttaatgtttaccctcccctactgattgtaaagtattctagtctactgtaaatagcaagtcaaacaaacgttaataaccttagagtgtgaggtaaaccctggacaggcatgcagtactcatttttgcctatttccaatttcagatactttttcttacattatggaaactatctgttcatattctttgcccatttttctattggattgttggtcttttctttttcttcttctcttttattttctttcttttaatcaggcagcctcccaagccagagtagcttagacagactcccgaactttttcttcttaatttatgagtgttcttcacacactagggaagttagctctttgtccgtgatgtgagttgcaaacattttttccagttagtagtttttctcttgactaattttttttttttttttttttggcaaaacagaacttttttttcataaagtacaatttatcaatcaattttatggcttctggattttaagttttagttaaaccagcctctgccattcaaggttgtaaggacttcttttcttcttttgtattttcttctagaactttttttttttttttttttttgcgagacagagtcttgctctgttgcccaggctgaagtgcagtggcatgatcttggctcattgcaacctctgcctcccaggttcaagtgattctcctgcctcagcttcccaagtagctgggactacaggcatgtgccaccacgcctagctaatttttgtattttttagtagagacagggtttcactatatgtgggccaggctggccttgaacccctgacctcaggtgatctgcccacctcggcctcccaaagtgctgggattacaagcatgagccactgtgcctggccccttctaggactcttatgggtttatttgtacattcatatcactggtccatttggaatgtattctggtacacagtgtgaattatgggatacaatttttcaattttctaaaaaaaacatttatttttgaaataaagctttattttatcatggtatcctgaaaatattagaatcatttatgaagcaattgccacattttagaaatttactttggaacttgagggcacggggtctggggtcttggcatttatcactatcatttgaattgttgctctgcaaaaggtgcttactctgcagtgtctaaaaattaccattgaagccaaaatttattttattaatcatggtgtttccttttctgttcccacatcaaaatttggtagatgggtgagggtaatttccagtaggttgccaaagaagatagcttatagtggggaatggcgagcacaaaacaacagcaaataacgcaatggaaaacattcctttagaaataaatgggtaaagtgtgtattgctgttcaaggctcttatcaaaacttccactgaaccataggtcagagagaggaattgttttctagctggaagccattacttcttggttcttgccctgaggtagaggaatctggttttgactgtggccagtttgtatctgtcttagctttaccatggggaagtcctagagggtggcatttcagaaacaatatggcaccctcaaggcagtgatcatctgattcagacaatacagtagtttgtcttcatccatctagacaatcatccattgcactaatgctttttcatcatctactaggttccagacactgtccctgtcatcaaggagattgcagtccatttgggggaggacaggccattatgacacatcctataataaaagtgtctggctgggcgcggtggctcacgcctgtaatcccagcactttgggaggctgaggtgggtggatcacaaggtcaggaggtcgagaccatcctggctaacacggtgaaacccgtctctactaaaaatacaaaaaattagccgggtgtggtggggggcgcctgtagtcccagctacttgggaggctgaggcaggagaatggcgtgaacccgggaggcagagcttgcagtgagccaggattgcgccactgcactccagcctgggcgacagagcgagactccatctcaaaaaaaaataaaagggtccgacagctgggcccggtggctcacacctgtaatcccagcactttgggaggccaaggtgggcgatcacctgaggtcaggagttcaagaccagcctggctaacatggtgaaaccccgtctctactaaaaatacaaaaattatccgggcatggtgacgcatgcctgtaattctagctacttgggaggctgaggtaggagaattgcctgaacccgtgaggtggaggttgcagtgagccaagatcacgccaccgcactctagcctgggcgacagagcaagactctgtctcaaaaaaaaaaaaagtatccgacagagggaaaaccagggaggtaagrgggttgcagaggaagggcagctcagtctggggaagacgaggaaaaattctggagaaatggattcctgaactgagttaggaaggatgggtaggaatttgcttggaaagaagtggggaaggcattccaagtaggggagcagccccgacaaaggcacagacagatgaagagtgctaggaactagaaattctagcagccataatgtaggtgcaaggaaggaagtggtgagagactaggcttgaaaggtaagcaaaggctgtattatggcaggctgtaaattgactttttctggtctcaaacagaggagtgaaaggaaatgatgtatatcttttttttttttgagacagtgtttcactcttgtcccccaggttggagtgcaatggcgtgatctcagctcactgcaacctccacctcccaggttcaagcgattctcctacctcagtctcctgagtacctgggattacaggcatgcgccaccacacccgattaatttttgtatttttagtaaggacggagtttctccatgttggtcaggctggtctcgaactcctgacctcaggtgatccgcccgcctcggcctcccaaagtgctaggattacaggcatgagccaccacgcccagcagaaatgatgtatatcttaggaagctcccgcatagtggcccagtagagtacgcatttgtttaggggtgcatgctggggaggggcctctcatagggctgcgtatgtcacccacaccaaaagctgaggagagcttcctagttctgttaccagatggtgccgcgcagctccaggctgttggtgccatgaacaaagaattggacatgacacacgtacaaatagcgaagcagcaaatgattaagcacagcgacactctcggagaggggtgagtgggctgacctgtgagtggttatcagtgccggtttgttacatttcacggccttttacatgtttttcctcacttgcttaatgtcacttgcctttctcttatagtgccttcaccctactttatttcttgtaagatagttgttcaaccttgtttacccccactttacctcttctgaccaaattgcccatctttacttttattttttgcgaccaaatagctactggaagtccttccaacttacttctcttaccatgtcccaacttactgcttactcccttatctattatattactttttgtggcaatatttgattgatgttttaaattacagactataaagaaacaccataaaatattaagacagtctgagagattttgatgtgttattaatatccacatggtttgcttcttttccaaagcatcccataacgtttgactctatgactgtaacaagttagatttttagaaactgatgcaaaggatcagattctagtagtttctttctctttttttttttttttgagatggagtttcacttctgtcgcctaggctagagtgcagtggtgccatctcggctcactgcaacctccgccttctgagttcttctgcctcagcctcctaagtagctgggattacaggtgccggccttcatgcccggctaaggctaatttttgtatttttagtagagacgggtttctccctgttggccaggttggtcttcaactcctgacctcaagtcatcctcccgccttggcctcccaaagtgctgggattacaggcatgagccatcgcgctctgccagattctagtattttctaccatcaaaatatctattacccaatgaaaagtctaaaggccaatcttttttttttttttgagacaaagtcttgctctgtcaccccaggctggagtgcagtggttcgatctcggctcactgcaacctccgcctcccgggttcaagcgattctcctgcctcagcctcttgggtagctgggattataggcgtgtgccaccgtgcctggctaatttttgtatttttattggagacagggtttcaccatgttggccaggctggtctgaaactcctgacctcaggcaatcctcctacctcagcctctcaaagtgctgggattaccggcatgagccacgactcccggccccaaaggtcaatcttaaagctacaaggtatcttttaaaaggagtaggaataacgtattttgaggcttaaaggagtaggaatagtgtatttttagatttgaagccatcttctaaagggtacgatatttggttaacatgtcactccttatcgccatggaagaagttaattctattcttttttttttttttttgagatggagtctcactctgttgcccaggctggagtacaatggtgtgatctcagctcactgcaacctctgcctcctgggttcaagcaattctcctgcctcagcctcctgagtagctgggattacaggggttctccaccatgcctgtctaatttttgtatttttttttttagtagaggtggagtttcaccatgttggtcaggctggtctcaaacccctaacctcatgatccgcccgccttggcctcccaaagtgctgggattacaggcgtgagccaccatgcccagccgttaattctattcttactgcttactcccttattttgtatgttcttcttctatcttacatcttttgcttttgctattgcttaagctagcctacgcccaagggtgctctttgccccctacttcctctgctattctctcgcctcagttccgctgcattccaagctcagcctgccccagcagcaggtctctttgacaaacctgcaattttggggaaaagtcagcccaagaaaggcagggggcccagacttatgctgtgtggcaaaagccctctttgatgggggaaggggaggactggaaaagcagagagatctttctggatgtcctgggagagcagccctttgggtggtgggtggaggctggaggcagggaggaatcccctcacagtgccatgagaagggcccccaaacccaggcgagacagagggagggtcaagaacgccaaggcaaatgtcacttgtgccttgttttttccctaaagaaactaaacaaagcggccgcgttcggtggcccctcaggaaggccggtcatttcctgaggagatatcaggccagcccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgtgagtgtttactctgtttccacatcactttaactccatgagcatcgaagcttctggaatcaacatgtttcttatgtttcttgcaggttcaagccttgagggtcaagaaaactgtaagtctgatgtttccactgtaacagatgtttctacctggcttcctcctttctcttctgtgatgcctaaaacgcacattaaattgctggggtttgatacttctaacaattaaggaaaagaatccaattgagaactaaagtttatcccatgtgggcatttttagaaaggcttagatctaagccaagttctggtcagtgtgttttagaagtagcacacgtttccttggctggtctgaaagtagtgggttatcttgatgaattgtttagtcagttacagatcaaactccatgttcttttctctgttctcacgactactcttgactagtctaaaaatatattaggttgttgmaaagtaattgtggtttttgccattacttttttaaaagatggcaaaaaacacaattataagtagcacacattttcttttttttttccttttttttttgagacagagtctctgttacccaggctggagtgcagtggtgcaatcccggctctctgcaaactccgcctcctgggttcaagggattctcctgtctcagcctcctaagtagctggaattagaggcgcatgccaccaggcccggctaatttttgtatttttagtagagacagggtttcaccatgttggccaggctggtctcaaactcctgacctcaggtgatccgctggcctccacctcccaaagtgctgggattacaggtgtgagccaccrygcccggcctcacattttctagatttcagtgcattgctgttttttgggatggggargtgatttttttattttaatgagcaattccataattagttttttgttgttttaccataatggcttatttgaatattgtaacctatccccaactgtttttatttgcaaatgagatataattgatttgttagacatatgaagacagatcctagtttaaattgttgctactttttttactcctaaatgataaaaatcacacactggagctcattttccattcacctgtgaggctacaagtrtatctgtaatattttgtgcttgtacaaagggaagtggggtgctgcctatctttgaagcctggtttatcttccactttacagctaattttgaacctttgtcttgagatgagagggttttgttctgcttcttctgggaccacatgaatgagggggctcagtagtgtcccggggctgtgaatagagggagagcccacagaacactatttccttgtcagaagtcactgcaatcagcaaagaatggaggtgactgggttgcaggcaaattgcacagctctttggaggtgaagtccatgggcaaggctagctggtgagtcaagcctcggagcagtggccccaggctggggagggctagttggccactggcaaagcccctctgccaggcttctctgctcaactgtaggtgcttccttgggcatttgatccccatggcaacccacggaggcaggatatccataatcttcataattatcctgctggactgatggtgtcaccaagcctcagaaataaccgattttaccagccgygttggctcacacctgtaatcccagcactttgggaggccaaggtggtcgaatcacttgaagccaggagttcaaaaccagcctggccaaaacagtgaaaccccgtctctactaaaaatacaaaaaattagctggacatggtggcacatgcctgtaatcccagctactcgggaggcaggggcatgagaattgcttgaacccgggaggcagaggttcggtgagccaggattgcgccactgcactccagcctgggcaacggagcaggactttgtctcagaaaaaaagaaagaaagaaagaaagaaccgatttgtccacgagagaggcagttggctgggcactgggactggaacttccactctctgaagctgcaccatttgtctggagccataggcctgactcaagtcttttagaccagttttacttaagctctttgatttgttttcccaatctgtaacatggggatgataagagaacttcgtgggcatgaagtgggtgtgaggttgagactggataaaaggaggtgattaattggcccccgcctcgaggtgattgataaatgacaatggtgtttactacacggtcctagcccccctttacgactgtgactcctgccctacccactctccctttgtccactccagccctcgtaccctcccagaccacaccctttgggccagaccctgccctgcagacactcacgctttggggtccctctttttcttacccacaacatcctgtttcccaaaaccgtggtgctctcccctctccccctccacaccacatggaagtcaattgctccctcctttgggttcctagagaatgaatgttctttgtaccttcagggaagacgttggaactgcagcacatggcacagggagcgactctcccactgcctcctcaggcctctgccttgttttacactcaaggaaacagacccaggggccacaaggcaccaagcaagcagggtcaacactgggggtgggcagggcggcggctggaaccaggtctccattccttaggccccctaggccagcatttgcagtgcgtggcctgcaggcttgctctgagtctcccgctctgcggctggggtcctgggacagcctcggccctttcccttccttccatctcaggcctctttgttcccctccagcccgcacctcactgcagctgcctcacctcaggaggtgacggctgctccrtcttcacctagaaaacagtcatctggagggaactccctcaacttcccgcctgggcctggctgcaggcttatcagcctctccacccatcctctcggtttccctcccggcctcggaggacacatgcaccctgctcctcagctgatgggggccagccaggcacttaggctgagacccttcctcacccccaggaccccacgcctacgtgcattcaagtccctctcccctaccaccacttctagaatctctatttctgcttctggctctgttctctcagtgaatgggaactcttttttttaggaaaaagaaaaatcacaagcagacacccacccccaccgtttatctggtgtccccctatctggcctttctagtttcctttctcagtcgaacctctctgaaagttagtttataatctgtgcctacccccctcacctctcagacacgcctcgcctcccagcagcctggcctcaggccccacttctccggctgttgggtctcctcttgctgaggggtcaccaaggaccacctgatgccaaatgcaacggacacttccagccctcggctccctgtacccctttcctgcctttgacttttgatcgtgccccaaagcctcgctccttgaccttttccatcctcttccctgctttgtctcctcactctctaacaaaccctcttccttctcccccatggctgactttggacttactttgtcttctcctggagtctgaaccctgtcctggtctctgcgggctcctggtcttatcctccctggagaccagctcccctctcaacacctccacattcccccctcctcccctaagttcacactcctcccaccttcacagtccagccctggcctctgccctgagcctccagttaacacaggctgacctttgatgtctcctcccagtcctcctactggcccctcacacgcagctgcaccaccatcactttgtcttccttccttatctttttctgtttgtttgtttgtttttgtagagactggggtctcattttgttgcccaggctggtctcaaactcctgggctgaagccatcctcctgcctcggcctccgaaagtgctgggataacagatatgagccaccacacacagctgcgtgtggcattttctattttagtttggtggcacacacatcctcctgggaatctaatccaggaagtttatcttccattctttcaaccccatatccaatcaaacaaagtctttttttaaattgtggtaaaatacaaataatataacatttattattaatgacatttagtacattcacggtgttgtgcaaccatcaccattgtctaattctagaacattttctttctttttctttttttttttttttttgacagagtctcactcttgttgcccaggctggagtgcagtggttggatctcagctcactgcaaccttcacctcccagattcaagcaattctcctgcctcaccctcctgagtagctgcaattacaggcacgaaccaccatgcccggctaatttttgtatttttagtagagacaaggttttgccatgttggccaggctattctcaaactcctgaccttaagtgatccacctgtcttggcctcccgaagtgctgggattcattctagaacattttcaacaccccagaaacaagtcctgttgagtccactcaggagatccccagcctatccttccctcatccccactgcacccgcctagctcaggcctcatcagctttcacctgaaccacttccaagctgtttactggccttgggtgctgtcacacccctcctgacaccctcaggacagggcccagcttgtcagcacagcaggccagccctccattctggcacgacagacccagccacctggcctctctagccccacactctggtttctgtaatgggccatgcccagaaggcacggatttctcacaccctcgtgtcctgggacacgctgttctcttacctggagcaccccactgcctgtccttggcctggcaggctcagttcagtggtcacttccttcagactccttgacctctcctgggcagcccttcctcttggtgcttactgatatcactggagtccagctatgtgggccccagcaacctttgctgtttgggacagcaaggatgatttcttacttactctgtcagcccagcacctggcacaggttctcgacacatgtctcatggatgggaacttgaactgaacttggagatgcttgagattcgggtaggaagatggctcagcatgctctctgatgagcacagaagttcatcagggactctatgcttcgtggctcccagtaattttcctgacgagggtgggcagcccctccttctcctgcaccctccactttctctctgagtcatttccaggttgagggccagggggctggctgactcatggtgccgcatgtttccagggagcaccaccatccactgatgagtggccttgaggtcaaggtcccactgtttttagcatgttggggtttggcactgtggtcactggctgttccgtggtgactttccaaatttagatccttctccgtcaaccttcatctccccgggttgaaaagatctgacctctttaggctgtcccacagccccacccttcatcacaatagtcctgaaactttttgggttcagtaaggaaatctgtgggccttctctccagaaaaagcacacatttgcacacaattggaggtagttgatgagcctcctaacacccacccatgcacctcccaggggctgtgtcccccaggttgtgaacagtcactctgtgtaaatagtgagacctacaggcagtaattcagtttggctgtgcttggctggtttatttagaaagatgataatgttttccatattatcaaaacaagaatcaggcagagacttttgaagtttggttgcgtggtatatttgttacctattgctgcttaacaatttacctaaaacttactggcttaagataacacagatttattatcctgaagtttctgagggtcaggaatgcaggagtggctgagttgggtggtgctggcaccgggtctcattagattgcagataaattgttggtcagggttgcggttatctgaaggcttgactgagtctggggaatctgcttccaagctcactcctgtggctatgggctggaggccttagttcctcatcctgggtaccttccacagggctgcttatgctatgactgctggcattccccagaatgagggatcccagacaggagagagagtgatcaggataaaagctgcattgtcttttattacctgatggagtattttgttggttaatgttaacgtgggaggtgaccacgtgtaagtgtgatgagcagagggcaaggaycattggggggggcatcttgaagggcttctatagcaagggaggtggtggtggttgtgscggtaaaaactaggtcactgtttttgttgttttgtcgatgatatttgtgttaagatgaagagctgagactcatatctcaacagagtttataaaatgcttttcttttttccatcctgccctctcttctcccttgtctgttcgagctagccatgggaatgtggtgttcctgccagtgcatccattgagttcgtttattgttaatttatttattttctgagwtggagtttttgctctattgctcaggctggagtgcaatgatgtgatcttggctcactgcaacctctacctcctggattcaagtgattctcctgcctcagcctcctgagtagctgggatgacaagtgcccgctaccatgcccggctaatttttgtatttttagtaaaggctaggtttcaccatgttggccagcgggtctcgaactcttgacctcaggtgatccaccgacctaggcctcccaaagagctgggattacaggtgtgagccgccacaccctgccgagtttgtttatttgagcagataatgtgtgttagagttgcttagaaaaacaagatggtggacgggccccatgctagtgggtaccatccctactggaaaaaccactgcttggtgcrttagccaaatttgctttaaaattgttttttaaaaagggagggcttttataaaaatcaaatgaactaggactggtyagtgggaggctcacgcaagggttgtgctgaggctggaaggcccagagtaggaagagttgtggagtgcagaatgagctctccaagggcagacactgccagcctcactgttctctgaacccccagtatgggggacagtgcttggcacrgaaaaacccccttaaatgtttgctatgaatggtgctaaggaagaaggcagagaatgtcaaccagaggccaggcactgggcaatatatacacggccccttctgtgccctcagccactttggcgcagtcactgtttaggttaaagataccagagaaggcaggtattcatgttcctacttcgtaggcagagacgtggtggcccagagaggttaaataactcccgagatcacccagctaagcactgtgggatcacgggtttgaatctggtatgtctgactcccttctgtacccagcactgtctgctggtctagggcataaccagccagggatgggcagctcgttcagtaaacaggagagcagatgaatgactcgtgtggagagcacgcagtggagtgagcaaaactgggaggctggagaagtcgctttaaattaacctgaaaatgtttaatatgctttttattttgtttattttttttgagatggartctatctttgttgcccaggctggagtgcagtggtgcaatctcggctcactgcaatatccacctcccaggttcaagtgattcttctgcctcagcctcccgagtagatgggattacaggcaactgccaccacgcctggctagtttttgtatctttaatagagatggggtttcaccatgttagccaggaggctggtctcgaactcctgacctcaagtgatctgcccagctcagcctcccaaagttctgggattacaggcatgagccaccacgcccagccttaaatatggtttttatttgaaaaaaaaaaaaatccctagaaacatgtagtggagacacagctttaaagctctgaatagttgattttcagctcatgcctgtaatcccagcacttggggaggctgaggcgggatgattgcttgaggccaggcgtttaagaatagcctggacaacatagtaagaccccatctctaaaaaattaaaattaaaaaataaaaaaagagtcgactttatttctgtaactggaagaatctagctaacatttctcaagcactttataggtgccaggaactctactttaagtaattaaactcaggttctcatttatacttacattccttgtgcctattgtatggataagcaaactgaggctcagagaaatttagggacttgccaaaggtcacacagctttgttagtagcagagatgagatttggcccaggtctggctccgtgcacttgatttctgctctttagtatctcctggttgagtcactggaatacacagcatagcttaaaatgaaggaggaagtactgaagaggtaatggaaggagacctaactgtctctgagagggaagagagtggttgggagggaactatattaattgaggagtgcagagaaattaatatggtccaaaggaaaaaaaggtttttttgagatggagttttgctcttatttcccaggctggagtgcaatggcatgaccttggctcactgcaacctctgcctcccaggttcaagcagttctcctgcctcagtctcccaagtagctgggattacaggcgcccaccaccacacccggctaattttgtatttttagtagagatgaggtttcaccatgttggccaggctggtcttgaactcctgacctcaagtgatccacccgcctcggcctcccaaagtgctgggattacaggcataaaccaccgtgcccggctggtccaaagaaagttgtgtgtcgagagctcatccagcaggcttcttaaatcaggagcttgtaagttgcatataaagacaaaaaagggagttccaaagagtaatgctgtgggaaatgacttgaatttaaaccgtcaccttgtttcatctcatggactggtcagacaccatttttgttgtcgttgttgttgttaaattaattgctcagaatatagcagcaggcgcaaattgtagtactcgttttaaaattgaagattaaattttaaattacccaacaaaggcctaactttgttaaaagagagggaaaggacaggttctgccagtatctctggccagctagctaactaacttttttcttattccaaaaaaatgacttgggaccacttataaaaattatgtattgttcaatgagatacaattaatgaggaaatcaggatgagagaaaaataaaggcagggaaataaagctatggcccatttagcacaaacgcatcccaaagattgctagaagcagaggtgaaatttttgctgtgtgttaacaatcaaagcaaaaagaggaacaaggtccattagaacattctcagaatccacaagatagaaatgaatcagttgttcagcataaacacagtgtttcctggtgctgttggaacactttgtgaaattagggacaatatctcatcaacatcccagaccaacatcccaaaagaccatttaatagcttgcatctgtgcttctccctaccccatagcccctccctccagagatgaccactatgctgacttgtaaaatattaatcttatatccagccacctttctttttcgtttgtttgtttgtgtttttgcagacagagtcttattctgtcgcccagtgcagtgttgtgatctcaacttactgcaacctgtgcctcccaggttcaagtgattcccctgcctcagcctcccaagtagctgggattacaggtgcatgccacaatgcctggctaatttttgtatttttggtagagacggggtttcaccatgttagccaggctgatctcgaactcctggcctcccacagtgctgggattacaggtgtgagctgccattcctggccttatccagccacctttctaaactcacatttatttctaataatttgtctgcagactctttgaggtttttacatatcatgtcatctgtctttgagagttttaaacattggactgctccattcactcaaaaattttaaaaaattccatgattgcattattcatacttcatggagatagatggggggctaagaaagcataccagacatagtcactttcaatcccaggtccaaatgctggataggtagcttccttgagaatgggcatggtagaaatttctggggggacgtgtagggatttgggaaaaacacctggttttatggtcatggactttcagtacatttttttccaaatcccctacagatcaattactttttctcttttttatacttatttaattttttttagatggagtttcgctcttgttgcccaggctggagtgcaatggcgcgatctcagctcactgcaacctctgcmtcccgggctcaagcgattctcctgcctcagcctactaagtagctgggattacaggcatgtaccacacccggctaattttgtatttttagtagagacagggtttcaccatgttggtcaggctggtcttaaactcctgacctcaggtgattcacccaccttggcctctcaaagtgctgggattacagccgtgagccactgcgcctggcctcttttctttcttttttttttttttgagacaggatctcactctgtcacctaggctggagtgcactggcatgatcatggctcacttcagcctcgacctcccaggctcaggtgatcctcccacctcagcctcctgagtagctgggactacagacacatgccatcatgcccagctgattcttttgtatttttgtagagtcagggttttgccatgttgcccaggctggtctcgaacttctgggctcaagcgatcctcctgcctcggcctcccaaaattctgggattacaggtgtgagccactgcacctagcttcatccatattttttttagccatgtatagaacatgagatgtttgaagttgttttctgacaggaatttggagagtgaatattttatggtgctgattaaacccagattcatgtgcttggaaaagacaaccacagggaagctagtgagtgctttgagatatgtcaaggggtaaaactaagaccacaagtgggctgcagaagcacctacaggcattgccaagaggatctccaaaaagcagttcaccctggtctgctctgaagtttggatacaagtcctgacccatgggcatggttcaggatcttctagcctggaaaattttcagggcagttgcccacaaccaaccaactgacaaaaacacagcaatagctagagagcacccaattttaagcaatccacccttccgtcagcctgctactgtgaatgagcctcaatatgtgatctgtagttagctgaattctattgacagcctatggttactggatataagccaattctgttctggggacttgccagaaatgacacaattggccagttgacccacagcctagttcctagcagagattggatagctgattgagcrttgtggctgttttgaggcttgaccagagattcctgccgttggcagaggggaatctgtagtctttgcttcttggtagcaggtgaggctgaaaacgcaagtagcaggctaaaaactggtttcaagtcctcaccatctggtgaaacctcagagcccatcagatagaaaatgccagctgggactgtgctaattcggtaaggcctgggtggagaaggagggcctgggcacgaccatctggtttcggaatggaggtagcagtcatttattaagyacttaatgtatatcgggcactgtacaggagacgttctggctgttctcctgtacatttcctgcaaagacctaatgagatatgattactccatcctacaggtaaggaaactgagctcagagagtctagctgcccagggtcacacagtaaatgatgagccaggacttgaacacttgactgcttgaatcctgtactccctccaggggccaagatgtggcagctcacagaatgcctatatctttttttttttttgtcttttgagacagtctcactctgtygcccaggctggagtgcagtggtgagatctcacctcactgcaacccccgcctcccaggttcaagtgattcttgtgcctcagcctctcaagtagctgggattacaggcctgcaccaccaaacctggctaatttttgtatttttagtagagagggggtttcaccatgttggccaggccagtctctaactgctgacctcaggtgatccacccaccttggtctcccaaagtgctgggattataggcgtgagccaccatacctagctctacatctttatcacactctgttcctttgccttggtgggaaaagttgcagcttagtaccaactgcctcctgcttgagccactgtgcacagttactatcagcctggccctgtaggcacgtagaacccctggactcaatactgcataggatgggataagaccacatctgatgtggtgaaggtcaccgggatgatgttgtttctgagataacaggtatgtctgccttccttccctttgcatttagctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccagstgttggtggaaggtgagtccttggaactgagcacaggcaagcagatggagcawagcacacagtggcgtgaataacagctgtgaatgaatagtgacactggacttaactctccacccatcaccctctcattcatctgcctggcattttccttacctgaatacgtaagcactagacatattcccaataggccaggcccttccttccttccttccttcctttctttctttgatggagtctcactctgtcacccagtctggagtgcagtggtgtgatctcggctcactgcaacctctgcctcccaggttcaagcgattctcctgcctcagcctcccaagtaattgggattacaggtgtgtgccaccacacctggctaattttgtatttttagtagagatggggtttcactgtgttggtcaggctggtctcgaactcctgacctcaagtgatccacctgccttggcctcccaaaatgcttcttcatctcgtctcataaattaaaatttcttcttcaagactcaactcaatgatgtcttctctttccaaaacaaaatgggtctaccccagggtgccagtcagtacagctctgatgctctctctacattcaatggtatttgtgtgtataaaggccacagcggtgtgttaagacacctcgttctgcagtcactctgcctgggtttcaatctgggcaagtcccttaacagctctaaacttcaaaatcctcaccagtaaaaggaagataacaacgatacccatttcaggcaattattgagagggttaaaagtgtcatgtgggtagagtgcttagcaaaatttccagcacctagtgagttcctaataaatagaaatgtatttatttattttgagacagagtcttcctctgtcacccaggctaaagagcaatggcgcgaccttggctcactgcaacctctgtctcctgggttcaagcgattctcctgtctcagcctcccaagmaactgggattacaggcacgcgccactgtgcctggctaattttttgtatttttagtaaggatggggttttaccatgttggccagcctggtctcgaactcctaacttcaagtgatttacccaccttggcctcccagagtgtcaggattacaggtgtgagccaccatgcccggtccacaaatattctatttcactcagtattgccatccgttcttacacatctgtctgctcttctggatagtgaaattgtaaagacagagatggtgtttggtttattcttatatcttgaacaatgaatctggctcatagtaggcattcagtcaatgttcatggaataaattaaagtcagtcctagcctgtggctgcattcaataaagggtaacaacaatcacagtgacactgacaaatactggctacctttcccctctaagcatcatctgttgggaatctgattgtgtcctcttcccaataggattataaaycattgaaaacaccaagtacatcttgaccatattttattttttaaatttatttatttatttatttatttatttttagacagagtctcactctgttgcccaggctggagggcagtggcacgatctcagctcactgcaacctctgccttcggggttcaagcaattctcctgcctcagcctcccaagtagctgggattacaggtgcctgccaccatgcccggctaattttttgtatttttaatagagatggggtttcgccatgttggccaggctggtctcaaactcctgacctcaggtgatccacctgcctcagcctcccaaagtgttgagattacagatgtgagccacctcgcgtggccttagtggtgattttggtggacccatcacccgagcagtgtacactgtacccagtgtgtagtcttttatccctcgctccctcccactctttcccctgagtccccaaagtccactgtatcattcttatgcctttgtttcctcatagcttagctcccattgagcatattttatattttttcctttcttttcttctcttttttgagacagggtctctgttgcccaggctggagtgcagtggtgggatcactgctcactgccgcctcaacctcctaggctcaagtgattctcccacctcggcctcccaagtagctgggactaccagtgcacaccactaactacccctggctaatttttaatttttttttttgtagagatagcatttcaccgtgttgcccaggctggtctccaactcctgggctcaagagatccacccacctcagcctccagattttatatatttcaaagtgcctagtactgtgctgggcacatacctgttcatttattacctggtaggtcgcactgggtgttcagagaacaaaaaagagccctctcatgggtcaactacagtcactcagcggagggaggcttgtgtctctcaatcaggctgatactgacagactttctcttcaatcaggctgatactgacagactttctctttccccrtaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacgggtcagcatcctgctcccttcctcatcgttctttgtggtttctggtttggtatggggagaaagaacccagaactgggaaggggctgctgttctcaggacttaagacctgttcttaatcattttaagccagtatttttcaagcttttttgactgttatacagttaaattgcatacaatttttcagacaagagtttcaccaacaacactttactcttaatatatatgatgctttttgtttgtttggcttggtttttggggtttttttttttgagacagagtctcgctctgtcgcccaagctggagtgcagtggtgcaatcttggctcagtgcagcctctgcctcccgggttcaagcaattcttatgcctcagcctctggagtagctgggattacaggcatgcagcaccacacctgactaatttttgtatctttagtagagatggggtttcgtcatgttggccaggctggtctcaaactcctgatgtcaggcgatccacccgccttggcctcccaaagtgctgggattacaggcgtgagccaccaccccaaccttgtgtgtgtttttgagacagggtcttgctctgttgcctgagctggagtgcagtggcatgatttcagctcactgcaacctccgcctcccaggttcaagcgattctcctgcctcagcctcctgggtagctgggattacaggggcatgccaccatgcctggctaaatttgtatttttagtatagacagggttttaccatgttggccaggctggtctcaaactcctaacctcagatgatctacccacctcggcctcctaaagtgctaggattacaggcgtgagccaccgtgcccagcctatttcagtctttaaacactggccatgacacactacactgatgcattatgtgatctgtagtttggaagccactgctttaagccatcgagggtcagacaccaggaagytgggtttggaggggatcgggaggaaagaggggccaggtcctcagccttggcctcctgttgttcaacgtagatttgcgttggacaaacagcaaacaaatgaggtggcctgggaaatgctcccaggagagaaggaggcaacagcagagggaagctggggagtgtccaggacatacagggctctaggacaggtagtcagccactcccaggacccggtctcatttgccaagccgggagaagtcaggggaaggcacacccatgtagatatttgcaaatatttccaaaataggaaacttacattttgtcataaatggtccccttcttttggcatcccactttatcctgcccattgtgtgtatgtgtgtctgtatgttctattatctgattataaaatcatgtgtgctctgggtagaattttcagacaaaagagcaggatataaagtatgtatataaagtgacaatcatttataatgcctctacttagagaaaaccacacatgatcctctagactttttctacatatatttatatatcatatacacacccagccacacacacacacacacacacacacagaaaaaacatcttttgtttttacaaaagatggggacctatcacactattttacagctttttaaaaaccagacaaaatcttatggacttttgtccatatgaagaaatatagatctatctcattttagaactcagaacttgactgtagggatgggccatctctgcaaccctcaaactcctgggcttgagtgatttacctcatcttctgctgatggatatttaggtatttttctcagtgtttgctattacaacaatcctgcagtatagatatttgtacttgtaacttgtgtactttggcaactattttactattattatttatgtggttaattcttagtagtcaaattgttgaatcagatgttttgtgcattttcttttttatttatttatttatttatttatttatttatttatttatttatttgagacagagtttcactcttgttgcccaggctcgagtacagtggcgcaatctcagctcaccgcaacctccgcctcccgggttcaagcgattctcctgcctcagcctcccgagtagttgggattaggcatgtgccaccacgcctggctaattttgtatttttagttgagatggggtttctccatgttggtcaggctggtcttgactcccgatctcaggtgatccacctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaggagtttgagaccagcctggccagcatggtgaaacctcatctctactaaaaatacaaaaattagccaagcgtggtggtgggcacctgtagtcccagctactctggaggctgaggcaggaggatcacttgaacctggaaggtggaggttgcagtgagccaccgtgtcactgcattccagcctgggtgactgagtgagactccatctcaaaacaacaacaaaaacttcagtatgaaaaacttatcgtaaaataaaaagacaaatgacaaactggagaaaatatttgcatagtacctttaacaaacagctaattcctttaatttataaaaggtttggctgactgtgcctggctcgatgttgccaaagtgctagatattgccaaagtgctcttcaagatggttgaacattttcatcagtagtgatgctagtgtttgttttcccrcatccttaccaacaaactttttctttctttctttcttttttaaatagagattagggtcttgctatgttgaccaggctgttctcgaactcctggcctcaagtgatcctcccatctcggcctcccaaagtgctaggattgcaggcatgagccactgtgcctggtcctaacagagtatttcaatgttttattatttttgacaatctagttgaggtatagtgatatatatcattgttgtggtgatttgtatttctttagtttttagtgaggttgagtttgtttattcatctattacatttttttcccgtaaaccacctattcatatatgccttgtcattttcattgtgaatcacaaaactccagtgccacaaagaaacaagataggtaaatttgactaaagtcatttttattgttcctggttggatttgttcaagccctttattttatttatttatttatttttgagatggagtctcactctgtcgcccaggctggagtgcagtggcgcgatctcggctcactgcaacctccgcccaccaggttcaagtgattctcctgcctcagcctcctgagtagcyggcattacagggggctgccaccacgcccagctaatttttgtatttttagtagagacggggtttcaccatcttggccaggctggtcttaaactcctgacctcgtgatccacccaccttggcctctcaaagtgctgggattacaggtgtggagcaccgtgcctgacccctttattttattttaaaaaatattttataatatgttttttgagatggagggtctcaccattgtttcccaggctggtcttaaactccttagctcaggcagttctcctgcctcagcctcccaaagtgctggagttgcaggcgtgagccaccgcccctagctgagcctttaataaattgattagctatttgtcagtgatattatgcaaatattttctctagtttgtcatttttctttgagttttttgataagttttccatgctgaagtttttaatcttcatttagtcaaatttacctgttctgtttctttatggcgcctcagttttgtgattcatacttaaaggtcttctgcatgtcaagattattaaaggaaaaaaacacacccatgttttctattcctgtgctatggtttcatttttttccctctgcatttaaatatctggtgcatctggaggtgatttgggtgaaagaaaaacacccttcagctattattaaggttccccagaagacctaaaatttgagagtcctaaagcatgtaaaggatgccttccccttttttacttttatttgagaaggcaggctattattttatgataacttctaattatgaattgactttataatgttaaaaatcactaatgaatattaaagcattagnnnnnnnnnnnnnnnnnnnnactaatgaatattaaagcattagagtactctaagttcactattagcattttaaagatatccctaatctatattttacacagttggaatctgtgtatatattccagtttatgccctgggcttgtttttttgttgtaagtggaaacgaaagcctaggacctatccctacttccctgaagatcctatgccctggttggtatgtgatctatacttgattaaaactatttttctttttaaatagagatagggtctcactatgttgcccagaggctgttctagaactcctgggcttcctaagtgttaggattacaggtgtaaggccccacactcaggcaaaattgtttttcaaactgcatgagtcatgaaatcagtttagtgagtgatggccagcattttaaaaaatgaaatagaaaagactagaagccacttttttggaggcatgcgattatttaaatattcatttccatgaagcagcacgtttcacagagctgaacttttgaaagctatagtatcttcatgctgaaatgccaagcttccatgaagtgctgagaatagcctagaaaactcgtagtgggcaggaggaagatcatttctaaatactgtggttatttctgaagtcctctgaaggcgagatctagagaaggtgtttggcctttgggaagcttcagaaacccagagaattgcagtgaagaagcctgaagatgcaagagtgagcgagaagggagggagtatgagagcagccaaggcaaaagttctagagaagaaaggttgaatttttaaagttagttaggaacaatagaagtttgaaaaggggaagcagcaaaaagagcagaagaggctcctcttgcccaggtttgcacctgagtccaaccaggttgtcttcctctcttgcagaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacaggtagggctgctgctgcgggagggtgttggcatatggcgggctcaagaggccaccatgctgcaatccagcatggccaaagagagctgatacatttcctgcccctgcttatctgaatgaatgtgctcagatggggctttggtgctcgtgggargaaaccactgcagagcgagttaacagtctactgtgcgtgttgagggtrcaggctccggcaccaaagctcaaccctgccgctcactgcttctgtgaccttgggtgagttattgaacgtgccgcagcgctgtgagatggtgataatgaccttttaggactgctataatgattaatgagataactatactgtaagcatgagctgagagatttgtacagagtaagactctgaacactggttaatgttttcattactctgttatatttctccatcccctgtgacaagcactatgctagatcccagacgtgggtcctatgacagggccacaaatgagaaagcattagtaaactcaaaaataatgataacatggctgggcatggtggctcacgtctgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaagaaatgacaattaccctttgttgaacattgcatgatgggtttatatacattttcttttctttttttttttttcttttttgagacaaagtctcactctgttgcccaggctggagtgcagtggcacgatctcggcccactacaacctctgcctcccaggttcaagtaattctcctgcctcagcctcccgagtagctgggattacaggtgcatgcgccaccatgccctgctaactttttgtattttaagtagagatggggtttcaccatgctgtccaggctggtctcaaactcctaacctcaagtgatctgcctgcctcggcctcctaaagtgctgggattataggcatgagccactgggctggcccaggtttatatatattttcatttcatgctcataacaattcaaggagataggcataagaatgtccactttatggatgtggaaactgagactgtgaggttagtaactcaaccaaggattacagggttaccaagggggtagaacaagagtcaccctcaggcctgtttggctttcaaatccatgaacttgaaagttccctcagactcctaaccctccttacctggctttatttccctctaaagtacttagcaccaaaaatatactctacctttcttgtttattatgtgtatgcagccactagaatgcaagccgctgagaacaggaacattattttgttcagtgctatatccttaacacctagaacagtgcccggcacacaggaggaattcaatacatatttgttggatgaaggaatgagtgttagatgacaatgtttcaggggacagagacagtcagcacttcttggttgcacggtgaaggggttctcatgtgtctgcattcataacgttcattcattcatttgttcagttatttactaaaagcctcctatgtgtcaagcattgagtgtgcagtgtcagcaacagtctccagcaccataggtaggctaccaactacccaactggtatattggcatatacattgggtcctgctggtctatagtgtgtgctagcaatttagttaagtattgatcatgacttatattttgatggctcatggtatttttttactgatacaatttatattatctcattaaagaaaagtaccagttcaacacatattgagcattttctgtatgctgggcaacttactggggataaagagctacctaagacccggttttacctatgaagaattcatagacataactagaccagtctacagcattttgtggtagaagcccagatggactgagacattctgtctcagatactttccctggataactttctccaacaggcctttccatgattcccaaggctaggttcagtgtcttttttcttttcttttttttttttttttgagatggagttttgctcttgttgcccaggctgcagtgaagtggcactatctcagctcactgcaacctccgcctcccgggttcaagcgattctcctgcctcagcctcccgagtagctgggattataggcatgcaccaccacacctagataatttttgtatttttagtagagacggggtttcgccatgttggccgggcttgtcttgaactcctgacattgtgatccrtccacctcggcctcccaaaatgctgggattacaggtgtgagccaccacgccctgccagttcagtgtttttcctatggggtctgtgacaaataatgcatctgaatcaaccactaaatgtaagcactttgaagtcagagactgtttcttattcactgctatctctcagtgcctagcaaggggcccgccacagagagaacctgcaataaatacttgtggggtgaaatgagtgagtgaacaaatacatgagtgaatgcatgaatcattatttgctgcattacaagctgcaaaacttttcttttgttgcttttttttttttttttgaaatggagtttcagtctctttttttattattattatactttaagttttagggtacatgtgcacaatgtgcaggttagttacatatgtatacatgtgccatgctggtgtaccgcacccattaactcgtcatttagcattaggtatatctcctaatgctatccctcccccctccccccaccccactacagtccccagagtgtgatgttccccttcctgtgtccatgtgttctcattgttcaattcccacctatgagtgagaagatgcggtgtttggttttttgtccttgctatagtttactgagaatgatgatttccaatttcatccatgtccctacaaaggacatgaactcatcgttttttatggctgcatagtattccatggtgtatatgtgccacattttcttaatctggtctatcattgttggacatttggattggttccaagtctttgctattgtgaatagtgccacaataaacatacgtgtgcatgtgtctttatagcagcatgatttatagtcctttgggtatatacccagtaatgggatggctgggtcaaatggtatttctagttctagatcccygaggaatcgccacactgacttccacaatggttgaactagtttacagtcccaccaacagtgtaaaagtgttcctgtttctccacatcctctccagcacctgttgtttcctgactttttaatgatcgccattctaactggtgtgagatggtatctcatagcggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaaactctttagtttaattagagcccatttgtcaattttggcttttgttgccattgcttttggtgttttagacatgaagtccttgcccatgcctatgtcctgaatggtaatgcctaggttttcttctagggtttttatggttttagktctaatgtttaagtctttaatccatcttgaattaatttttgtataaggtgtaaggaagggatccagtttcagctttctacatgtggctagccagttttcccagcaccatttattaaatagggaatcctttccccattgcttgtttttctcaggtttgtcaaagatcagatagttgtagatatgcggcgttattcctgagggctctgttccgttccattgatctatatctctgttttggtaccagtaccatgctgttttggttactgtagccttgtagtatagtttgaagtcaggttgcgtgatgtctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgaccatggaatgttcttccatttgtttgtatcctcttttatttcattgagcagtggtttgtagttttccttgaagaggtccttcatgtcccttgtaagttggattcctaggtgttttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatccaatcatgtcatctgcaaacagggacaatttgacttcctcttttcctaattgaataccctttatttccttctcctgcctaattgccctggccagaacttccaacactatgttgaataggagtggtgagagaaggcatccctgtcttgtgccagttttcaaagggaatgcttccagtttttgcccattcagtatgatattggctgtgggtttgtcatagatagctcttattattttgagatacgtcccatcaatacctaatttattgagagtttttatcatgaagggttgttgaattttgtcaaaggccttttctgcgtctattgagataatcatgtggtttttgtctttggttctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtatctctgcccggctttggtatcaggatgatgctggcctcatcatcctgagggaggattccctctttttctattgactggaatagtttcagaaggaatggtgccagttcctccttgtacctctggtagaattcggctgtgaatccatctggtcytggactctttttggttggtaagctattgattattgccacaatttcagatcccgttattggtctattcagagattcracttcttcctggtttagtcttgggagagtgtgtgtgttgaggaatttatccatttctcctagattttctagtttatttgtgtagaggtgtttgtagtattctctgatggtagtttgtatttctgtgggatcggtgatgatatcccctttatcattttttattgcgtgtatttgattcttctctctttttttctttattaggcttgctagcggtctatcaattttgttgatcctttcaaaaaaccagctcctggattcattaattttttgaagggttttttgtgtctctatttccttcagttctgctctgattttagttatttcttgccttctgctagcttaaggagtttcattcttgttgcccaggctggagtgcagtggagcaatctcggctcactgcaatctctgtctcctgggttcaagggattctcttgcctcagcctcccgagtatctgggattacaggcgcccaccaccatgctggctaattttatatttttagtagagatggggtttcaccatgttgcccaggctggtctcaactcctgacctcaggtgatccacccacctctgcctcccaaagtgctgggattacaggcatgagccaccacacctggccacaagttgcaaaacttttctaatccttgtcattgaaataaattggattaacaagaaaggaaaacctgccattggaatcctaggcaaagaatgaaccctagctccttactggggtgatcgttaggtacatgagaagcaaaggaaaactttttgctggaagttggaagttggttctgccaagagcacctgagccaagggcctctccaggaagggtctttagggtggtggccagacacatctcgctccattcccactcactgtttttcagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtggtgagtatattgttgctgactcagaggacatccggggttgaatgggagaaaggaaatttatctgcagctgccgccctctccggtctgagcagactcaggcagggtaagaactagagggagagaagtgcgaaatcaaaggccaaagaaacaaggaggtattcctgctcagaacactgattcactgatgatgatgtggcctctgacttgctaagattctggcaagattctgcctcctggagcaagtacccacccaaaagttcaggaaggaaacactacttagtcaatgttaaacttttcttttttttttttgagacgtgtcgcccaggctagagtgcagtggcacgatagctcactgcaacctctgcctcctaggttcaagtgatctcctgcctcagcctcccaagtagctgggattacaggtgcccaccaccacgtctgcctaatttttgtatttttatttttattacttttatttatttatttatttatttttttgagatgcagtctcgctctgtcacccaggctggagtgcagtggcacaatctgggctcactgcaagctccgcctcctgggttcacgccattctcctgcctcagcctcccaagtagctgggactacaggcacccgcaaccacgcccggataatatttttttgtatttttagtagagatggggtttcaccgtgttagccaggatggtctccatctcctgacctcgtgatctgcctgcctcggcctcccaaagtcctgggattacaggcctgagccaccacacccggccaagaatatcaaaattccattttttaaatctgtatcctggctaacccaaaagggtcagacttccagtggacagaatgtaggtatttgaccaccaggagctgggcttctcaggcctgaatgtgcatgcaagacctggttaaaatacaggttatgattcagtattttaggcccagatggggccaggttctgcatctctaactagcattttggtgatgtggatgctgttggtctctggaccacactttgggtggcgagattctggttgattatagaactccagtcaagttgtcactgtcactatattattcagtcacgatcctttcatttaacctgtggctgtgttttatccagctaagattttattatagcttcaactgaaccaggattttagcctatttttaatgctctaaccacctaactcaaaaggcaggaatgcaagagacaaatgtgtgttataacgttttattttattttttgttcttgggaggaggaaatctcattgtataaggtttaaataaactaatgcctaaataatgacctaatataattcttatctgttaagaggctgaagcactaagaagactttttttatctttttttttttttttttttttttgagatggagttttgctcttgttacccaggctggagtgcaatgacatgatctcggctcactgcaacctctgcctcccgggttcaagcgattctcctgcctcagcctcccgagtagctaggattacaggcatgtgccaccatgcccagctaattttggatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattggctggacctggtggctcacacctgtaatcccaacaatttggcaggccaaggtgggtggatcacctgaggtcaggagtttgaggccagcctggccaacatggtgaaaccccctctctactaaaaatacaaaagttagccgggtgtggtggcacatgcctgtaatcccagctactcgggaggctgaggcaggagaatcccttggacccaggaggtggaggttgtggtcagctgagattgcgccattgcactccagcctgggtgacagagcaagactcggtctcagaacacacacacacacacacacacacacacacacacatatatgctcagccaggtgtggtggctcatacttataatcccagcactttgggcagctgatgtgggaggatcacttgagtccaggagttcaagaccagcctgagcacatagtgagaccctgtctctacaaaaaataaagaattagccaggtgtggtgtgcacctatagtcccagctactcgggaggctgaggtaggaggattgcttgattctgggaggttgtagtgagctgtcatcgcaccagtgcactccagcctgggtaatagagtgagaccctgtctcaaatacacacacacacacacacacacacacacacacacacattttgttggctacttgttgtactttttctatgttttctgtgtctttgctcaacacaagaaaagtatattatgtgtgcatgtgcgtgtgagatatggtaaaatatgaacatgtatttctggggatgtaatgttttccttgaatttctgtcattctctgttttgcttattgtacttctctttccctttcccttctcaccacacacacacacacacacacacacacacacacacacacacacagcctgtcagtctcataggtgtcctataaaggtaaataaggcaggcaggcatttgaaattacagcagggatagaaagcaaagctcaggctttggaggaggaacctcttgtgctggatgctttgcttttaccttcagtgccttttggattgtttctccctctgttctagaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccaygccaaaatgttaagtgaggttctgagggtgaaggtgataggtaagttgctgtgctgtgagaagaaatcatgtgggcttggggcattctttcacccccagggactgtggggacaataagagaagtagggggccaggtgcggtggctcatgcctgtaatcccagcactttaggaggccaaggccggtgaatcattgaggccaggagttcaagaccagcctggccaacatggtgaaaccccatctctactaaaaatacaaaaattagctgggcatgrtggcgtgcgcctataatcccagccactcgggaggctgaggcaggagaattgcttgaacccaggaagcagaggttgcactgagccaagttgcgccattgcactccagcctgagcaacaagagcgaaactccatctaaaaaaaaaaaagcgagagaagtagtgggtgcttatgcaaagtccatatactagatatgcaccaaagcagggccaaggttcagtaaaggaggctggaaaatatttgggggctattgatgaggacaatgtaatctctttccagaacctttcaacaaactgctaaaatatgataagcatgaaagtgtcctgactgcaggaagcactgaagttgtgcatatgggctcccttagcactttctccttttcagatacactgttctgagaattgtagatcaggactctgctgttgtgactcctagccgggcaaccctgccttgtgtgaattctgcagcagtgagagctacaggctgtggtctcatggcagttactaacatttgcctgggattctcatcatactcaagagaaatataccattgtcttgggggtggacagtttcccttaagcctctatctcatgcctctcagaaggcctcaggagtgccattgcttgcatgtcttagatattttgcatcctgttgtaaaaagtttaataaggcttcctcctctttgtccttcttgtttagtaactgcctatctacatgggctgctggtggatgtgaataggagagagggattcctgcttctattcatgtatagtctaatagtagccataccttttcaattaacattaacataggctggttgaggtagctcacacctgtaatcctagcgctttgggaagctgaggtgggcggatcacctgaggtcaggaattcgagaccagcctggccaacatggtgaaatcctgtctctaataaaaatacaaaaaattagctgggtgtggtggtgggcacctttaatgccagctactcgggaggctgaggcacaagaatcatttgaacctgggaggcagaggctgcagtgagccaatatcattccgctacactccagcctgggcaacggagcaagactccatctcaaaaaaaaaaaaaattaacattaacatagactaagcacctaatggtgtgaggcatacaaaaaagaagacatattctttgtttcaatgctgtggtaagaaacacaagctctcctaattaaatgatggagaaacatctgaatcataataccaataagcatagaaaaaatgttaggggtcatgtttggttgtcacgtgaactatatccttacagtgatggtgatagtaatttagggtatgccagacttcatctagcttaagtgggtaaacattgtgaaaaagctgggctaggtgccagggcttgagaatgggtgggcagagaaggctgaagatggctgaacatctccagcaaacacatgagccaaaaggtcccatggggcacttcaaaagactgtgcgcagccaggtgcggtggctcacgcctataatcccagcactttgggagaccgaatggggtggatcacttgagcccaggagtttgagactagcttggccaacatggcaaaaccccgtctctactaaaaatacaaaaattagcccagcgtggtggtgggtgcctgtagccccagctactcaggtggctgaggtgggagaatcacttgaatccaggaggcagaggttgcagtgagccaagatcgtgccactgcactccagcctgggtgacagagtgagactctatctcaaaaaaaaaaaaaaaaaaaaaaaaaaaagactgtggccaaatcagatggctggaaacaaaggctggagtttgggaatggagaatcaccggatatgagctgaaaaagtggctgagcctaagcgtgacaggtgtcaggtgccagtmtcaggagtaggcaattgtcctgcatgcagtgaaaagccagaagatggaaggaaggacaggatgcaaatgagttctcggaacgatccacctggtggctgggtcagggagcaggcatggtgacttcagacctcatggtacgttagaggctaatgtgaagcccatgtgaagctgttggtttaaactgggtcgatatcagtrgcwcacatttactgaccatgtgtccagccctgtgtgaagtactgtagtaaattgctccaatggaaactcacaataaccacagaaggccagtaacagcattgtcgttattttatcatgacgcaactgaggcttagggcagacagctggtgggtggtgggactgggatttgagcccactggtgtcccaggcccggagcttggcttcttccattgtcttaccacagcctgcactcacaggagagtgactcataagttmcaataccatctgctgaccatctgctctcacactagaaggaaagtctacttgggaagacaatttaggatccgaattttggtagttgaggatggagctaggaaaagcggatacaggaggtagccaagttctgcttggacctgcagggagtgaggctggccgggctccaggtggaaatgcccaggtgaaaagggagacttggagttcaggaaagtaacctggactggagccataggtttaggtgtcagtggctcagagacagaagctcagcgtgtaggtgaaatcacccaggaggagaatggggatggaaaactgaggattgaattttgcaaaatgttcatacttccggggaaaacaaagaataaccagtgaataagaaaggggtgccaggtaagaagggaagagaatcagagtcatgaggaagcccagaagcccagaaaaagctgagttccacagtaagacctgggcaacagtgaagtatggagagcccaagattgggagcgtggaggaagagcatccaccactgaatttaatcagcaggggactcagggacgttggttggggaatcaagtgaccttcccagtttcttcaaaacttgagagagagtgcagtgtcacaagattgtgactacaaaagagtgcagtcagatttcaggggtaacaagaaagtgtgaaataagggagtcaaagcataaaggaaaaaggagaaaaaatggccgatagctagagaaggcagtgggtcaagattgtctgtggcctggcatggtggcttatgcctgtaatcccagcattttggaaggccgaggtgggcaaatcacctgaggtcaggaattcaagaccagcctggccaacagggcaaaacccygtctctaaaacaacaacaacaacaaaaaaatccaaaragttagctgggcctggtgggcgcacctgtcattccagctactcgggaggctgaggcaggagatttgcttgaacccaggaggcacacgttgcggtaagctgagattataccactgcactccagcctgggtgataagagcgggactctgtctcagaggaaaaaaaaaaaagttgagcagtggctgtctcatgttcctcttcctctgcccttctttkctcagtgtgaatccttttcctgsttttcagccccrgtggatgaggtccagatttctatcctgtcaagtaaggtggtrgagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctadcaaggaacaggagggagagtattactgcacagccttcaacagagccaaccacgcctccagtgtccccagaagcaaaatactgacagtcagaggtgagtcagggtctccatagcaagctgtgctgtgggctcccaagggcaagaccagaaaacacaccccttgtaagagggagttgggggggagtctagcttatgtgactgaaggctaggagagtaatgtcctccaggctcttggttgcaagtgacagaaacccactcaaattaagtaaaaaagagaaatcgattattataaggaattgggagaatgtcacatcgttccaattacaaattgttggcagactcaccattgagtcatcttgggtcaaacatccaaccacagaccacctgtagccaaggggattgggtcacgcagaacagacatgattggggaacccacttatgtgggtgggggcggtttcctggagaggaagagggctgaaaacacatgccaaaaaggagtctactccacttgagccctggagttggagaccagcctgggcaacatggtgaaaccctgtctctacaaaaagtacaaaaataggctgggcgcagtggctcatacctgtaatcccagctactcgggaggctgagacatgagaatcacttgaacccaggaggtagaggttgcagtgagcagagcttgctccactgcactccagcctgggcaacagagcaagactctgcctcaaaaatcaaaccaacaaaaaatagctgtgtgtggtggtgtgctcctgtagtcccagctactcgggaggctgaggtggaaggattgctcaagcccaggaagttgaggctgcagtgagctgtcatcagcctctagcctgggtgacagagtgagaccctgtttcaaaaaagaaagaaaaagaaaagagtctaccccagcaaagctggtttgttccctccttgaggaccacagctgacctctatttgtagcagaaacaatcatttctgcaccagctctgagtgcagaacccctcagaggtagatggatgctaaggcaagctgccagttacaagagctgtgagaatcagactgacttttgttgcttaagcctgatattatttcttcctggcagaggaagagcctatatacaaaaaaaattttttgttttgttttgttttcagtcattcttgccccatggaagaaaggacttattgcagtggttatcatcggagtgatcattgctctcttgatcattgcggccaaatgttattttctgaggaaagccaagggtgagcatagttctttccttccatactgactggtcgtccttgccaggaaaccagccagggatgcgtggtgcttttctgacccctggattcagctaggcaaaaatgaaagctattattttcctcattgggcaaaccagaaaagataaatttggggggaaattrcatctttgtgtggttagaagaagccatttctgtagatttgtccacacctagtcctgtaatgygtgtagagtggggtgcaagcgtcttggagacacacaaacatgcgcataacacccacatgttgcacacacacattgaatgctttgtaattaacctggtggttgtgctgtgacttctaccctatgcttggggttagctaagtaagcccggctgagcagccaggaccacctgctgataaccaggaatcagagtcagctgtccaagactcaaggaaaagggcagagcatcagtaaatcctgcaaaaatttttttgtgggataaggtaggttcttttggagcctctggtgctgctgcccaggatgggaggggaagatggggtgaggaggggccctggtttttgtcaggaaagctgccacccatcaaggaagatagagcacaccctggcgttgatcttaggccagcttcgagttacaaacgcagggattgatttcgcctttactttttgtaattatctggaatcaaagagagtggtcaggcacggtggctcacacctgtaattccagcactttgggaggccaaggcaggcagatcacttgaggtcaggagttcaagactagccgggacaacatggtgaaacccccatctctactaaaaatacaaaaaattggccagacgtggtgatgggtgcctgtaattgcagctactcaggaggctgaggcaggagaatcacttgaacctgggaggcagaggttacagtgagcccagatcacatcactgcactccagcctgggcaacagagcaagactctgtctcaaaaaaaaaaaaaaaagagagagagaggaagagagctgcctgcttatctggctaatctggttcccatatcattgtctctttttccatcatatttcactaacaaaaatcacttctggctaaaatagtcaagatatcatgtttctggggaaatatcttggtataagaccaagagaatacctctttcttttctgtcttttgtaaaagagtgaatatatttggcttctttttctctctttttctgggtattcaatcttctgggaagtcaaacgtagctgaaaagagtgttccttcacagcttactaggagtaaaacaaaaagaaaagaaaagtgttttctatctattaggttagtgcaaaagccattggcgttttggccattatagtggtatggatgtgggtactgtatactgactttggtttttcgttttctgttttaaagccaagcagatgccagtggaaatgtccaggtgagtgtatttgtaagaagggggcggctgctctgtgagcacggtggacatgtctggagggagattctggtcattaggaagttttcagtggctcttggcaaacttagaaaaatataggccttccttgagtgtgagttgtgtgtgtgagttgtgtgtgtgtgtgtgtgtgtgtgtgtatctccgtggaagaatgccaattgtcctttcatgggaaggaatggcttttattctgagatcatgtccttcctacatgattatttgtgaaatctccctttctttatgaaattataatggtagtagataaattttttaaaatttgacaaaatagagttggcctttaaaaaatggttttactacctttactgttgttgaaatcccaaatccaaaagtatagaaatgattgctctgttccagagagaaacagtagcgtgggataagaatttcaggggcttggtagtagcctgtgaaggactcctggtattcatgtgtgctttggtcctgatgtttattttaataggaaaaagttttatcaccgccaagcatggtggctcgcacctgtaatcccagcactttgggaggctgaggcaggcagatcacctgaggtcaggagttcaagaccagcctagccagcgaaaccccatctctactaaaaacacaaaaattasccgggcgtggtggtgcatgcctgtaatcccagctactcgggaggctgaggcacgagaatcacttgaacccaggaggcggaggctgcagtgatccgagattgcactgctgcactccagcctgggtgacagagcgagactctgtctaaaaaaaaaaaaagtttttttacataatccttggagctgccaaaaaatatttgttttcccaaatgagagagtaaagttttccttaccttggaaaactcttcctggttttctcatgatcttcccttgtttactttggtggtttggggttagaacaataacaacaacaaatatatctatatattgttttctgtttttatatttcattttaaggccagcagtaccacttctgaactcyaacaacgagaaaatgtcagatcccaatatggaagctaacagtcattacggtaaagtcatgttctcctgccatttctaatttcccccaacttgctacatacttccttagccctctcagaagcagaatatgtaagtggtgggattacagttggaagagaaaccctggcttcaacagggtacttcatctcatcagccactgggccatgtaatatacrgaaacgtaaaaggaaaggtaacatattttattctaactttgycaccttccaaactccccgtagaagaaakatggagaataatcataatgccttcaaagactttgaacattgctccagcgtaatattataattctccattttcaagacagagaccagatattgaatgaaaacattggtaaaacatcttctcagatggaattattacaagcacaagacagttttacttcaaatttgccacaaagggaaagcaatttcaatattctctcagtaaaggcataaataaagtgttccaactaagaaatatctattcataaggctcatcagtagcttcagggtcagctcagctgaatgagtagccagtcctaggagttcttaatcccaggttagtaagaaaattgctcaagcatttcagcagggatgctacttacttcccagagggggctataattacatcacaaaaagtcctgtcccagaccaaatttggaacactcttcctcttttctttctttcttttttttttagacagggtcttcccaggctggagtgcagtggtgcaatctcagctcactgcagcctctacctcccaggctcaggtgatcctcccatctcagcctcctgagtagctgggatcacaggcatgtgccaccatgcccagctaatttttattttttgtagagatggcactctaccaatgctggtttcagactcctgggcttaagaaatccttctgccttggcctcccaaagtgctgggattacaggtgtgagcccctgagcccagccacttttcttgctttatcagcaggtttggtcatagaatgctcatgttcttttctaattctataaatgtctcacaaaataagaaatttttaggatatactttttacagagacatattttgcttgagaaatatgttttaagaattgagtaattcatatagtactgaatcataaactttaaaaaaggaaaataaaatatttgtagtaataaaagtaatgtgtcagtaaatagaaacgagcaaatatattgtttaagaaactatattctaggctgggcgcggtggctcacgcctgtaatctcaacactttgggaggccgaggtaggtggatcacttgaggtcagcagttcaaaaccaccctggccaacatggtgtaaccctgtttctactaaaaatacaaaaaattagctgggcatggtggtacatgtttataatcccagctactcagcaggctgaggcaggagaatcccttgaacctgggaggtggaggttgcagtgacctgagatctcaacattgcactccagcctgagcaacaagagcgaaactccatctcaaaaaagaaagaaagaaagaaactatattcaggccaggcatggtagttcatgcctataatcccagctctttgggaggctgaggtgggaggatcacttgaggccaggagttggagaccagcctgtgcaacaaagcgagactaggagaatcgctggaatctgggaggaggaggctgcagtgagctgggatcgcaccactgcactccagcctgggtgacagagcaagacattgcctcaaaaaaaaaaaaaaaagaaagaaagaaaaaaagaaaaagactacacagcaggtcaaatggagcccacaggagggccaacgaggggacccaggacccagagacagtgctggttgtcactacactgaataaatcaggcttgactttgttaggggtactgaatttttaaaaggttttagaaaactagaatttcccttgtcactcaccctaattgttatttttcaactaggtcacaatgacgatgtcrgaaaccatgcaatgaaaccaataaatgataataaaggtaattatctaattacatgtttttattagaaccaacttttacattaaaaaaaagactcataggaaaagaaaactaaaacttgaaggactgtggataatttcccacctctcttaatgaccctgtacccagccgatgtgtcaatgaaggtagctagctgctttcaccagagatgctatctagtgtcctcagtgggaaagtcacctaaatcaaagtagggaagaactgggttatactcaaaaaacaacttcctgactcataatgagctactgggtaaggcagtgggacctcttttttcttgagcattgaggtggtgatttttaaagacaatggacaataaattgctctcttctgcctgaagcactgagggattggactaaatcatttttcaaaattcctttcgctctgggctgctgccatgggagctaaggctcctaacaaagagaaaggattctgttaaggtctcttcctttctttcttttttttgtttttttcttgagacaagagtctcgctctgtcagccaggctggagtgcagtggtgcgatctcggctcactgcaacctccacctcccgggttcaagcaattctcctgcctcagcytcccaagtaactgggactacaggcgcctgccaccacgcccggctaatttttgtatttttactagagacagggtttcactgtgttggccaggctggtctcaaactcctgaccttgttatctgcccaccttggcctcccaaaatgctagaattacaggcgcgagccactgcgcctggctcttttttttttttttttttttttttgatacagagtcttactctgtcacccaagctggagtacggtggcacaatcttggctcactgcagcctccgcctctcgggttcaagccattctcgtgcctcagcctcccaagtagctgggattacaggtgtgtgccaccatgcccagctaatttttgtatttttagtattggtggatttttaccatgttggccaggctgatctcgaactcctgacctcaggtgatctgcccgcctcagcctcccgaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatgtatctttgactgcagaatcattgttttggtagctgatgagaatccctattctttagggctttaaaaacaaaacagtaatgttatttttgacttgaagacaaactacttttctagctttcaccttagtaccctgagtgatttcattcacgtgtatgcctcacactctccaagtatttttagggtagtgacccctgttccccatttcccgaaatcctctcagtcttggaggtagctttgtttgcctgtggctgtggagaaggcttccagcatcttgagtgagactgaattgggagaactgctggggctgatactgggctgttttctgtctctactgacctgttccaagtccccccactgtagaaacagggacctaggccagagggtccctccacatcctggtaacagaggagtcagggaggaaaccatgggccccgaggccctgtatctgcctctgggaccagtgcggggttcgtactcccttcctcatcccgaatggaattaagcctgtgtctggctgccccctcaaaatacagaatactttaataacctgaatgaaaatctagccgggggcagtggcttatgcctgtaatcccagcactttgggaggctgaggtgggcggatcgcttgaggtcaggagttcaaaaccagcctggccaatatggtgaaaccctgtctctactaaaaatacaaaaattaaccccgtctctactaaaaatacaaaaattagctgggcatggtggtgcacacctgtaatcccagctactcaggaggcttaggcaggagaatcacttgaacccgggaggtggaggttgcagtgagctgagatcacaccactgcactccagcctgggtgaaagagtgagactctgtctcaaaaaaaaaaaaaaaaaagaaaagaaagtctctacttctatgatctgaggtgcccacaagagattccacctaaacaacaagctgctgtggtttctttgagcagagcctctgaactcagacgtgcagtacacggaagttcaagtgtcctcagctgagtctcacaaaggtaagtgccactcgagtgagtccccaggcattgcctttggcttgggtttaaaccccagtggtggcgggggtgctgtgttcagtgagaagagtctgtgcaccctcagtcgctccaaaggaagtgattagcagacctaccggcctgctaagactggaaggagcaaaggcccctggccctggccctgtctctgagctgtaaaatttcaataatttaaaagaaaaaaagaaaaggccaggcactgtggctcacacctgtaatcctagcactttgggaggccaaggcgggtggatcacctgagatcaggagttcgagaccagcctgaccaacatgataaaaccccatctctactaaaaatacaaaaattagccggctctggtggcgcacacctgtaatcccagctactcaggaggctgaggcaggagaatcgcttgaacccggaaggcagaggtggcagtgagctgagattgcgccactgcattccagcctgggtgacagagtgagactccatctcaaaaaatatatatatatatataaaatatataatatatataatatataaatataaatacatatataatatataatatatgttttctttgtgtataatatatattttataatattttatatatttttattttttatttttatatattttatatataatatttttatatttatattatttatatattttttattttatatatatatatattttttttttttctttgttgagacggagtctcactctctgcccaggctggagtgcagttgcgaggatcccgtcgacctgcaggggggggggggcgctgaggtctgnnnnnnnnnnnnnnnnnnnnnnnnnnnnnnnnnnnnnnnnnnnctcactgcaacctctgcctccgggttaaagcgattctcctgcctcagcctcccgagtagctgggattacaggcatgcaccgccacagccgggtaatttatttattttttttttgtatttttagtagagatgggatttcaccatgttggccagcgtgaactcgaacttctgacttcaaaagatccacccccctcagcctcccaaagtgctgggattacaggtgtgagccaccacactcggcctcaataattttaaaaattaattaaagaaaaatagagacagggtttcgccatgttgccctggctggtctcaaattcccgggctcaagcaatctgcccacttttgtctcccaaagtgctgggattacaggcgaagccaccacacctggccatttttgataattattcgttatgatactactaataataggtaagatttattgagcacttactaagtgccagggaattaggaagtactgagcaatttgtcccttccagaggtagaccccctgccaaacccagtgtgttcctaaagttgcttgtgcagactgaatgtgtgtcaatcaaatgcatgtttcaagatatcgagtgctttgccatttagagggacacttaggtaaaggcttttgaaagcacaagatccctgtccgtgtgagcagtggcactgattttacaccttgggttttgtttttgtgtatgtggttctctcaagggcaggctggcctggaagtccctgtctctggttctatgctggggaaatggatgcagagtgggctgctccatagaaaatgctagaacatcaatctcgtttgttttgggcaccataaaaaacatgcatctcctggccaggcacggtggctcacacttgtaaacctagtactttgggaggccaaggcaggtggatcacttgaggccaggagttcgagaccagcctggccaacatggtgaaaccctgtcttccactaaaaatacaaaaattagctgggcgtggtggcgcatgcctgtaatccatctactggggaggctgaggcagaagaatcgcttgaacccgggaggcagaggttgcagtgagccaggatcaagccactgctctccagcctggatggcagagcaagactccgtctaaaaaaaaattaaaaatgcatctcctaactgtcctcctcctttgcgaacccagattgggcagtacacagtccccgggggtcactgcacmctcctgcacgctcaaaggaaacagtggctcctgcacgctcaaaggaagcagtctcagaaccttcctgcccagctgggaagctccctgggatcattgccatctgtctcccttcctctgaggctaaccccaggctgcatccacctagccaggcaggcctggggtagttttcctgactgtgcaggctgaatgsgtgcagttttccaggccgtgccagccactagccagaccacatggcaatggggtcctgaaatcaccccttgctccatgatctgggaggagtcttggacttctccttgtcttctctttttgagcctgggctgagtgtcagcagctgtatgcacagaactttccttacagggatgccccgtagagccgctgggctgtgtgctgcaccactggggcacattcccatagcctaccaacagaatggcccccgggggttgtgtactgcccaatctgcacaactcacttccaagtctagactggacctgagaggggtggggaacgcggcaggcctgaagctctcttcctcattttttttttttttttttttttatgacagtcttgctcttgttgcccaggctggaatgcaatggcacagtttcggcacactgcttcctctgcttcccgggttcaagctattctcctgcctcagcctcctgagtagctggggttacaggcgcccaccaccatccccggctaatttttgtatttttagtagagacagggtttcaccatgttggccaggctggtctccaactcctgacctcaggtgatccacccgccttgaccacccaaagtgccgggattacaggtgtgaaccaccaggcctggcctcttcctctttatttcattgtagagtgattgactcgttgagataacaaattgtgattaaggccctacgcaggcagcacaagcacatacagaccctcccttgtggagggacagcctgagaggcagccaggaacacactgcagcaaagccctcctaaccttcagggatcacctaaccttcagtgatctgcccacctcagcctcccaaagtgctgggattacaagcatgagccactgcgcccggccctggttttctttttcttgctcaaaggtggggaagggttgaagggacaagaaggaggtattgtaatcccagcactttgggaggcagaggcgagaggatcacttgagcccaggcattcaagaccagcctgkgcaacaaagcaagaacttatttctacaaaaaatttaaaaataaggaggtatcgagaccctccaggattgggtgaagcagaggcggtcagcatgtgccctccttgccaagctgtgcagctgcagggatgccatcacctaactggtccctctttccccatttgcacaaaagctgtgtgggctgcagaggtccaggtagacccgtaaagagggtcacttgggggcaatggagagctttttgggaattcaatttgagttttctagacccgtcctcctccttggcagctaaggagcagtgtgggaagtcaggcctgagcctcaggtgttccctctctgccttcctgtgggtggagagccaggtattaccaggtacgaaaaggggctttgtgggtacaaggccagtggtgagtacatttgacctggtcttgaccaagccagttccctgctctcaagacttcctcctcctatggaggaggggttgggaaccacatccagctctgaccctagtggcagccgaccaagtggtcacttggggtggaggaggggcaggaaggaactcagtaaatcctggtttgctgcatgtttgctctgagactaattgctgggaaaaccccatgacgttgaagccatctccttctctgttaacacagagaaaaacagaagccaaaataaagccccatccggaaacatccctgacagcagagacaaagagcctgccagcctggtttactcattagcaagcagctgctgccgtggagtgggtggggaggagaggtagtgatgagctgcaactctgcctgcccacccatcacttaactgggcagatttgggggcagctgcaactctagaagctccaccaagaagcagaaacccccaggcccaaacaccaagccctctccctccatttattcctcacctgccccagcccccactgtgggcctgggtcggagggtgagctggccgtgaccaccccaccatgcgcctggtatatggtgtttgatagcatttgttgcagtgtctgcgttgtttgtgcacctgtctgcctcacagcctggagctcctgaaagctgggaccaggcccgatcacctttcctcttccacagtgcggggttcacactaggtgtctaggattctgctgagtgagtgatttggccaggcctgacatcaagcagagggtgtcttggggatgtggaggatcccccaatagggttggggatccctacagcttcccttgaggcccccacatctggtgccacagaaagagagtgaggggtgtgtgggcatctctgctgtcccagcagtgtggtgccctggtagctcagccactctactgagttccaaatcctgtttggtgccctggggaagtcagtgtaaggccctagtcaccccaaatgccccaagttcaactgtagggatctgacccacccccaggctttctcctcacaaatggttcctgacacaggagccaccaccattactgtcacttcaaacttggacaggtgcccccaggcagctgagcaagcctaggaatgggacatgtccaagaccccagctgtcaccccataggaggtcggggtctgccagggagacggacttgggaacaagtcacatcggtgtgttgtggacaaatgtcaccaacatgctgtggagctcagggggccctgtaacttcccagggcacagagggagagtgagtgtgggtgtgttggtacatgcgtgaagctccaccagggtcgtggggaaatggggcaaggagaaagggcagtgctggctgtggaggagtgtgtgtggggccaggaagtgagagtggggtgtccctggagcatggtgagacaagggcatctcagtgcaggtagagtccagggtcacaccccagccattcactccaaggagggaaatgcactgaccatggcacaggaagccccttaccctatctggggcttcctttccccatctgtaaaaggagaacagtggcccacacgacatcaggctcttttctacagtgaggcttcctgggcctttgtgcaggtgacaggagctgggaagtggccaggttccatcctgtttcctcagggttggtgggtatgtatgtgtgtgcacaccctgtgtgcatgagtgtgtgcacacccagattgcatgtttgtacatacagtgtgtatacaatgtgtgtagacacatcctatacactgtatgagggtatacatagcatgtatacacattgtgtgcatgagtgtgcgtgtgtatatgctgtgtgtgtatttttgtatacacatcctgtgcccataccccagtgtaaggtaaacagatggcaggaagggcgcccttgagtctcctccaggtatacgccacaccctgggtcagtcatcatgctgccatattgagagggtctagcccagaggatctcagccctgtctgcatattagggcccctgaggagatcctaaaaaaccagcaccagggacccccccagaccaatccaaccagaagctgcagtgaggcccaggagccagcagtgaaaacagccagcccagctgtctatctctgtaagagttctcagtcccagctattcctagggtcactgacaacccccaggctctaacccagacctcaggatcttgttctggatcccggggtctgggctctcaggtgattgggaggccatagcccaaccctgcgttgagggacctggcagaatgtctggacaagggtcacggtggcaggggaagaggagtggggccagcaagctggaggctgcaggcccttgctgggggcctctccatccgtggcccctcaggtccagggttcctctggtgcatgtggccctgctccacaatggcctgctgacctcctattcccagactgggagtgacgctcgttagaccaagaccttcttcttcttcttcttttttttttttttgaggtggtgtgtcactgtgttgcccaggctggagtgcagtggcgcaatcttggctcactgcaacctctgcatcctgggttcaagcgattctcgtcccttagctctcgagtaactgggatcacaggcacgcaccaccatgcccggctaattttttgaatttttagtagagacggggtttcgccatgttggccagaatggtctcaacctcctgacctcaagtgatctgcccccctcaccctcccaaagtgctgggattacaggtatgagccaccttgcccagccaggatcttctaacatcagaaatgacaaggtctctgggtgcttctggacctggttctggtggggtgcagtggtggggtacagccttgcctgcagagcctcagaccttttcctatgactgcagtggactgacctcgttcccagaggcagctactaacttatgcctggtcctttttccagatctaggaaagaaggacacagagacagtgtacagtgaagtccggaaagctgtccctggtgagtgagggtctccagtgccccagcctgggggatgccccctagaatcwctgatggggccttgggagtgggcagagaaaagaagaagcaaagaaggccaaaaaaggggtgccacctcttacaccagcgctgtgggcttcctctctcccaccacccttaaaaagtcacctcgggtcacatttactattcatgtagtcaacgagcgcttcttgaatgcttactgaccccagccggtgacccttacctgctccccacacaggccctggtggctggggttccccaaggtcttggacgtcgagtgttttgctttggagacccccagtagcttcagcctttcttcttgttttcttttttctcttttttttttttggatayggagtctcgctctgtcactcaggctggagtgcagtggtgcaatctcgactcactgcaacctccacttcccggatttaagtgattctcctgcctcagcctcccaagtagatgggattacaggcgccygccaccacactcagctaattttttttttttttttttgagacagagtttcgctcttgatgcccaggctggggtgcaatggagcgatctcggctcactgcaacctccgcctcccggttcaagcgattctcctgcctcagcctcctgagtagctggaattacaggcatgtgccaccacacccagctaattttgtatttttagtagagacggggtttctccctgttggtcaagctggtcgcaaactcccaacctcaggtaatccgcgcgcctcggcctcccaaagtgctgggattacaagtgtgagccaccgcgcccagcagcttcagcttttctgacagtagactgactttgggagtgggtgtgggtttgcggatctgctctatttcctttggttcggctggccccacttcgcttcccgtgacgacccactgcttactcatgaaagggcttcccccagagctgagcacagagcttaagcagacccggaactgggggagctcaacaagtcctttttttcggtgggggggtataataactgtattcaattctggtgaaatgaaatacacaatgacaacttttaaattctgaaggtaagtcagcaatccgaaagacgtaaacattgtgggggaaatagtgactgtgtgagtatctcgctttgtacagcagacctctatttaagtgggttcttggaaagggaatcattaaaatggtccaggacatttctgcaaagggtggctactcaggctaggcgtggtggctcattaagcactcagtaagtgctttatttatttattcaaaataaataaataaatataaaaggatgactcctccgagtacagtcggcaaaccagcagcagcaatctcgggcccagcccagacccacaaaactagtctctggaatctgaacttagccagcttcagatgtttctgatgctgccaatatttgagaagcactgtttgtgttttgttttgtttttttgtttgaaacagagtctcactctgtcacccagactggagtacagcagtgccatctcagctgactgcaactccgtgcaacaccccccggcccctaaggcttaagcratcctcccaagtagctagaaccacagacacacaccaccatgcccagctaagtttttgtatttttggtagagatgaggttttaccatgttgcccagactggtcttgaattcctgagctcaagcaatccacccccttcggcctcccaaagtgctgggattacaagcgtgagccactgtgccaggcaaaaagcactgttttagaagaaccatccaattctctgaggaccctgctttttatctgaaatagcgatcacttcttaattcacttttaaaagttggtatatctacaagaagaatagaaactcaacccttgtggaacttgaccctgaataatttttgaaaaaccaattctctggggaatttttagctcaaatacctcatttcacaatctccatatattcagagctaacaaaatgcaaatctgacaataaayagccgttctctatttgtctagtgtaagggaaagttataagygaggtagggttcaaggttgctcccattgtgcarttgtacaaaaatgccccttctactttcttggtggtccctgagagtgttcgctttcttggacactgctgaagagttcactttcagttgctttcgttaagcaaaatctcctatttgagcacttattgtatgtgctaagtggtctaagtacatcgtgtctttcaatgggatttgtccatgggattcaccacaaatcccattttacagttgaggatactaaggcatagagaggttaagacgcttgcccaagatcacgcagcaagcmagcccctgagaatcgttcctccccggagtggactccacgctcttgatcactgaggtgtactgtcttcggtttgggaaagtcgggtggtagaaggtggaagctgcagggatcctcgctgcaggaggccagctccttaccacctctgcctcgaggcctccagcgaagtctgtgatcatctgaggctactggttggaggcccttttataggtggtgaggggcaccttagtgtggattctagggaaaaacttaactttttttcctttactctcctaagtgctctgactggggccctgcgaattggacaagcagattaacaagaggaaaacagagtttattaacatacataacgcaaatcacacaggagaaacatcaatgatgagtaactcaaaggggtggttagcacttggggtctataaagcatcttaggctgatcgcagtggctcacgcctgtaatcccagcactttgggaggccgaggcgggtggatcacctgaggtcaggagttggagaccagcctggccaatatggtgaaaccccgtctctactaaaaatacaaaaaattatctaggcatggtggcatgtacctgtaaccccagctcctcgggaggttgaggcaggagaattgcttgaacccgggaggcagaggttgcagtgagccgagatcacgctattgcactccagcctgggcaacaagaatgaaactccatctcaaaaaaataaaaataaatataaatatataaagcttcttaacaaagagcaataaatttgtagacaaatgacaagacaaaggaargatggtttttggcttyccagagtggcaaactgagaaagtcaatcaagtggccacaaatattttatgggggcatttacagcaggtgtgttttcttaggagtttctgcttttagggctgggcatggtggttcatgcctgtaatctcagcactttggaaggctgaggtgagagaatcgcttgagcccaggaatttgagaccagcttgggcaacacagtgaggccccatctctaaaaaaaaaaaaaaaaaaaaaattttaaaaaatttaaaaaaccaatataaaaacaaaaattagctgggcatagtggtgcatgcctgtagtcccagctgctcaggagactgagacaggaggatcgcttgagcctgggaggtggaggctgcagtgaactgtgattgtgccactgccctccagcctgggtgacagaatgagactgtgggttccaaaaaacttaattttcttcctttactctcttaggttttctgactggggccctgcaaattacacaagacagattaacaagagaaaaacagagaccctctttgtttttctcttgttaatctgcctcaaaaaaaaaaaaaaaggaagaagtagtttctgcttttagtcagataaacaagctctgggaagacttccttctacatctgaaccagctcaaaacaatccttatgccaaaggggcatattttgtggtggcatattctgatttccttcatctgctttagggcagctggctgttcaagtgggttctctcggggtctccaggttggttctagattactcagtccgggctgttggaacctgacccctcaggcagaaactataggcatcgtagaacccactcttgtaggatttgaggcggtgtagagcacaggctttcctgggagacatcccagtccccgttctgaggcagcccccaatcagctgagttactgtgaccaagatgtcttacccctcagagactcagtttcttcaactgttaaatgcaaatggggttaaatgagatagaatcatgggagatggtgctggttatccccacagtcactgtattatccctgccacagagtgagcacttaatcaatttcagtttaaaaacacaggaggaacttgagccctatagagttcagtgtcttgcccagggtactactagagcagtcccctgactccgagaccaggaccctcccacagcaccacctgggccacctggagtcaatcagggctctgtcgctctacaaccttgtctctaaactggcagaccattagggaacctgccaggtctctaacctgcccaggggtgaaggtagagagagccctggttcttgcacaggctgtagccctyggggcctgcagctgcctgcagctgtgcctccaacccacctggaagcctctggtcctggaagccaaggggtttcctgtttgtcagtgcttccttgaggagaggagcctgcaggacatggctgatttcttttctttctctstttctctctctctctttctttctctctcgctctctctttttctttttcttcctttctttcctttttcctttctttccttttctctttcctccttctttctatctttctctctctctctctctccttccttccttctttcttttcttttctttcttttttgtaagacagagtctcactgtgtcacccaggctggagtgcagtggcacgatcacagtgaacagcagcctccacctcctgggctcaagcgatcctcccgcctcagcctctggagaagctgggattacaggcacgcaccaccatgcccagctaattcgccatgttgcccaggctattgcccaattcctgggctcaagtgatctgcccgccttggcctcccaaagtgctgggattcaggcgtgcgccacctgaatgctcagcttttctttcttttcctcttactggttgctaaagagcaggcatcccatttgaggaatttctctcctaaattctctgggacttccttaatagaaaacatcttccaagtaatctcttttccttcactccctacataaaatcagagagattccctcctctctgcctggggggagttagatgattctccaaagagccagatccttcagccagcagtaacccacccgcttaggcttctctcacactcatcctcagcctctctttgttcaagtcttccccagagcccagagctgttaaggatcatcatttctttctttctttctttcttttttttttttttgagacagggtcttcgctctgtcacccaggctggagtgcagtggcgcgatcgcagctcactgcaacctccagctcccgggttcaagtgattcttctgcctcagcctcctgagtagctgggamcacagctactgccaccacgcccgggtaattttttttgtatttttagtagagacggtgtttcaccatattggtcaggctgatctcgaactccagacctcaggtgatccacctgccttggcctcccaaagtgctgggataacaggtgtgagacaccacgcccggccagatcatcatttcttattcatcatcataaccatccccagattcttcatcattgccaaattcttcagcagctctttcctctggatattattccacctctgtagactgcagatttcttttgttccatgttgattgttttctccctatactctaattatcttgcggttgggcgggtcccttcctcctctgtcacagttaaagctaatatgtattgagcactccctctgtgtgagacacttggagccctaccttaatccccaagatcatctaacagttgatgggggttctattattattcttgctctgcakatggggaaacgggcccagaggttaactaatttgtccttgttccacagccagtggcagagcaaggactgaacccagggggcctggctgaagccatgctcttcaaagccttcctgttccctctctttttttctcttaattggtttgttaccaattgctgtccattgtttgttgccaaaccaattgactgcattcttttctgttttccatctttcttagtttaggcttcatgttatcggcataattggagaacktttgtctmcttttttttttttcagacagggtctggctctgtcactcaggctggagtgcagtggcatgatcttggctcactgcaacctctgtcccccggcctcaagcatcctcccctctcagcctcctaagtagatcctatctactttaaacatgaagagtaatattctactgtggcctgkgtgaccctgggcaagtcatagagcctctcaagaccttggtcaccttctctgtgagatgaggtatgggctggaggcaggtcagtggtcctcgggctttattaaaacatcaatagtttggcgcaccccactccctgtgaatttcccattcactaggtctggagcggtgccgaaaacgtgcatttctaacaggtgtccacacgcagctgctgccgtcacgctggggcccgggctttgagaaccactcttgatgcagcatgttcctttctgattgtgccacgctaaggctctgcttcttgttggaaggagtagggtctttctcaccctccagaaatcctggagggatctttcagcattggtgggcaggtaaaacccagaaacactgtgcttattagagggaaggtggtattgagtgacccccaataaaacagggggcccagggccgcgcgcagtggctcacgcctgtaatcccagcaatttgggaggctaaggcgggcggatcatgaggtcaggagatcgagaccatcctggctaacacggtgaaaccccatctctactaaaaatacaaaaaattagctggacgtggtggcgggcgcctgtagtccagctacatgggaggctgaggcaggagaatggtgtgaacccgggaggcagagcttgcagtgagccaagatcgcaccagtgcactccaggcctggcgacagagtgagactccatctcaaaaaaaaaaattggggcccagtgtggggtaggtttgtgagatcagtgagccagctgggtgcagagcggagtctttgctgacctttccccttcatgttccccgtcatcttctagcatgcagcatttcaggactgcctattttgggaaatggcttaaagggcacagttctggcccttaaaccccctttcaccccctgagtaatacaaaataagccctcccctagataagcaatagggcatggggcaggcctgcctccaaggagcagccccagggccgaggagagagagctgggcgctggcccaggggacttgagtttgatgggaaagcttgcagacagtgggggagctgcctggtctttccagtcttggcttttggctctaagcacagcttttttttttttttttttaattgttgtatcatgaggcgccttccactcagctgcctccccacgttaggggatggacacagcactggcagggatccctgtgtgtctcagtttccctattgactctctgtggcctagagatgtatggtagaattccacactatgctttttttccaccttttttttttttttttttttttttgagacagggtctctcctctgtcacccaggctggagtgcagtggnnnnnnnnnnnnnnnnnnnnnnnnnnnnnnnnnnncaacctccacctccccaggcaggcccctctgactcagctgggactacaggcatgcaccaccgcacccagcaaaatatttttgtattttagtagagatggggtttcgtcacattggccaggctggtcttgaactccagagctcaagcaatccgcccgcctcagcctcccaaagtgctgggattacaatgcccagcccacttttttttttactttttacaattttattcttaaaattgtggtaaaacacatatcacataaaatttaccattttaactctaagtatccagctcagtggcactaagtactacacttttggttgtcatagcgtggtgaacagagaagagaatgctactgcgtctcgtggagagaggccagggataccgctaaacatgcgacaatgcacaggacagccccctccccaccacaaaacaccacccagcccaaaatttcaacagggccaccatggagaaaccctggccagaggaattcacctcctgcaactcctccaacaggagagctggttttcctctccagtaccagcttttgcctgccctctgtcttgggaggtgacttaaggcacatcccacctgattactgtggctctggatgggtgctgagtcttgctctgggcaccagccctacctgttgagccagaggcccacctccccatcacggaatctactcactcaatggtccatcttctacttttttgttgctattttttgttttttgagactaagtcttgctctgtcactcaggctggagtgcaatagcacgatcttggttcactgcaacawtcgcctcctgggtccaagtgattctcatgcctcagccttccaagtagctgggattggaggcayrcaccaccacgcccagctaatttttgtatttttagtagagacggagtttcaccattgttggccaggctggtctcgaactcctggccacaagtgatccaccggccttggtctcccaaagttctgggatgacaggcgtgagccactgcgcccagtccaccttctactttctatttgcctggaattcagacttccagggtgtttcttagggaggcagaaaccctggtcctcaccgcatcccctgccacccagtataccaagactagctgggccgagagtagccgtgacaggaaatggctgagaaagaaccaaagaaaaggaggcctctgtgccaagtctcctatgggaggaagagaagagcacttgaggatcagtccccacccatcctgtgaggcccagagccagtgaggccagagggcactgccaaccctgcccctggggaggcatttcctacttcagcgtgcaagatggtgaaaaagtatccccatgaaaaaatggatgctacctccaattcaactttggtgatgattgctctgttaccaaaaaaacaagaactgcaagtgtgcatggagtaagtgttccatccgtatttgagtttttcacattttgtcttcagattgctttagaaaatgcctacttgaggttctttcgctgttgggagaggttccagagcccttaggggactaggagggtccaggaatcacggggtcctttgggtccttgcaggtcagatttgcattgggggtgctgtcctcaacctcactcaatgcatggaagttgacacaatggctcaacattascgttgggctgattcatcatttggctgttgacaccagcctctggcccagccaggacagaaaaagggcccctgaggaacttctggctctgttccctctatgggggaggggcagtggacttgtgataagacagggtgttagggtgaggtggacttggggaaacaggatatttctaaattagagaaacagaaggattgtgacccccgctgtgacagacaggccctgagcctgcccgaggtccaggaggaactgtatgtgagcttggggctgggtctatactgaggccccttggcrtacttttctcgataagactgaggacttatggccctcccaccattccctccaccaccttcgagaacagcaaccatccccaatgcccacatctcctcttggggtctcccccaggcagcaggtgaggtccccatgacttctctgtcttcaagtcagggtccacagtcagctgtttggggatctgccccagcatgtgggccactgaccattgggtggggtcctggtcctttccagaagggcaagccatacccgtcacttgcctctcataggaaacaccatctctaatgaatgcaggcagggatcacccaccacctatgcagagcttcctgctctcattggcttttctcascctcactgtcctcttgctgacatccggttgggaccatttgcgcaactgcagactggcagggccaggcaaacacagcatggcgcctgccaagaaggtggtgtgagactgggcacagtggctcatgcctgtaatcccagcactttgggagactgagatgagtggatcacctgaggtcaggagtttgagaccagcctggccaacatggcgaaaccccatctctactaaaaatacaaaaattacccggctattgtggtgggcatctgtaatcccagctacctgggaggctgaggcaggagaattgcttgaacccaggaaatggaggttgcagtgagccactgcactccagcctgggtgacagagctagaccccgtctcaaaaaaaaaaaaaaagaaggtggtgtgggctcccacacagttgagaggagactcctgaggggaaggggaaacagttgcccagatctgctaagagcgttggcaatgcttctgcctcctcctctgttgagcctgctcctggaagggattgacaaaatagtatgaaatctagaaatagctttattcccaaagaggataccggtggtgttattgaaaagagcaaaaacttggaaagcacctacatttttaaagtaaggaattggtgaagtcaatagttgyacatccatttaacaattatttagtagctaattggacaattatgcttaagaagttttcagaaaaagtttataaagccatgttatatgaaaaagttaagttataaaatggcatatactgtataattataactgctccccacccccaaaaaagccaaatcgtagtggaaaatgactaggaaaaaaaaaagtatcaacagggtttggagaatgaggccagrtatcatttttatctgctacttcctactttccatagttttcatttttttcttaaaaaaatatgtgctactaatttttttttttttttgagatggagtcttgctgtgtcrcccaggctggagtgcagtggcgcratctcagctcactgcaacctctgcctcctgggttcaagcgattctcctgcctcagcctcccgagtaactgggactacaggtgcccaccaccacgcctggctaattttgtatttttagtagagatgggatttcaccatgttggccaggctggtctcctggcctcaggtgatccgcctgcctcagcctctccaactgttgggattacaggcatgagccaccacacccagccgtgatactacatttctaaaaaactgtttaaaatgttaaatgaggccagatgtggtgactcacacttgtaatcccagcactttgggaggccagggttggcagatcacctgaggccaggagttcgagaccaccctggccaacatggcaaaactccatttctacaaaaaatacaaaaaaaattagccaggcatggtggtgtgcgcctgtagtcccagcaacttgggaggctgaggcaggagaattccttgaatctgggaggcggagggtgcagtgagccgagatagtgccagctgaggcaggagaattccctggaggtagaggttacggtgagccaagatggcgccaccacactccagcctgagtgacaaagcgagactctgtctcaaaaaaaaaaaaataaagaaaattttaaatgaagtgccagggactttatgcgcatgtcatgtggagctagagggtcccggggaagctgtcttgcacaaaggagccataaacctctaagggcacctgccggctgatgtctcctggctctcgcctcctccctcttttctcgacctgctcctgaccctgtgatgttgttggggcagttgaactgggttatttgcgttgctcactgccatgtcatcctttgttttgtagatgccgtggaaagcagatactctgtaagtacacatttcatatacattatatttaaaagtactccactgaacagtgaaatatttccagactcacccacgtcctgcattcacaygaattcttccccgctccctagtctgtttcagaccagaagccctgggcttctctgactagccttggccagttctgatttcgaatattctctcctgcaatttccatcattacatctcagcccacacgtgaagggattgggactctggggtgcttagcgccaaacaagcaaagcacacatttcgtttaacgccaaagtctaggctctggaagtgaggcagatctagggtgtatgcttggaggagtggagcagctgacagctcattgcaatttagccgatwctaattaccccctacacaccaggccatcagctgcaggagacacccaagcttcttgacctcagttcaccttctgatgagggaatcagacatgtgatcacttatcataaagcaaagtgagctatgccagagcctatgggaacacagaacagagacctagctagtggcctcttccccaaggaatcatttggaatgggccatgaagaatgaatggagtgatggcagcattgagggagaaagatcagcaggagcacaagggtgagggatgaccagtttcaagcagtgtgggatgggaaaagaagagtgtgacagtgacaagtgacgggagaaagataagtcagggcttaaatccaaaggatttacatgccttgttaagaagcttcattctgtaggaaatggagttaggaatctgctatttggcagatgggagggtttatgaaagacacagaggcccacgttcaacttttgcaaagacgtgtcttccaatcccaacctttttgtgagctacccagcaatgcaggagttaactgggcagctaatatctgaagaaatgaggcatttgccgcataaacttcttttaggtctgggaagaactttcagcaagatttctggtagctcttccagtgggcccctggcttcctttgttttgcccatgtctggactcttgtaaaacagagctcattatgcctttgacagacaggaagccactgacattctttttatggaagaaagctatgaatttaaggaaaagaggaatgaaatgaatggttgttttttttcctagccaaaacccactcagactcctgaaatcagagactatcgtgtcactgggacaaggagcccaatttacagatgaggaaactgaggcctgcactggtagaatagcrtgtctggggtcacctggatggctaatagagtgaggaacagagcccaggcctctatactctgcggccagtcctctgtcacgacagagactccctccaagatgtgaagttgctgtcccagcaataatggctttgagagagtggaaaatgaggtctttgctccctgggcagtgcgggacacaratgtgtystcctgaagcgataaacatggctgggtccacccaaaacaccctgtaggaccaacttatttactttgtcttggatccaaagggtgtctctggacaaaggcttggagctccaggccagacagaactttacccagaagctggcccttgggcctcaaagtctgctcccaggatggttctgagagctcacccatgactggtcctgtccccccagaaaaaagaatagagtcatttgatgggagcacagggtttccagccrttgggaaaggaattttgaacctttaagcaaatgggttttgtttataaaagaagcaggtatagcttccctaataatcagctggtgtgggtcaggagaaaattaattgaattgcccagtggggaaatgggaggagatttccttcctgaaatcaaacctggcgatcattcccagttgtttaatggccgttgcctctgaaaacattggaggaaatatcttaacaatgagatagccacgtagccaaagactaatttggtattgtttgacttgcttcaatggcacattctgacttcatttttcctctgccatttttaccttgtttataaattgtgtgtgtggccgacgcagacagatagcatggaagagaacaccctgtacttaaatgaaaggggtgaatctggacttgtgagagtcttgggatcttggaaaggaccctgccttcttacagaaagaaaggcaattggcagctatagctcgcctccccccttcctggaggccaggaggcagctgggctacagtggaaactgtccaggtgctaggatcaggggatgggaggggagctccagctttccagctgtcttttgggtgagcctgtcttcctcaagctcaagcttccttatctataaagtggagatggtgatgacaatgatgataagagcaacctattaggattttaaggatgaaatgagcaactgcaaccaccatataaaagctgcaagctgcaaaccaccatataaaagctggttgatctcaagctcttttcatcacttgggcaatagtaggtgtggatgggggacttaacttgatttggccatgaaatgaccctgccacatatggagaatgtagcagttgcttacccaaggcataggattcaaccaaggccaggctttgacttaggaatcagagacccacattaacayttgacttcccrcttcttagccatgtcaccatgggcaaatttcttggcctctcaagacctctrcttcctaatctgtaaactgggaatcataaactccctcacttggttgtygcaagggttgaatgagcacctggcatagacctggtctattgcaagtgcccacaggagcactttgtagaagcaggaactagagatcccagggtgtgttgaaatcaaaatgacctttgagggagaccacaccatattccgggtacaaggcagggcgatttcacaactgcacttgggtggctgatggctggcttctgatttaagcacagcaagcccagaccttggatgtgagcgtgttaacctttacttcaaaatccctaaggccctgttgattgtggcccagcccttcctgtctgtggctttggttctgcaatggtgccccaggcattggctgcccccacagagagagagcggaggtgtctggggagggacttggtctggggcccacagaaaggctggacaccagagtcatgtctcccccatccaggcagagcagaggaaatagggcagggtggctgccggcgctggcaggcctccagcctctggggccagcacggcttgcttggcccacttgcatggggctctcctggcagaggaggggccagagccttggctttctagttggggcacctcggccctgcatcctgttccccaagggtccttggacccagcagggctgaaacaaaatggagacactatcccagctcaccctcaggaagccagccaggctggctgtggaggtcccaagaccctgggtcatcctccatctccagcttctgccttgctgagttccacctgcagcagagtgtcctgtgcacatggagggtccagaatagtggacttaggtgctgcctgctcttcagggcccactgttgcccagggcccccctctactctggtatctcccagcaggccctgctctttttccctccaagggctccttccatttgtcaaaatccaatctttaggctgactccagagttgcttctgtgaatcccccactgcccagcccagagccctctcagtgcctctgaaccccttctgcagtttgttgagacctcttataccttctacttcrtagtggtgttgtttatcaataattgatacaatataaaattcttggggacagcttcttgcatccccagcatagagaacagtgtgggtcagataagggtccaggcactgataggtggataggtgacacaaataccatttgaagctgttaaagagcactacaggatggcagaaggaatccaggaatccttttgtgggtgtttttttgctttttttgtttgtttgtgtgttttttgagatgaagtctcactctatcacccaggctggagtgcaggggtgctatttcagctcactgcaacctccatctcccagactcaagtgatcctcccacctcagcctcctgagtagctgggactacaggtgcacaccaccatgtatgcctaattctttgcatttttgatagagatggggcttcgccatgttgcccaggctgttctggaactcctaaactcaggggatccacccaccttggcctcccaaagtgcygggattacagggatgagctaccatgcccagccaggaatccttttttttaattgtcataaaatatacataatattaagtttaccattttctttttttttgagacggagtcttgctctgtcrcccaggttggagtgcagtggcgcaatcttggctcactgcaagctccgcctcccgggttcacgccattctcctgcctcagcctcccgagtggctgggactacaggcacacgccaccacgcccggctartttttgtatttttcagtagagacaaggtttcactatgttggccaggctggtcttgaactcctgacctcatgatccacccgcctcggcctcccaaagtgttgggattacaggcgtgagccactgcgcccgcccggcaaattcaccattttccagtgtatacttaaccattttaaagtgtataattcagttgcattaggtccgttcacattrctgtgcaaccaccaccactatccatctccagagctttttctttttaagtgaaagcaagtttattagagaagtaaagaaacaaaagaatggctactccataggcagagcagccactgaaacactgtacccattaaacactaactccccattgcccctccagcaacccctagcaaccactgtctactttctgtctctatgaatttgactatttgaggtacatcacataagtggaatcatatatttgtcctttcatgtctgccttatttcatttagcataacgttttcaaggttttcctgtgttgaaaatatatcagaatttcattctctttttaaggtagaatcatatcattttaaaacatttcagttggaccatctaagttcagtccttcattttcaaaattaaaaaacaggcctcaaacgggtrcatctcacgttagctagagacagaactggagctagmagtcagatctcttacaaagttgcctttcttcttctgtgggtaagtggggcacccttgggacgctgtgctgggcgtacatgggtgcttgatgaagttacttggtggactgatgtgattgatgtccaacatgtatgcagggacagaggctatggtccctacagagcaggcatggagagaaggagaaatacatacgggcaggagccaggagagggagggtgtagtgagcagagaccgcgccactgcactccagcctgagtgacagagtgagaatccatctaaaaaaaattgcttgctaaagaagtggtctcctgaggtcttaagacgttcctgacaatgtcttgagtgggtgggagagaggctgcagtcattgtgctgtggaatttcagaggtgagaaccacacctaaccaaaattactttccctgtttgcctcagtgacacagctgcaggaaccctggtgggtgttgtattaagtaaatttgacctttattctttgcagatctgtgaaatgttgtcttctgaggggccacgtgtatctgtagtgctgaggactccttgggcctctgaagtcacagagagaaccctgcagggtgggggaccagtgtgtgacagccctgctttgcattttctttgagaagtgctgtcattttgcatttctctccaccagggcaatcttcaatcttgagaggtgtgatcataacttgccttgtttcttgtcgctacagagaacggaaggctcccttgatggaacttagacagcaaggccagatgcacatccctggaaggacatccatgttccgagaagaacagatratccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaaytggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttggstagtccttgttctttggaaatacacagtgctgaccagacagcctccccctgtcccctctatgacctcgccctccacaaatgggaaaaccagactacttgggagcacckcctgtgaaataccaacctgaagacacsgttcattcaggcaacgcacaaaacagaaaatgaaggtggaacaagcacagatgttcttcaamtgtttttgtctacactctttctcttttcctctaccatgctgaaggctgaaagacaggaagatggtgccatcagcaaatattattcttaattgaaaacttraaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtrgtatcagctactcaagaggctgaggtgagattatcgcttgaacccaggaaacggaggttgtagtgagcggagatcgcgccactgcactccagcctgagtgacagagtgagaatccatctcaaaaaaaacaaaaaacaaaattgcttgctaaagaagtggtctcctgaggtcttaagacattcctgacagtgtcttgagtgggtgggagaraggytgctgtcattgcgctgtggaatttcacagatgagaaccacgcctagccaaaatcacttttcctgtttgcctcagtgacacagctgcagggaccctcgtggatgttgtattaaataaatttgacctttrctctttgcagatctgtgaaatgttgtcttctgaggggccacatgcatctatagtgctgaggactccttgggcctctgaagtcacagagagaaccgagcaggtctatgtttttgttttgttgttttgagacggagattcgctcttgttgcccgggctggactgcagcggcgcaacctctgctcactgcaacctccgcctcctgggttcaagcagttctcctgtctcagcctcccgagtagctgggattacaggcacatgtcaccacgcctggctaatttttgtatttttagtagagatggggtttcaccacgttggccaggctgatctcgaatgcctgacctttggtgatctgcccgccttgtcctcatgtgtgctccacaggcctttgggttgggattgcaggcgtgagccaccatgcccagcctagactcttttgacaatatgatgaaagctgttggttcctttccccaacacacacacaccgagttgtatcacgaaaatgtcatacaatttccaggttttctgagtggtgggctcagattgaggtcaaaggatcagacgacctctaacgaccttcatgtctctgttgatgatctggggacagccagatcccctgtgtccagggagttccttagtcccttgccaccaccagagaagggcaattgccacgggagctgcaaagaccctattcctactcctggtgccttacttatgcagcacgactgaattttttgttttgttttgttttgttgagacaggggcttgctctgttgcccaggctggagtgcagtggcacaacaatggctcaccgcagcctcgaacccctgggctcaagcgatcctcccatctcagcttcctgggtagctgggaccagaggcgtgagccgccatagctggctaatttttaattttttttttgcagagatgaggtttcaccatggtgcccaggctggtctcgaacttctgggctcaagtgatcctccctccttggcctcgcaaagtgctgggattgcaggcatgagccaccgcccccggcctgtggagcacacatgagtttaaaattactttcccttctgcctatatttccgaggaggaaacttcatgcgcagggatctttcttagtggatttaatggctaaaaggtctgtctgaatccaggacgctggctttagccttcctcggcagctgccgtaaccccggtgtctaaacctgaagcatcccaggagcacccactccaggagttttctcggccgcggaactcattagttagagcgccctcttgtgttctcatgtggtaatcggtcattgaaggacttaaaatggtccttagccaacacacagtagaacttttccctcttctgaccccaagaggtcagccacccatttcatgagcatatactggtcgccccatcagcgttctctgattggctaactgaacccactccccgacctagactcaagacaggcgaagtgacgcttaggtcaacattcactcactaaagcaacgactgtcgggcgattttgtctcccgctggttttggaatggtgtctggagacatttttggttgtcacagctgggtgggtgtgctcccggcatctggtgggtagaaaccaagcatgctcctaaacatcctacaggcacagaaccgtctcccacgaccaagcatgatcaagtcccaaatgccaataatggccaggttgagaaactctgcacagaagcatccagttatttgtctgtttgctcaacaagcttgtgctcatcatgctctgtgttcctgacgctgtgctgggtgttggcggtgggaagattacaagagtcacatggcagctgtcctcctggaaggtacaacccagtagagatgcagactaacagagagccaattacaaagcagtgtgacaagcgtcatggtggaaaattaaaagctcaaacaagggcacatgggaggggcttccaacacagactttgggggatccaggaaggtctaagaggaaagtgggtctcaccaaagccttgaccataggcagagggtaccagtggaaaaggtggggtgaagaacattgaggacaaaaggaagaagtgcaggaaggccctgaggcaagggagtggggggtgccctggagggatggcagcagggcagtctgtcagacccaagtggcctccagccctagaagccaattagtcctcctcaaaaagctgtcactgtcccctaagaattgctgccaggctcccactggcctgactcagtctttgagagtcttaaggaggaggtctctgaaaggtacacaccaagaactctccccagcacagctgtttttaagactctccaccagcgtcattggcgtgttgggaagaaaccctctgccacagaggccagcttcagcctttgcctaacaccgcaagggcaaatggaaaggtaaacgggaaggagatgtctccccagcaggctatttgaggacagtcttccctgcagaagatctcaacctggggtcaacagagtggaaatgttagagtagggagctaggcaaacatgagcaggacaggtgagggcccccacaggaatgtcaggctaccatcaggtgatggtcaggtggttgttaaactgtctctgtaaaataataattggttgcagccagctccaagcaaggacagtctctcaatagatacaaaacaccctgatctggtgatcagccgcttcccgataagatctcaggagctgggcaagcagcctggagcatgcgcaccaagaggcaaaatggcggaatttaaccagtatatgacctaccttcctctgggaacgcacgactggtaaggggaaaaatgcctcaagtgagcatgcgcgcaacttcagtaatcacactgtgcatgcgaccccttccaagtgctggcaggtcaccacatacgcggacagcctgctgcaagggaagaatcaggggagatgagacgtaaatcccagaactatgccaaatacataaaaccccaagttaagggtcaggcagggcacttagatctctcaagttgcctgcctgacccaagtgtagtgtacttccttttgttcctgctctaaaactttttaataaactctcactcctgctctaaaacttgccttggtctctccctgtgccttaagaccacttaaaaccacctctgcccctcagctgagttctgtctttgagaaggcaagcatcaagtttgctgcagacccattggattcaccactggtaacagaagttggggtaaggcgtggggcctgagaattctctaagagtaggtgcagccgggcgcggtggctcacgcctgtaaccccagcactttgagaggctgaggtgggtggatcagctgaggtcaggagttcgagaccagcctcaatatggggaaaccccatctctactaaaaatacaaaatcagccgggcgtagtggtgcatgcctgtaatctcagctactcgggaggctgaggcaggagaattgcttgaacctgggaggcagaggttgtggtgagccaagatcgagccattgcactccagcctgggcaacaagagcgaaactctgtctcaaaaaaaaaaaaaaagagtaggtgcaaaaggttatgagggtgtgcagttttctatgggagagaatccatagcttttatccatgtctttgtttgttttgagataaagagtcttgctctgtcacgcaggctggagtgcactggtgtgaacatggctcactgcagccttgacctcccgggctcaagcaatcctcctgtctcagcttcccaaagctgggaccacaggtgcccacgaccacacccagctaatttttaatttttttgtagagatgagggtgttactatgttgcccaggctggtcacaaactcctgggctcaagtgatagaactcctgcctcagcctcccaaattctgggattataggtgtgagccactacgcctggccttttatcagtttcttgaagggagatagggtccaaaaaagggttaggaacttctaaataattaaaaactcacatatgcttcatattatttgatgtcagttaaaaccccaaaatagtgatcaatacatttcttaccaaaggatctactttaaagacagttttacattcaatatccccagcaagactcggcttaccttcagaaaattgctcagaataaggaaacaaatggtgatttcaacatttgaagggggtagccctcatctctcaaaagtaataagctattagaatgttttggaataccagaccaggtgcagtgactcatgcctgtaatcccagcacttagggaggcagaggcagaaggattgcttgagcccaggagtttaagtcctgcctgggcaatatagcaagaccccattctccacaaaaaagaaaaaaaaaaagacaaaaaagagaatattttggaatatcaaagaaccagcagtaaatctattgaaaaacttcagagtccaaagtatttctaaagcccaaattgtcccttcatatatatttcataattcaataggaaaagaattctttcttcagaatgaactttggcaatagaaaagaaaccttatttccacattcagaaaggatgacaatgctggaaagcaaattaactttttttaacttttttgcttgtttagtttttgagtctcgctcttgttgcccaggttggagtgcagtggcaccatcttggctcactgcaacctccgcctcccaggttcaagcaattctcctgcctcagcctcccaagtagctaggattacaggcatgtgccaccacacccggctaattttgtatttttttagtggagatggggtttcaccatattggtcaggctggtcaaactcctaacctcaagtgatccacccaccctggcctcccaaagtgctgggattacaggcatgagccaccacgcctggccgcaaatacaattcttaaagaaaaataaaagctaaattggaataggggattggccaccagtcgattacatgaccttggatgtgtcacacatcctagggctcctctcctgcaaaggaaaatgtattcatcatttcccagggatgccataataaattaccacaaaccagctggctaaaaacagcagaaatctattcttgcacagttctggacacctgaagtccaaaatcaaggtgtcagcaatgccatgctcctccaaaggctctaggaaagaccccttctctgcctctcctggcctctgatggttcctggcaattcttgagattttctgggttgcagctgcactgctccagtcactgcctctgtcatcacagggcattctttcacatgcgtgtctgtgccttcacatggccttctgagaaggacactagagctgggtgtggtggctcatgcctgtaatcctagcactttgggaggctgaggcgagtggatcacctgcggtcaggagttcaagaccagtctggccaacatggtgaaatcccatctctactaaaaatacaaaaaattagccaggcctggtggcacacacctgtaatcccagctactcaggaggctgaggcaggagaatggcgtgaatccgggaggcggaggttgcagtgagccaagattgcaccactgcactccagcctcggggatagagcgagactctgtctccaaaaaaaaaaggacactagttatcggatttagcgcccacccgaatccaatacaaccccatcttcactaacattatctacaaagaccctgtctccaaataaactcacattctgaagttccaagcagatatgattttggggtgacactattcaacccagtacagaaaagactggactagacgagctcaggtccttgtagctctgacttcccaggtttctaagatgctcatgtaaatcggaaggcagaaagatggtgattttccttcagataacatcatcttctcagcatcatcttttgagccttctcaggccagtgttctctcactgtgctctgttctcttgtgctttgtgtctcggcatctctgaaatattattgttttcttttctattttatttatttattata

SEQ ID NO: 17646 - DNA, 183334 bp, Homo sapiens
tttaccctggtgtcttcagtggtttttaactcccaatctgcccctatccccttggctgcctacactttccttttctggggagcaatcagctagtcatgggtatttttcatgaagagtcctgagctttcctccaaccacgcagggcctttaaaagcagtccccaccccacaaaacaaagacctggatgataatgatttaatggcccctccatcccagtaatttactttgccttcccctaaaaaacttaaaatggccaatattgatggcatacatttactaatgtttaaatatctatcatatggtgttcaattaaagtgtttaaagcttttttgggtaccattacgagttgcttcatttttatcttcttccaattttaaaagaatcaccaaggattattcttctagcctatgctttctcaccagagacaaatgtccacttttacagctttattctggtaatgcaaataattttatttataataaataataatacatttatttacagaaggcattacattaaatttcattgtataaaagtttcacagtatacttcttgcatatgatatatttcatcccctctactacaaaactaagataaaaatcaagccacctcagaaaacaaataagagagaaaaacaaaaacagaataaaaaacttgtttgtatatgtcaataagaactgtgaaaatattctgtgcttataagaagcccaaattccctggtatctttctaagatcctttccaatctggtctcagcttcactcacttttcttaacttctattccagtctcttcatctattttcatgttacctctgcatagaatgcccattacctttttctctacctataaaatcccctgcccactccctgcaaggttaaatttcagtgccatcatctatttgaaagccttgactttatttattctctattatagggatcagatgcaattagatcattctatgtatgttgtctctacgtagcctgtgaatattcctgaggttagggcctagcacttcaacatctctgattccccaggatctaagagacttcctcctgcagagaagtaactttgtaagtgtttcagtgcattacatgagcacagatgctgcagagaacaaacattagtaattactatcattgtatagattatgatctaggagagaagataaaaaatggtcacattattgtaaaataagctatgtaagtgttattatctcagagccaaataatagactcccttcccttgatgcacttattttgtattaaagacaaatggtatttccccacacatgtgtttagtgacccagtcctaccacaagaaatgccagtctccttggtttgaaatactaattaatcattttttgttgtaattctgggattttagagcccacttactttatttaactttttacaaattggttaaaagaaaataattaaatcaacctgttcaaatgatcctagaattgcataacagcttaaatataattaagtcatatttcaaattaagggacccagcaatgcagctaaaatgttactgctcatcagtggttgttattctgagtcatagaatgccacgaattgaacattcctgccagggcaccaccctggtccaccctcccctgctgcagccctggtgtgtcactcatgttgaagtctgccagtaagtccaaggaagtttcctatagtgttgagaactgttcctcaccaggattctgaagtcaagtattttgtttttttgttttttcttaagtaccagttgcccaaatgtctttggacaaggtttctggcacaggcttgttcaggaaatagggagggagaaacacctattttatattttaagtgaaaaaacacacaggaatattacgtaataacaaaaaacaaatggttggctcatggtgaagtttaagttccatatcactgtgactttattttggtcagagaggaagcaatcataggttctcaaggtatatcaacaacaactattaggataatttcactagactgtttaatttaataggcttaaaatgaaatatgccaatgttacaattgagcacaaaactacttattttctcttcctagttacaagtgaaagaaattaatgaacagcaggtttgcagtggaataacaactgttgtatccatttttgcctctgcagaacatagccctggagcccaatatatgccagaaaattaaaaattattgaactagactaagttttccatatgagttagctttgtgagttagccccactgttttggggtatattcccctaagtgcttacatactaaaacttaaaaatccaaatcttcataaaatctttgtaaaaacggaagcagttctgtacacttccacctacccctaacacctgagagtggaggggatggggttggggtaaaaccacactttgatgctaccttaaaatgtatttaaaatctcatatttgacttttaaaaagaaaacatgatttaaaaatatttcttataaaaatctgttattttagcaaacaacaatttttaaattatttatttttgagtaaaatcagcaccacccccactacccaggtgggagtaccttatttatcctgtagctttgagaacctataatcttactgctaaagaaccctggcatacattagacacggagttctagaacctcttctattcccccaacctcttagcggaatgttcttctcttgtaaaaaaattaaaaaaaaaaaaaaaaaaaaaaaacctctgacggccagccaatttgaaaagcaaattcatgtgaacgttataatgggttctgatgtcttcatgcatacccattttatagaactatcttcaagataattccctaatccaaggtaaatatttttaaagcgaggattccagaaataataataggagttgatggagatatttttaggcggacattaaagttcctcttctgatggccatcaaatttcaccacttcctacagggtctaccacacgcagagcctgccctgtttacatggtctgtttaataccaattcttctatttacagagaagaatgattcatactaaccgagcacttactttaatccaggcattgtgctaaatgctcagaggctcggttcatttaatccccacagcaattctcagaccagaagtagtacagtattttcattcccactttacatttgagaaaactgaggcttagataaacttgatgacgtttcccaaatcacacagctactatattgtggttccaggacttgagtccaagcagcgtaactccagaaccttacttactctagttactttactcagtatattagattaactccaagaagaatactttggttttaagtatatgtttttctttttgagattattggttaataatctcaattactcttgcctcatttcatagacatccactttccaaattcttaatcagttcagtctctaatctttcagtgcagccatccccaaccgttttggcagagagaccggtttcatagaaggcattttttccacagaccaggggtagggggaacggtttcaagatgattcaaacacattacattcattgtgcactttattcccattataattatgttataatatataatgaagtaattataaaactcaccataatgtagaatcagtgggagccctcagcctgttttcctgcaactagacgttttcatctggggatgatgggagacagtgacagatcatcaggcattagattctcataagaagcgtgtgcagttcacaataaggttcatgctcctactcatgcttccaaacccttaaagagatctgatcaaatcaagtctcatttaaaatagaaaagtatgtagtataaagtctagagctgaaacatttgtcatcaagtgtctcatatcaataactagtttgtgactctgggcaagtttctgtcttctctaaatctttactcaatgacatgtctttctgtcagtcagaataaaattggttaagaaaataaccggcttgacatttatttgtatttgggtttattgaagttcagaaaataagcactgattctaaaattaattctctaaccatagttatctctcagtctctacatttgtattgactagacatataaaagattcataaatatgtaaacatgtaaacataaaatttgtaacttgtgaaaattaattgtaacaatatcactgttagtgatggttatcaccaataatttgtaagtcctagaggaaataaaaatattaaaattgaaattatgtattagcccccagaagaaaggtaaatttcccagtaattgtaaacttgaacatattatatgttaaccctactttatttcaatattttacaatttctttttgttttttctaatgaaatatattgcaatttgctaaaatgccatatatgtatttgcatatgtatgtatatgctgtacatatatatgtacacatacatacatacacatgattgtgtatatatagacacactattatatgtttttgaaaactaagcaatttggagaaatatcattgggaaagtacttactatgatttttaaatgtctacgaattaatcaatatctattggttactgttcaaagcacagagagtcatactgagaggcataagacataactgatactaccaacagggaaacgagatatacacaggaaatgaattccttggcagggtatgagagcattgaacacaaacaaaggaacttaagtaaagtccaatgggattgaactgtgacccaacataatacaatttttctagagactcatttgtgtaaatttgaagacagaactgagaaatgacattataaaaactaaaaacgggagaacgagatttttaatgtatttactaaatagtgaatcagttcagatacataatagaaaaggaatttcttgattaatgggtcaacatactgagatctgatggccttcaacctccttgggtctgcccaccccatttttgacgctccttaaacttcttcaacttttgtcttctccagcttttagttgctgtgatcctctatctggcagtgtatccagtgaaccctgtgggcttcttccttcctgtccctcgtgttacctgttctgtgctacctgtgttgtgttctgctcaacgaaccctcctttgggtggcactcttgtcctgcctagccctagttctgctagagatgctcaattagttgttgagttgaagaattgaattgaactgtttccctcagattcctctaaacacaaatccacttattctttctgtctttgaaattctcaaaaccgctaagacacagctattttgaaaatagccagcattggttgaagctagggtgaatatggcttttgactcagagaggttgttcaactcaccaggaaagggaagcattgcaagttcctaagcacttctggactcttaatgcattttcactcgtgaaagtttcaagcaagaaaaaaataaagtagtgccccgagttctttattagattcaattaccagcgtacaaacatcctaattcacttaaacaaaatagcccacacacattccatttccaaggaggctgcttttcttcctctcttcccttctcgctctccctcttactgtttttcctccgtcttgcttctccttttctccccttatcctagttatctcaaagaaaagcttatctgcaaccaccctttaaccacgaattaccataaacgaagcacccccccccacccccccataagcgaaagcaaagccctcagtggagcctgtcggggtggtggggacgccccctttcgtgcaaaacgacttcacggtgaatttcaagtgtccgcaggggatggaaggggggattccagatcctcgcattttcacagacggcctaatccctctgcgcaatggacccgggaaagctgcctcccgttaagggcgcccaggcactgtcaaagcgccctccctgcccgggccgggagaagtaaggggtgtgaaggcggagccactgggctggcaacaccctcccgaaggtccagcccttacccgccttcctaccaccttaggggatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggmattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactggtgagcgactcgcttttctctgagcatctcctgctcgcgggcttggggcttrgagcggggagggaggtcctcagagccatgggccagataggaagagagagcgcccatccactttcsggcattccaggtactcaggccaggctacggggcaggcaggagtttcgcgttctggttttgatatgaattagttttmgtgtctctccaaagtccttcaccctaggagtaggagtgaggcagcactgaaaaccttasaaggtagaattcacttttaaaattaaagttgtttttacaatacacattgtatattaggactttgctgaatatttcctcccctccacccttttttatggcatgggatgggagggtgatgcttatagggcgcctgatacatatgcaaaattcctaccctcgggttgttccagagtggacattattgaattttcttgctgtctactatttaggcttttttcccatgcagaacaagaaaaggcagggatgcaagacgaaactgccacttgttccaaaatgatgtttctatgtcagcacccaagaggagggatattttgaaacgtagaaaggaatggtgaacattttctctgtaaatatcacagggcagtctacttttaagatgcaaaatatagtattgttatttgtacataaatgtgtatttttaaggaggggacttaaaaacatagtggaaatgcaaagttgtatccaatttagaaaaagcttgaaatatagcattttgtaagattttcccaataatgaactcatggtcagatcttttttaccagttactgattggggtgggggaaagttgaaatggtgaaaaatggaagaaggtggggggaaagtgtatcgatagaatctctgtgtgaaagaaaatcaccttattaatgggttaattaacagctggctttaacatatcattgatattcaattgttcagtgtttttactgctggcatggttattagtactagttaatttagcatttttaccactaaaaacagggtagagccagctagtttagacctgccttagatggccaagcattgttaagttttatgaagatgatttagaagttgattatcagcaagcagagcttttttcagaagggaggtaatgtaaagagagttaataattagctactggcytttcatccaaacatttcccactactcaggaaatgtccaataatccaaacagtggtaactgctgaacagcattatagccggtgagtggtttaacttaccagctactgccactactttttacacatatttgacctatgattcttctccaactcaaatttttttagattgtattttgttgtttttgtgcaaaatctgaatacagtagtttactatccaagttgtactttttcattctaccaaataagcagtctctagagtagaaatgatgaaatgaggtttgcgtatcctctaaaaagacaagagtgaaacttgaagtaacagagaagtttaacaagttacaatttcatatatatgttggtgaaatatacattggtgaatccaggaagagacttaaaatatttagaaaccttgtgtgcactatatttatgcccatttcgcaacacatgagggatctgaaattggactgctttcccatcagtcattatattctgtaggctcttctttagcaatctctttcagatttggaaacttctcatcaattcagagtccgtttgtaacctggggactcatcaccattcttatccatgcacactactgtagagcttatctttctgtcttcaatttgaacccaacttccagtctaccctcctaatacatcatttttactatatctgtttttagtcaaaaatctttggtggttctttgttgcctttaagataaaatccaaaattctcaactgactgccctaatccaacaccctctctctatctcctactactcctatgtcagtttcttattgctgttgtaacaacttgccatagatcaccagcttaaaacaacataaatttactattgtacagttctgtaggtcagaagtatcactgggctagaatcaagatgtcaccagggctgcatttcttctggaggttctaggggaaaatcagtttccctgttttcaccagcctctggccaccacctgcattcttggcctgtggcccctttctccatcttcaaccgagcagggtagaatcttcagatcttcccccatgactctgctttatcatcacatctccttctcagactctgaccctactaccttcctaaggatccttgtaattacaatgtgcctaccagaataatctcctcatctcaagatctttaatttaattacatcttccaagtcccttttaccatctaagataacatattcacaggttccaggcattaggtcatggatatctttgggagaccattattctgcctaccacaacccataagcataaactgtccattatagccaatcacttttctttactttctccataatcctcatgttcattttgccactgaagatatgaccttgttttatacatcgagaaaagaattccacctttccatcctaccaccctctgacatctaaataaactctctacagccttccaaactgggtttacatcagaacaacaagccaccagcatcccaataaacttcctatttgatttagactgtcttatattagctccttacaacgtttactaaaatgattcatcaaaaagatgtccttatgtccaaaggattgttattttatgtatgtcaaagtctcagcataaactgatgtcacatataaaggatttaactgaagacagtttcataaagtgacagtttagrgaggccttaaaggaacaagaaaagagggtggagcatctagygcaagcaacagtagggaaaaaagaacctgaagcaaggtgagaagaaaaaccatgaccattcctaggcctgaggaggtggcagtgttagtttgattatgaactctagttatgggagggtggccattagactggagttgtggtcataaaaaggaatgcagctagtgacaaaattgaagcccagcagagaaggagtaaggaaaataaatatacctcctttcctcccaccctctgatgtcttgctcagccttcccattggccatccccaaatggcaagatccaaccttycagagaacaaagggcaagacaatcaataacagaatagctagcacaacttaaccccgaaatgtattatgtgcaaggcactgtgccaagggctttgcatgtattatttcattttaatctaaaaaattaagtttactaattgatcacaagcagtcacagatttctttgttcttttttcactccctcagcttcagttgattagccttgaaaaaaagaaaagaaaaaattaaaactttataactattatcaatattttagagatgaggaaatcaaaatatagtattaagaagttaatttcatttgtccaaagttgaagaactaatgacaaatctactcaattcatatctctgacctcaaattaaatgctctaaaataatatgctatattggctgcctaaagataagttcattctctcttgctcactcctctaaatgtgaaatccaaacatagttgtctaaaagacttggataaagacctaattaatgatacaagtcaatcttttatttccatgatttttaggtgtacagcattaagtgtaactcaagtaagactactatttctcgttattaagaatataaatatagaattagccctaattaaactatatgtctctcttccctagaaacattttggttggcctagaagcaagggtcttcttttcacaggcaagatttcctattcaaaatgaaatccagtgaggagatgggagatggctgaatatggggaggaagtcagccacttattcaaaacaaagaatgactcccaatggcagacaatgtattgtcaggaattgctgaagatggtgaaaattgtcttactcattgtgatgtttgtaaaggcagcaatgaattcacgggatttttgtttgtttagtaaacaggcaatgagagtaaccatgagacacatatatatgctatactagtttaactatttctcttccctcctgtcataacacttacccagctattttgaagcatgagctcttgggccacagcttatcactgatgttctgacttcagtagatagatgctcctctaacatgttcctccacttccaacccaataaacttcccactagatttagaacttgctgaatttccacatcttaacatattttagtagaataaagtagctcatgtttaaaatatatttagaaaagttggggactaaaatgctattctttacctacacttctcttctgttgtgtgaaatacaaaatagtgtactcaaattcatgttaagaaactgagatgaaagatattttgaaactgttgccacagtgctaaagtcagaatagattgcctattcagagcagtctgtgactggagaattgtattcgccctcaaagcaagtacagtagagtatcaagagatgcaaatgactgcatatatttctatcttcaagattattgagcttctttcagctcctttattatgccagctactctaaagtctccttggggactttgcataagtagttactcccactgctactgatctcaatccctgaataaacgtcatttccaagagataccctgaagtagattggaccctaccttaggacatgtgtatcccagcacctttgcttctattatataatgcaccacggtattataattaactatctaattgcctgtctttccagcttgctgtatgctctgtgagggtaggatctttaaccataacacctagaaataataggcactttttaattgaatgaatcgcaaaagaattgactattgacaaactcagaaaatacttaagggatcagattgtccctttattatatacctctgccttattttattatacctctgcctgaaatatttctgtctatccaaatttataaataatggaatggaagacaccatcagttgaaagatgcaccattattttatgtaccactaaaaaagacaagccactcccaatccaattataattgctagattgttagatagttcctagtttcagagatgtcaaaattgggaaaatgtgcgtctgaaaattacaatcaataatatacagtgtatggtactttttaccatggtacttttctatttgtttggacacttaaaaattgtgtcataagattttgaagaggctagtatgtgaaccccatctagatacagagatataacattgttcctctcagttctcttcaagtgccaagtttatatctgatttaggggataattgctcctctggcaccaacagcctcaccagatcccaaaaacagagctccctccaaatgctctatctttagaagagagcttcaggagaaaggtgacaataaagtaatcatataatgttccagttgcacaggattaatgactctagctttggcaaactcttaactttttgtcatgttggtggtaagctccagggttgtgtatataggaagaagactaattttaatcaaaactttcctatgatttaaaaggaagataaaaaagtcaactaagttttaaaaggaaattaaaatgcatatgctggttggtgttaggaattcactttatgtgttaaaaaaaatcaattttatccaaacaggagatccctattaacaagataagtaagagatctgaaatgagaaatcattgtaattcaaatatgcaaaggagtggatacacatactctttttgtatgaattatatgagatctcctaaaataaatgcaaattcttaaatttaaatatagcacytaagtcactttaaaacatcaatagttaagatggtttatatattttgttacaaatcatatatccttactacaaattaaatgtactttcaaaattattttattaattagacttttattttaccaaatactaaagtctagaaatacatgggtactggccaatccttaaaaatatctgtgtaacacattttacttataatatttttggtgaaatgatcttatgccgtataagaatacatgcaaatagaaatacacacacacacacacacacacacacacacacacamttctgttcataggattttgtttatttggtaggaggttttgtattattttgtgacaactgcaagtaagcactttccatcatgagaaatttagatagtgagtgagtacaagttccttaaaaaaaaaaacaaataaaacaaacaaaaaaaaccactttcccttttacccttttgtctatattagctaactaatcctcccagtcatccacttagctttgctggtggaggtcacatgggaacctttgcacaatctgaggtttgcacattctctctaaataaacaattgcgtttatcactagatattcataattggagctctggcttcttattttgtaaagttcactttccaaaccatgtataataaaactaattgccattatgtgttattctaaaatattttaagaacttttcctggggaagatgtattttaaattaccattttcttacctaagcacggctatctcaaatattgaaataggcttatacaaacttaccttaagagtaaccttctttttaagtttttagtaacattataaaacagaatgtgatttcctaattttagaatgtcagttacagacaagttaaaaactctgaattaaagaaaaattaataaccattaatttttgcatactaaaaatatgagtatgtgccacttgttatgctgtgttccaggagaacaaagacaaataaaaggtagtaagtctctgcctttactggtggaagaggtagtagacatggaaagacacaatggtgggagaggctcccaaggtgctttataaggaataacaaaaagattaggtttgtgttgcaggaaagtaagccttccaaaataaaatacaagatgaaaacaagaaaatttatacagccccgactgtttaagggtcacaagctaagcagagggtattaaaacaagatttccatctttcaggagcccataattccatttcatgtcatacaaaccatttcttttatattattataataggaaagatagtaattcaactcaccaatgaggtccatgaaccattttattcagtagagctgaataacataaataacataaataaatgtaccccaaagattatccatcagtcaactctaccaaaccagttatttttccaaggctgaataattatgatcatgttaaaatgagctcttgtcccttgttttgtctgatccagttttctagcttcaagccaggcatttttagagctctataatttattaatatcaagtatcataatatcactaggacctcataaggatggtcaaatgagagrgcaggacaaataatcttatttatcatttagaatgaaaaataattagctttattgcggtctgggacttatttcaagttggtagaatccatccaggaaagaccatatttgaggtctgccaattcttggtccacaaacaagaaactttgaatcagtctttcacctctgaaatgggtcttagaaaaatcagatttgaaagatagcacgcaaaattgaaaacaaatatgttaggatgagattataggtgttgtttaaacacttaaaaaatattactgcagcataatttttagttagaaatttaattattgaattcaattccctcaattcttcagtgaaataaattgggttccagagagactgagtactgccaaaagttacagtaaaaacaattgaagagtaagagctacaatccaggatgcttgacttctagcccagttctcttcttgagacactggaagtgtctcaagagcaacaaattaaaaacttttggaggtaacaatacttttttccccttctggagagattaatataaataagacattgtagggaaaatagatataattaaagttactgatataaagatttatactgatataaagttactgatataaagttttctattttaaacagccaatacataagtataaaattagtatttaaagcaaaagagctaaaagccctggtatttttctcaatactttgctcatttggaaaaaaatgaaaataaatatataactacagcagtttctgaactaccattattaagtgaaatacagtcaataacaatataagtaagtgccttaagaaatgtcttgaaatgtctgtaataatgttaaaatagctgccatactttacatttgactcacctagcttatcattaatatatgagtgcctactatgtgcaaaggacctttaaaaggacaaaggagtataaagataaatccttccagagttcaacaaaaaagatacatgtttaaattaacatggattcaagtttacatggtttcaagtttgagataacatttaagctggactttaaagataggcagcactaaaggaagcagggatgaaaggaagtgacattttaaacagagaagttagtatgagttaaggtagcaaacgagaaagttcctagcatatgtagggaacaaaggttactttcaaggtggaatatagggtgccctgaggggaaaagtgggaagtaaatttgtaaggccagtgcaaattgggattgtagacgttaattcatagggaatgggaatccaaaatgaatcaaaataaaaatataatgattggtctagaaatactaagccataaacaaaatctgggtgaaaacatctaatagtcaactacaggcttaaattactaaggaaaaaaaaaagttcccaactattgcagttgtttcacatacaacagtaattctatgaaagattttatagtatactgaattatggaggcacactgatattttttaaaatggcccaaagtggtttgcctcataacttaaaaaaaaatttttttaaccatggatttaagagtcaataagggtttttcacaggtttctaatgtacagataaatatatgtatatttttctaaagtagaacattagatctttctctaagagtatgatgatgacctaggctggacagaaggaaaaaaaaaaactatgtagaagagaaaagtataataattttaagaggtgataaaagagcaggaaagggactagtgcctttcaaatcctctaggttggttcccaagctgtgagtttttgtttagctggtaaaggtgacagttgaggggaagtgacagtggataatagcacataatttgcagtgaaggagatgattacaaacattcataatataggatggtggtagtagaaagagagggtatggagttatgcaggcctgaatttcaatgctagtcatgtgatcttgaaaacatttcttaacttccccatagttgattttcttctataaaattaggataacaaatatttaccttacaggggagaattagagcataggaaagaacttgataaacattcaatacgtgatagctcttcaataaaaaccttttgttaagatcccactgtgtgcttaccmctgtgattctgtggcttttaatctttggcagactatgggaaagataaattgtacttagaaagatgatcaaggagcacttcaaagccccagttcaaaattatctcctcattctctctctctttctctctcacaaatacacacacaagcacactttcaccctaccaattaggaattttaagttaacaagatactttttttaaaatacagtgtcctttggataggcaaatcaccttcacacttgagtgtgattagttctttgcttagtgaaaagttgctgggttctcctggaattggaagaaggcaatgtgaattaggaacttcttgagggtactcagtatgataggaaggtgggaagaaggaggaagtaaggggagacatagagagcgagaaacaaagagaaaagaggccacaaatattaataagtagtggttcttatttggactttccccttggaggggacctttccgtcccctgataatctcttaggaagataattgacacttaagtttaaattgtgaagcctgtcagttgagaaaaatgttgagacaagtctcaatcattttaggacgtttatttgccaaaattaaggacgtgcgcggggaagacaggtctatgcctttctgggaagatgattttgagggctccaaatttaaaggggaaagggtgggatactgagaaatacagttttcatgtgagagggtagcagggggaaaatagtcattcatgcctctgtctggcttagtcaatctgaatctgcatttttacgtaagataacatagacaaatggggcaggggaacaatcagatatgcatttgtgtcaggagggcagaggggtgactgtacctgaaaacagaagctatctatttacattgccatggtaaattttmatagaaacactttatggtaaagatcttggcgctcactgagaatttccttgtgggcaaaatatgagcgaggtgtgtagcttttcatctggtagccatctcatttaaaaaccaagaggcaaggcagttttgcgtgacccagttcccagcttaacttttccctttggcttaatgagtttggggatccgagatttattttccttccacacgcctatgccaaactcagattccttcctttcatccctgtttcatctgttcaggctggttagttcccctttycaatccacacagagaaagacagaaaagmcagtgagaagctatgtgtgcaggacttctctgccctccactccatctaagctctcaagaaacttttagattcttttgttttttctattcatcggtctcttaaagaggcaatcccacttctccatttccacttcctaataaagaatgctaagtaacttaaggattttctttaaattatgtagctattcaatcagggtcagtcctagttaatagtttttccccacttcccatagcctcggcttttagcttagctttggcagtgaagatctggccctaagctcttgcgacccaacccccaacctaaacatttcacaggctactgggctgcggaaagctgaggctgccaactttggagcctaggattcccaggacatcaggtcaagcaactgagaggtccacccaggggtaaattccacacatagtttcttctctcttgggaccagcgctttaacatctgggtgaatcagatcgtgcagacacggtaactaggcgcagaaaacagctggacacgttgctgggagcccagacagaacgtgaccagtagttctcagaaaccgcttctaaataccagctccaacaggcttgtagcgtccgagtgcggataaggcaagagcaaaaacgagcatagtttgggccgttggggccaaatctgcacttctgagagctacttttactgctaagctttgaaattggatttacccagagggaagcgttgcagtggcagccgcaggcaggtaaractagtatttgcactcacacactccccggattcttcacagacagggatggaagagaaaacttaggaagttgaagtttggcattaaaataaaggactcgccaccactctgtgcaccttcttgagggagttcattcgtccggagcgcctcacagcttagtrcgcctgcgcacgcgcgaactgcggccccgcctctcctttggggacgggagacgtgcgtcgggtcgcgggacgggggctgcgcatgcgccttcatttmgtcagcccrctgttgcgtgctgccagcgggaactgtgtaggggtagattttcgctgcagtgttccccgagcctgttagacgcagcgcgccgggagactgagagaggaaaggatagaggaagtgctgccctaggctgcatgagtcgaagcaagcgtgtttccttcccgccaggcaagtgcccttagaaaccgggccccgcccccttcctggcctgcattcccatcccctctcccggggcggaggtgaggacctccttggttcctttggttctgtcagtgagccccttccttggccatgaagctcgtgaggaagaacatcgagaaggacaatgcgggccaggtgaccctggtccccgaggagcctgaggacatgtggcacacttacaacctcgtgcaggtgggcgacagcctgcgcgcctccaccatccgcaaggtacagacagagtcctccacgggcagcgtgggcagcaaccgggtccgcactaccctcactctctgcgtggaggccatcgacttcgactctcaagcctgccagctgcgggttaaggggaccaacatccaagagaatgagtatgtcaagatgggggcttaccacaccatcgagctggagcccaaccgccagttcaccctggccaagaagcagtgggatagtgtggtactggagcgcatcgagcaggcctgtgacccagcctggagcgctgatgtggcggctgtggtcatgcaggaaggcctcgcccatatctgcttagtcactcccagcatgaccctcactcgggccaaggtggaggtgaacatccctaggaaaaggaaaggcaattgctctcagcatgaccgggccttggagcggttctatgaacaggtggtccaggctatccagcgccacatacactttgatgttgtaaagtgcatcctggtggccagcccaggatttgtgagggagcagttctgcgactacmtgtttcaacaagcagtgaagaccgacaacaaactgctcctggaaaaccggtccaaatttcttcaggtaaaacaatcttacccagggataattaagaatgggcagagggattggtataaactactcctaaagttttagaactgggaaaaataagaagagaaagtctttacttagctgggattttcatgagataatgaaataaaaagagaatgttaaatgtctagcaaatttatggagtaaacttcgctgaaacatatgaagccttactagcgcttttggctttaagcctttgtgrgctgattaatgggtgttctaggagattattttgcctaacttttgtaattgtgattctaggtacatgcctcctccggacacaagtactccctgaaagaggccctttgtgaccctactgtggctagccgcctttcagacactaaagctgctggggaagtcaaagccttggatgacttctataaaatgttacagcatgaaccggatcgagctttctatggactcaagcaggtggagaaggccaatgaagccatggcaattgacacattgctcatcagcgatgagctcttcaggcatcaggatgtagccacacggagccggtatgtgaggctggtggacagtgtgaaagagaatgcaggcaccgttaggatattctctagtcttcacgtttctggggaacagctcagccagttgactggggtagctgccattctccgcttccctgttcccgaactttctgaccaagagggtgattccagttctgaagaggattaatgattgaaacttaaaattgagacaatcttgtgtttcctaaacwgttacagtacatttctcagcatccttgtgacagaaagctgcaagaakggcactttttgattcatacagggatttcttatgtctttggctacactagatattttgtgattggcaagacatgtatttaaacaataaactaaaaggaaataatctccacgtactaccatcttgattaaattgtgtaattttttataggaattatgagttatctgtagtacttggaaacagaaaatgtgtgtatttaaagacgatgcctatgcagtatattgtttgggatagattgcaaaatttcacactgcatgctttgaaacagttttccttagaaaaagcttttgctatcttatcctgtttacattatttctttattttaattctgcttggtgttcttgcattgcatttaatgatcccttttctccccacctccacacactacattttttttagatttaaatagttttactattttaaatgattgccgtacaattagtagacttgaagacaagttttaaatatttttcttcaaaggcttgttaaaccaatcatgttaaaaggaaattcttggttttggtttgttgttgttagcattagtcatatttgatttagagggtaacttaaatcagttatttttagctttttagaactttgatctgctagggattgtcaaaataatctccttgaggcatctttatttttaaaatgagattaaagtatgtgatttgcttgttatgtggctaattagtggcaaagctggaagtcattcccagtctggactttagttctttgcgccaaaacatgctatattatttatttatttttttgcttgtcaaagttatacttaattctgttttatatttgtatgtggcattaatttgggtttgcacatttttattggactattttagttgtgaagaagcctgttctaaagtttaagtcacatgactagtatgtggcagttgacttaaactccaatactctttactatcattgacttaaactctgatactctttactataattatggaattgtgcaaatacctccgagtttaaaatattatttttattatttttggtgcacattcctaaaagttaaggaaggagcctcagtaatggaattgcttcttgaccttttgcaaacytcaatttagcaaaataattaggaacgatctaatagtgatgatacagtttttaactgctggatcagcgacgcctatttcaagtagtgatactaactaaactttcgccggtctttcctgtgtctgtgggccttcctcctggtgtgacagacttggggatttcttgtaaacttcctaactagtctgaacctttttatttcttattgggaactgacacttccctatactttaaaactcacatatktatatttttgtacatctatctcctaattcaaaagtaattgagattgtcatttcattataattccgtgagtatctttaaattactatcaaatatgttactaaataatttaataagaatatagaaatgaagccactgagatccttaaagttgaaacctgattgttattatattttcagtaaggatttggagatttttggacatttttactctcataatctatgcagtactgaaatgaggtctaataaatataaccaatacatgttaggccataggttcttaaatttagctacctgttcacctcaacttgagagctcttaaaaccctcagtgtccaggttgcagcccagactagttaaataacgttttatccctagaaatgttttttttaaagctacccagatgattccaataggcgtcaaggctaatagccactgattcaggccttgctattcaaaagtatggtccgtaaaccagcagcatccctgagagcttgttggaaactagaattcagggatcttttgtagacctactgagacaggcgctacctgtaccaacatctctagatgattcctgtgcataataaaatctgataaacaaaggcaataggttattcttcctgtgctggtaaatctctggcaggggtccccagtcaggaaaaagatttgagtattaaggtctttcaaaaaagttaactggccatactcaactgtctataaaacckctataaatttctgtttttatgtctatgaattattaaataaaatttaactcatttttaagaaattacattttctgttatcaagaatacaattcttactagatcataggtgaaaatgtcaataatgataggagcaaattaaaaattcagataattatttttgacttttctagaagacataattatctctggaaagcatatacagtagtctaattccaactgctactcattaagtattggatatgtgataaaaactctatcgataactccaatgtaccttctctaatgtactgtaaatttccatttcctatcatgtgcttgcaaacaaagatttcctatgccactaaactcaataagtgagaagcttgcacattatttcattttgctatagctacgatacatatcaaatgacagctactcctggtccctcatttgtatgttaaattccttgttaattttatgacaagattgttgatcttggatttcactttcattaccgtcttagaaacaaattggatttttctgctcccagatgccactagagtagctttgtaaagctcatttttcttatctttacttagtttctgtctctaactttagtttcctttttcagcttccctgactaattstcttaacctccaattatctttaacagaagttactaattctgcaattcatrtattctggaactggaattatctktgttcctaagcaaccaagtatacatatgaaacggtctgtacattaatgcctcataatagcagctcttatttgggaaagggttatagtacatttaaaccatgtggttttccaagcaagttaagactggctatttgtgtttagtgtcagaatatgttgaattagaagttgaagagtttctaaagtgattttaagggcttgaggagagatgaacccttttgcttagagccagaacttagatatggggtgtaaatatttatattacactaatcattaagagtaatatatttaattttatccatttttttagtgccttttttgaaccartcactgggctagatgtggggaggacaaacatgtaagcaaatcactgttagaagtaacttgtacaaagtgtgtaaaaggacacagtggtgaaaggggtgacttttaggagaaacttyatagagcaaggaccagtaagtttacctaaaaggggaagaagaaatatggagaaattaagtgggaagatggggaggggaagtgtgctaatcacctaagaacctccgtgctacaagaaggagtttgggtttgaccattaggagaaacaattacaaagctgaagcagcatgctaaactgcatttcacaaataccactttggcagcatcaaggatcgattkgaggaggcaagactggaggcaggaagactggttaaaaaaatgcatattaggaagataygagagaaaaatgataatggccttatcaaaggcarcaataatgttccttgcaataggaatgaacagaagtcaacaggaaatattaagagatgggatcaaaaggacatgactgcagattgctgtttagagttatggaaaaaagtagaatccaaaggtaaatctcagatttcttgagtggtgggagagatgatgacacaaaatgtaactttaaaaatggtaattaaaaaaaaatgttttatgcagtggtggttaaatttactaaaagattttttcaggattcccatagtgcaggaattagcaagctatatctcattcaggccaatcagttactgctagcggaccccatggccttgtgctccccatcttaacatagtatctctgatttgtctcacyagacaaatcagagatacacttccccttttattccgtgaggaaccacaagagtctgaactgtggcatcaattttgcagttggatttacatctttcttaatgatttgaaaataatttgtttcaaaaattgattttgaccagcacacaattttgctggtatatcatgtttaagtaaatgaattctccagcagtgaagcacaactaaagtgaagagctgaagagcaacttaagaaagaacaattaattccaataaagttggtaaaatgctcagtaaaataattttcttccaatggatgtcagcatatttaaactttgtggtgtgattcagtttatatactctaagagattcagtattttagaaaagtgctcttcaagattttcctaatgtattatatgtatctctcatgaattgaattgatttagaaatttagtgtaaaagtgttacacacagccaacatgatttataaaggatctaggatgcaattataatatttttgtgaatcaattatgcctttttaggaaaagatttagaagttaaaaatgcagctaatgaagctgttagaaaataaaacctgtattagtagtcttggatttaacaaggagaacaatcaggagttgctaaatatggtcatcaagtagtaaacttcacgtagaaataaaaaaattgaccaagttcagtaaagagatatttatttaggttaaaaataccattcaaaaacattgggagaaggtatttattaatggagataccttcttcagtggcgatgataaagtctcattcattgtttttctttatatagtaagaattagtcctttttaggaagtgtgtgatatatatcaccatctgtattctcatccacatgttacactattatttctaaatttccaagaataatctgtaaaataactattttgcagtatttaatatctctattttcagtaacatgttattatattgtgttgagataaataacactgattaataaattggaatattatgaatgttttaatttaaattgagaaaygaatgagtttctgtaaggacaaacacctttgtgtgtagtattatagttgcatacaaatttgaggctacagtgtttgctttttacaatgaatattttaactctataataattgacattgatatgggaaggtcttaaattttcagatttcagtgctaaggatgataacatttatgataaattgtggagacttggatatcagtcttcttttaaatttcctttctttatttcctaaaattgcctacattaaaaccccattctttagaatgttagttcaatggaagtgcctgttttctataatgtcagagatttaaggaatttaaagcttatttctatttgggtgccacatttgttttcaaaacacccaatactgaggcaagagcagtatttgccaagtagcaaatacaagagcaaaatgttttggcagtcatattgcctggctttgcccagggttggtaccactgtccccactccaggaatggacaacctgttataacaaaagtaactgtgtgcttattaagtgtcaggtcttatggtaagtgctttaaaatgcattagtctttcaagaacccagtcagaagggttttgtcattactattttctgatgcaaaaaaaatgaaattaaagaagattaaataatttatccaaaataacagttagtgggtgtgatgaggtgctccctcagctatcaccctaaaaaatctaagaatgccagttcttctcagctttcagtttggagtaggcaaacatgtatctaaaaataaaaataaattatttgatgacactaaattttatataatcagccaaagtttatgcaatcatttttaatgtttttattctattattttgtcatcttatgaaaaatcaggaactcaattctgtggtcctctaatctacctggatcatagtggagaattagaaagcagagaaaatgtggcaaatctatgtattaaagcaatcccctcaagcactatccagcattcatttattgttatttcacacctagtttcagcaagctttttttgttgcttaattttaaacctacaattaagtcatgcactattacaataaacttttttttaatgactcaccttaagtagctagaactatgctacccctgggtatgcaaggatgaattaagacagttttccctgcctttaatctagaaattagatatcagcaggagatgaccacaagtggccaagttgacagaattgacagcagttaaaagtgacagctgatagtgggagtggattctgaaacactgtcaaaagaaaaaaagcctagagtattatagagtatttcactgggacttgaggatgttactgaggacaataccagtacctggtattcacactgaggaaaagattaaattacattcagtgtattctgttaaagaagtcaaataaatgtaatgtctttcaatgattttcatccaaaaatagtggtactttaaaaaatctttagctgtcatacctagaatgactgttccagataaccagagttttactatgccttaatagtctcagtaataaaactcaaataattgttgaaggatgaattwttgttaaggaaaaaaatcccaatagattttagttgtacaatttattcagagataggaggtccttctgagttcaagtctacgttccagaagttttatgtctggaatttttcatcaagtcctagtgtaaacattgactagaactttttgtttgacaccattgtgaaaaattgctctgtggatagaaaacattttaatcttgtgtttcagctcatttgatctgatgaccataatttatagtttatttttcctccccaagtgtgttgttgactrtggtataattctttttttctttttctttctttctttctttttttttttttttttttttttgtttgatgagtttgaagaggaagcttaaaatacatttcagtacatggctctgaatcacttaaaatcataagaggttaaagctgtaaggaactttatatatcatcggacctagttccttcatgttacagatttaagccagcccagagagggttggtaacttgctcaaacacaataggagtttttcacagggtccacattcctgtttgatatatctgattccaatgtcacctactttttgtcacctattcatattgagtcatttggggtagaggaacaaggaacaatgcaggattcaaaaatgccttaaaccctccttatttatcaaattatcatcttgtggcaaggcagtttttctctgagcagcattgctgagactcaaactcagttttgaagtcttgttcattccttggaggagtatttatatttccctatagggaactcttcctgcctttcttcttctgagaaccatttcatttttctgaaaatcatgtactaagtacctactatgtgacagggactctaatagcccccagtgatcagaagtaaagaaagatcacagtctcttccttgcaaaaaaacacagtctacaatggggaacgaatggtaaagcagtagtaatagcagtgcaatctggcacaggaacatgggagctcagagggctaactcagcctggctttagtgaggaggtattcccagagtttaaactggcaagttccagaagcccacactgatcttccattagtttctagagagatcaggtgaagggacctgagmgcattcctcttttaaggcctctcaactttactttttttttttttttttttggagacaagagtcttgctctataccccaggctggagtgcagtggcctgatcttggctcactgcccctctgcctcctgggttcaagcaattctcgtgcctcaccctccccagtagctggggattacaggtgcgtgccaccacacccagctarttgtcatatttttagtagagayggggtttcaccatgttggccaggttggtctcaaactcytgacctcaagtgatctgcccatcttgtcctccccaagtgggattacaggmgtgagtcactgcacctggcctcaacttcactttggtaatatttttcttctacagagtggtctctgtaatccctgatctctctaaatgttaaatatttactgtggagtcaacaaacctgagaggagacatcatggagaaggagattccattacctcctacyctcataagaaaatgaaaatcaaatacagaccagggaccatgactgaaaggactctgaaagattgtggaacctttgtataatagtatccatgtttttgttgtctcctctgcatttcttacatgactaagcactgactggttaaaccagaaaaggaagcttagcttctttcgtttttaggacagcaaagatggggatggtgacaggggagtttgagacattctgtccctttccatagccattcctggaagaaagaatgtccaggattaactggttggtggcacagccacctcagggaaagggaaactgacccctggggactgaagtcaggaataaagaagtgacaaggagctagctggggcctggggaaggccctggggctggacactagaaagacccaccggggtcttttctatttttatattcaacattttatctttcgttgtaaaactcaggaaaacacctttaacaaacaaaaataacttctctcttaagttgttcattktactaaatggccaacatggattggatatggtagaaggaaagaacattttctgcagaagggagaaaaaaaccacaatctattttatgaggaggaatgaactctgggaatagttctctgaccctttgtgtgtcagtgtgttctcagcctgaactggaagaaaatgggatrgcatgtggaatgtgggaaagtgcgaagactgatgcaaaattcactatctgcctcattaaatacactagtaggttttcaagagaatgagtctgttatcaccacagtaaatttctcactctgggcctaactccttatctaaaacttaatagagcttaataagtgttcaaatttttcctgtctttctgggaatcattttcacctttatctctgatcctgtactttccctaggtcagagtaaaatataatgggaaacgggcaagtaggtaggaaatgtggagaaggtcaaggcctttttataatggttcattgtaaatttaaaattcttagatatgtatttcatacagattcacatatgttcttctggatgaattagaaattttaattgtgaggatcaataaagtagcgcaaccagctttcacatytgtatgaaatttaggactttgcaaaggatgttgcacaccaaaaattacaaaataattcaacgattatttgctacagttaccaaagattataatattaacatttgcaagaacattgcatttgtgaataaccaagtatgatacaaggaagaaatcatccatgtcattctcagaggatatggtgtaagaactggcccatgactcatgacaccaggccctgccactaggttgtgtgacttgaggaaataatttcatctttttgagagttggtttcttcatctgcagaatgagcaaagaagggtggctcttgacttcataatctctcttgcagatatctgattctacttggtgcagtaacaataattgcttgttatttttgcgatcatgtctttccagtaaaataaatctttagtgactctcaggtttaaaaagaatcttttttgcaccctattttaaaagctgccagatttggggtttggctgactactaaggagagcagcctgctagaaggagcaaattccagagctgagggtcatttatttggaatgctttgccaaacactcccctatttttaaagttgttgggggactttaaacttgaatatagggtggtaggacaattgtttgaaccactctgtaaatacgtgcatgaaaatcttgaggtttacaaatattttttaatagtttgccacatttcaatggcatgtcaagttgcagggtcctgccacttttcttcttgttattttcctcttctatcaactttgctcactctcccaaagaaataggcaatgagaaaaaacaggtcttaatttttactggaatgctctttccatttggctagaggtttctcaaaccaggcggcaccaatcacctagggagttttaaaatcatggtgatgcctgagccctacctcaactaagtcagaatatttgggaaaggagcccaggcatctgtacattttaaaagctcctcaggtgcttcttatctgcagccaggttaaaccaggagtgtcatcactgagtaggactattagctttaatgtgtcctgtgaccacaataccaatcagctctctggttaagaaaagagatgaacatagacattctgaaaaggcaactttataaagttgaggggaatgtatttctttagctttaatgcctcactgtgggatttgtctatacatttatgtatttttaaattactatcataaattcacaattagtaccaaaaccgatcaatttgtgaatatttattgatgccatttacatgcatatgtgttgctaaatacaatgggagggggcctacagaaaggtagagaacccagatcccacccacttcttgaagcttataatcattttggggtgcaaggattgtgtaaaacaagacacaaaaatcacacatgttacagaaattaaaagctaatatcactgagaacaggaagacattacaattggctagaatcacctcaggagatggtacttggatctgggcaccctttgaatgtttttcacttatccggtaggtaaggacattagctctggactagraaatcttggatctcccacaggtgagctctgtgaccttgagcaagtaatgttacctttatgattctcaaacttagctttgtgagcttcaatttgtaaaatggaaaaaatgataaaactgctctcatagagttgcaaggaataaatgatatgatgtaagcaaaatacctgaaaattcctaagagcgcaatttaagttcattttgttccttcttatsgcttttttttttttttttttttttttttttgccaaatacaccacttgggcaacagatcagccatggaaatatgatgcagaagatctgcctcatgcctgttcctaacataaatctctctctaccaaagctgtctgtcagagattgtgttcaaaccagaacaagtggacccactcagtccagagttaccctcaacatgaaacaggctacccagctggttctctgtctttataatatttttatttctttaaatttgatgaaagacccacttttgtgagttttacacacaaatgaagaggagtacagaagagcacatttcaattgtaatgttcatgccaggaatagtaacctcttcaaggataccactgagtgcacacagaatgctgggaggtcctgactctgcttatggaaaccacagaaactcatccctgaaactggttctatagcagccatgaccctcattaaacttccaatcaagtaaaattaatattagctattaggttagatgttaggtattgtctttgcctccatttaatcatcttacttcctatggtacctgttaattatgatttgaatctccttaactgctcagcctgggtgtttcagccatatataagtcataaacagactacaattatcttactatttctcagttacttgcaaacaacaggaaccaagtctgataatacaagaaatgaagaaattttctggaagaaggcaaagaggctcagataggaacaaagaggggaggcacagtcagaaccctgctatagaaatcacctgtgtaaggcaatgcagctgatggaatagccacccccagacaaccatcaccaatacactggggcttctgagagactcaaccagagcttctgagaataatctctgagtgtgaaaatcagattggctattgaaaggtcacatgcccacattctatgaaccaggagcaggataacggactattctatatgcctacatctcctcctctcattcacatctcctatgtaccttccccaaccaggaggaatttgtggattctaggtagccaaaacaaaagaaaatattcactaaccattttaaagaagttgaagtaagagaactaacatttaccaaataccttgcaaagccagccattgcattggtattaggggaactggtagactgtgctgttattagtaccttgcagtcagactggcattgttcaaatcccagctcagccacttgctggaagaaacaatggtcatgctgagcctggactggcaggactccagatcctgatgacatatcactgttttatgtagccctgttggactgatttcacttctttttagtctcaggatttaattcacaatgagttgttttttggtttgtttgtttgattttgagacagagtctcgctctgtcacccaggctggagtgcagtggcgcgatctcagctcactgcaacctcagcatcctgggttcaagcgattcttgttccttagcctcccaagtggctgggaccacaggcatgcaacccctcacccagctaatttttgtataggcgggttttcgccatgttgaccaggctggtctcaaacttctaacctcaggtgatctgcctacyccaggctcccaaagtgctgggattacaggtgtgagcactgtgcgagcccacaatgagtttttaacacttactgttcctcatcagagatgccaatttgttaggaaaacaaagtgcatccctttcaggcttcatatctgcttagaaaaaagcacaatcctataaattacstaatcatataaattagttgagtaatacaaaattatttttccttttatctgacttttttttctgaataaattaccttaaacctggcttcagtttgctcataagytcctgatatttgaacaggtatctgcccaacaatcagagagaattagtcctctgcaccttctgagaggtattaaaaaaaaagggggggaaagaaaaagaatcagtccaattggtagattttaaatggctcatttaaatactacaagtttatcagtctctaaattttcagcctaggaaaatttcarccaggaatttgatattagtcctgatgcatcacgraagtacggaaactcagtttctacagacccagggcttcctggggttacctcaggccacttatatctcttatctgtgcttttccttagctgacatttggttctagaatgaaatggaagtcaggaaagaggaaaatgatgatgtacttccccactcccaacacacacttgtctttagcctaaacattgttttccaatccagctgtcaaacttcaagtatggaagaggaggagaaaaatcagctagcaaatatatccagatttcctgctgggcaccaartgctaagcagggtaggccaaaaacatttaatcaaaaaaacaagatccaccacggtttttactctcctaaagtaaaatataaatttggaggtgagccaaagttaaaaatataaaaatatagccagtgtttctctcctactttcctagggttgctaggttttgggagcctgggatgggggaaaacagtagaggagacatacttattataaaacattcaaaatagtgaatgggacatacttattctaaaaatttacttgctgtttatctgaaattcaaatgtaactgagtatctagcaaccctacatcctgatattcaactttcctactcccctggccatgactggcttgggcaggagagatctttgcctgggtagatgttgggaggagcctggtgaatgtattccttcccaggattggtcttggctctagttctggagcctctgttggaagaatggagaagggctccattccaaaaaatggaatagggatctccttccctatgtttggaaaacactggtctaaggctttcaacaatagccttgaatatcaatgaatgtctacttagcaatcatcttttccagatgattcttatgtcttaaaataatgttacttcaagaaggtgcctaattgtaagacatccttacagtaatagtagttgggttgtgatgcaatttgataatgtgagattctcttagaaaataaaattagtaataaataactacagctgagtttataatcttaataaattaaggtagcttaatttaaaatgtataactaaacaaaaactaagtcacaaaaactccttgatgacatgaataacatacagcagggagacagtagtaagtagtggctaaggggaaaggctgtggaattacaccacctgagtctaatatctaacactgattattgaggtgacttactgaagtttcctcacctgcaaactaagttacaacctattgtgtttttttaattgattgagattattaacactttttataatgcctggtccagagtaatgctccaaacattttacctattttatatgctaaatttaaacttaatctttttgggacttaatatatatccatgcacatcgagcatattttaaattcagaaaggaaaccaatatgccagcagaaataaaacaaatattcttgttttcaaataaagatcatttctttatgagaaagatgaaaattaacgatcttttagagatagttcaatgttagccactcacagtcacaggtttaaaccgtgaagttagtgtttatttttatgaatctaaaaacaattgttcccagccatggcatgaagtcttcmtattgccccaacccacataaacacactagaaattttcattcttagggagggatagggaggctgggggctactgaatggacattttgttagttaagagctcactcacaggctgaaggagtgtggaataggtccaccattagctattctggccatacctctcttagagattggggtcctggttaccaacgaaggaccatgtggccatatccagagggttggagcaggtctcagggcccattgcctggcacacctcctcccagaattcctgaggtataaccttctcaggaagatagcagagctcttttctaacactccrctatttctggagagtagtgagtatattcccctccaggccttttcacttttattcagaaacacagggaaaataataaaagtctgtctgtattatgactagctacaacaggtgggggttttctttgcagtaatattttcaagtggtatcacctagcagctggattcctttgccttaacagaattggcmccctaaaagcaaaagagatggaagcactgggagtgataaactttgtcagtttagaatcaatttagatcagtttaaaaccattcaaacttgacacattcaaaagctttcaatgctatccactaagaaatcatatttgaggaatttttttccattaaacatttagtctggcttaaatmtagtaagatgctaatcttttcgaaacttgtttttctttctttttgtaaaagtcagttgagtttaatataacaaaagggctgaataccagaggtagagaaggaagtgtcccaggcttggtttcaagacaactaggtcctggattctacaactaagtgattttgtgaccttgagcattactagccattgtgagcctcatttataaaggagggataaagattaaaattatgaaatctttctgtaagtaattggcacacagaatagacgttcaataaatgttaactctgtagcctaggagtgatctggttacaagctttgttaaaactccttctttaaggaaatgtaaaaataaattggtactgtcaaagcttttatgcccaggccatgtagagattatcttccttccaaagaaactaaaatggattgagaagacaaatatcattccaaggaaaggctagaagtctgcaaaattatacaattgtactttagtgcaccaaagattaaaaataatgcagtcagaataacatttatttcatctaccagaatsttaccctatttcttgcctttgattagtttaagaataggaaactaagatagtacagacttataaagatataacgtatttataaatatgtatctttgcatatgcaaattataatatacatattttaaaagtttgcttcagtgaaatttagagcatgagcagacaacctatttttggtgaagagtcagagataataaagtttttagcttttgctggccacacaagctctgtagtgactacttgactctatcatggtatggcaaaagcaggtctcagggccacagacaatagtaaataataggatatgattgcgttcccataaaactttatttacataagcaggtagtgggcaggatttggtctgtaggacacagtttgttgaaccctggcctagagcatgatatagagtatgcttacaaactgggcmtaattaagataactattctagaggaaaaagaatgtatatgcttagattaactcagcaattacataaacacaactgtagtacatacatctattcttttarcatcaaggcttgctgagttgaaaaaaaaatggtatggttctctaactatattctgttgagttgctggtgtgtaaatcacattgtaactggccactattactttttggagttctaacatatgcttatttgcacattagggtttactgtttttctgtgatagacaaatactgaaatttgattcagatccattacacaaatggccaagacaggatattctgtgaatttcctgggaagtatatwcaagtatcacttacctgacagcatctgagccattgtgttataaggaatttcctgcagggattgaattagttaggcttagccctcagtggttttgtaactatttcccgcattcaccttaaacaatgccttttagaagtggtttttgggtgattctttttctccaggaagagattayaaataatgaaatgattagaccattagagaatttaaatcagtagagaatgctaatttctttttttgtcatagtaacagagcaagccaacttaatcagtgccctgacaaagcatccagcaccaacacatacattagaaaggtatctaattcctcaccattttggtattctaattttataaattttaattctattccattttgagagtatctagggatcagaacctttatggaagactaataactaggtaaacactattacctagcttaagagaccctaaaatgtcagtgacttcataccacaatggtttattttgctcatgtatctcattcctgtgtgagttagatgaccccaatccctcctgtactatgcccttgggaacacacatctctatggttacagtcaaaggagagagttgtagatagaaaacggcacacttccaagtctttgctattgtgaatagtgccgcaataaacacacgtgtgcatgtgtctttatagcagcatgatttataatcctttgggtatatacccagtaatgggatggtggggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgatcgccattctaactggtgtcagatggtatctcattgtggttttgatttgcatttctctgatggccagtgatgatgagcattttttcatgtgtcttttggctgcataaatgtcttcttttgagaagtgtctgttcatatcctctgcccactttttgatggagttgtttgcttttttcttgtaaatttgtttgtgttcattatagattctggatattagccctttgtcagatgagtagattgcaaatattttctcccattctgtaggttgcctattcactctgatggtagtttcttttgctgtgcagaagttctttagtttaattagatcccatttgtcaatgttggcttttgttgccattgctttcggtgttttagacatgaagtccttgcccatgcctatgtcctgaatggtawtgcctaggttttcttctagggtttttatggttttagatctgacatttaagtctttaatccatcttgaattaatttttgtataaggtgtaaggaagggatccrgtttcagctttctacatatggctagccagttttcccagcaccatttattaaatagggaatcctttccccattgcttgtttttctcaggtttgtcaaagatcagatggttagatatgtggcattatttctgaggcctctgttctgttccattggtctatatctctgttttggtaccagtaccatgctgttttggttactgtagccttgtagtataatttgaagtcaggtagywtgatgcctccagctttgttcttttggcttaggattgacttggcaatgcaggctcttttttggttccatatgaactttaatgtggcacatatacaccatggaatactatgcagtcataaaaaatgatgagttcatgtcctttgtagggacatggatgaagctggaaaccatcattctcagcaaactatcgcaaggacaaaaaaccaaacaccacatgttctcactcataggtgggaattaaacaatgagaacacttggacacaggaaggggaacatcacacatcagggcctgttgtggggtggggggaggggggagggatagcattaggagatacacctaatgctaaatgacgagttaatgggtgcagcacaccaacatggcacatgtatacatatgtaacaaacctgcacgttgtgcacatgtaccctaaaacttaaagtataataaaaaaaaaaaaagaaaaagaaaatggcacacttgctcttgactcccttggccggaggtggaggtaatacattgttagttctgatccttgttcattgatgagaaccagcccacatggcttccacctactgctagggactctgggacatacagacaagcacataattatttggtgatatttggtgagccctaactgccgcagaaaaacttttgaagcatttagttctctcccgagaccagaaatcaatcaggtaaacatgaataagaaatttatagtattatctcagtttttttttattggctttaacaagagcatatgctgggaggatatttgctatattctgctagtttccccaatttaaggttgtctgttttgattaaaaccccttagcccagtggaaagatgaaactctcatctatttagtccttaatatctctatcactaaatggataggtttcatgtactcttcagtattgatagcctactttctaagtgtgtgtgtgtatgtgcatgtgtttctgccattacagtcattgtatgaaacaattatgtattctgacaacagctagcacagatttatctatttaataaatgttggttgattaatagataaaggcacgtttatatataccagcaaatacgaagacttggattcagtaaagtttgataccattcaatagcattaagattaaggatgactgtgayggcctttagtttgcatttttagactgcttaatttgggtcaatgtttctcaaagttatctccagtggtctaaactgttaaatctgttccraagtctaggaacctatgtcagtcaaaaaagtatgtttttagacagctctcctcaccccattccgtgtgaagatggccccactgatattcataaaaaataagaatattccctcccaatgaatgttgctataaggaaatttgctcatacagaattggtaaatggaaaaatgatgtcactataatacataagtcactataattcagttttccctagcaccttaatgtttatactaccaatgccaccacttgaatgccaaatacactaagagttggacacagtaagcatatactcatacagtattgtaaggaattcccattctccttgtattcttcctctttgcctagttttgctgtgtgtgatttcttggaagggcttatataattggccccaaacttagttcattttgcccttgtccccacaactattcagccttaacattttcttacttcattccactgtaatcatttatttagtatagaatttattaggaatctaaatgcctttaaaawtaygctagtatttttatttgagttgtttcgactttatgttttagctaaaaaggtgtatggactttgagttgactgccccaactctgtttttatcataagctgtatgatttttatgtgtgattttgtagaaaacacaagattgcttttaggaatgaatatatcacattataatagaaatatctgttttcttgcaacwtaaattgcatatattttatgaatggaagaatgtcaacaacaaaattggcaatgggactatttgagaatttgccatgtggaggccgtttcctgaccttttatcctttatatgctagagtgctttagagtttccaaatggtgttcatatgtrgaattttatgtcaatccttgaacaatactacaaggatcattattaacatttctacttgatagacttggaaatcaaggctcagaggagacaaatgttttgcctacagtagattggtgacaacattctggctataattagttactctaytcaaataaacatatttgagcttcgattttacttagggcactggggatacaaagataattaaaatgaaactcagtcctcatccaaccagttgcctctcttcttcctcccactgattcagggacacttccgtttggactgggcagagctagacaatctcaaactcatagaggcatctgcattgctagtttcctagaagagctggaggctgagtatccggactgctctgcataggggatatgggacacttaggtggctcctggccaagtggcccaagcctgttgctgactggaagtctgtcacttggctctcctccctcgccagttcgtattgtagcctctacccttgacactgtctcacccagtggaaacacagctgcaagagctgcagaaggcctattacttctaatctttctgcttcgtatgatcggtaattacaccccagggacacataatgaagatggttcatcactgctttttatgtgcttcatagtgtgagatagtggactgggaacttgaatcagagcaagaaaattgttttctgctctrggtttggtcacttaaactagccacagtatattaggcaaaatatttcaactgcttgggcatcagtgttctcatcatttgaggacactgtctcattagatggtcgaatagggacttttccagctatagccttctgagattcctcaaggacacatcgagtttgtattgcatggtcaaaagagggctccaaggaaccaggtctaacaagctttaaggtgagtgagttctctcaatggtgccccgactttcctgacatccttctgaatcttagacaagcctcggagagagatactcatggaatgaccaaaatggtagcaccagatctgtatgaggtatttaatcattttattttattttaatttttagacagagttttgctctgttgcccaggctggagtgcagtggtacgatattggctcactgcaacctccgcctcccgggttcaagcaattctcctgcctcagcctcccgagtagctgggattataggcttgcgccaccatgcccagctaatttttgtattttttagtagagatggggttttgctctgttgaccaggctggtctcaaactcctggccttaagtgatccacccacctcagtctcccaaagtgctgggattgcaggtgtgagccatggcacctatccaaatcattttaaatggygatgattatgtccaataagtccatcttattctcttgggcatctcaaccttttcctgccttaggaaaatggaggtcctctaactcctaagatcttgtcacatgatcctgctgtaggcagaacccacaccagttaaatgtttatttacttgatcaatgtttagcctgtggttggcttttaaatatcccaacggagactgagaaagcagtgcagagagtgctaaaatacagacaaaggaaaagaaagaattggaaactaggagaaaacaaggaaaaaagaaggggaaagtgctttcagcatttcttttcaacttcctctacatgcttagaaaacagaattgacttttgtatgtctgtggtagctttacaaataaattaaacatattatcaacgtttgccaatttattttacaagtatacggaatatcattagcacattctggtgatagtatgtcagatatttaaagagctctagcttgaagaaaatgggccttactttaagagtgctatatttgttttatgttctcatacttaatgatctgggacctaattttcttcagccctgattatgctttgtttcatgacctttaatatatatatatagtaatcattaaatcaaataattataagtcacttaccaaaggaattaaatatggaaaatgcatttgaatatgtacatgattcatccacattttaatatctatccttacttctgtttccttttgtctcccattaatgataaaatagctgagaagattgttctctcttttctttctttttttttttttttttagacggaatcttgctctgttgcccaggctggagcggaatggcatgatcccagcctatggtgacctctgcctcccgagttcaagagattctcctgcctcaggctcccgagtagctaggattaaaagcatgtgccaccacgccctgctaatttttgtatttttagtagagatggggtttcacatgttgctcaggctggtcttgaacttctgacctaaagtgatccgcctgccttggcctcccaaagtgctaggattacaagcatgagccactgtgcccggccagattgttctctcttaatgggctgataagtaaccaagtaaaacatattgtacttttaccccatgctagaggcagcaagcccaagctgcagaatgcccaattacacaatcctctattagccaccaaagagaagatacttttaaatttgtattacattatttaaatagaaaaaataaagacagaagatcctttaaaaagcaaactggataaatagtacttcagaattctatatattatttgttacaactgcatgtaaacctataattacctcaaaatgaaaagtttartttttaaacaaagcctattattgtatgattaaggtggataattgagctgcttcttatttttattatagtaaaatatacataaaataaaatgtattattttaactgctttaaaattgtaattcagtggcattaagtacatttacaaggttgtgcaatattgtgaaccactgtctgtttcagaacttttgttactacatccagtggaaattctgtatctgttactcttattcctcccttccctctgctcctgggaactacagatctgttttctgttcctattaacatgccgctttaaataatatttcatataaatgaaatcagacaataaaaaggtattttgtgtctggcttctttcacttagtgtgatgttttcaagattcattcatgtcatagtatgtatcagtataggcccatcttgttttaatgcacttcactttattgtgcttcatagatactgcgtttttcacagattgaaggtttgtggcccactcttcacttgaacaagtaacagcaagtgctcattttgtgtctctatgtcacattttggtaattctcgcaatttcaaaatttttccttattattatatctgttatggggccttgtgatcagtggtgccaggaactgtgcctatataagatggaaattttgataagtgtgtgtgttctgacagctccactgaccagctgtttccttctctctctcccttttcttgggcctctctattgcctgaggcacaaaagtattgaaattagtctaaaataggcagggcacagtggctcatgcccgtaatcccagcactttggraggccaacacaggcagatcacaaggtcaggagatcgagaccattctggtcaacatggtgaaaccccgtctctactgaaaatgcaaaaattagctgggcgtggtggcgcctgcctgtaatcccagctacttgggaggctgaggcaggagaatcgcttgaaccagggagtcagaggttgcagtcagctgagatcatgctactgcactccagcctgggtaacagagtgagactctgtcaaagaaaaaaaaaaaaaaaggaaagaagttagtctaaaataaccttacagtggcctctaagtgttcaagtgaaaggaagtcacacatctctcactttaaatgaaaagctagaaatgactgcgcttagtgaggaaagcatattgaaagccaagataggccaaagctaggcctcttggtccagttagctgagtcatgaatgtaaaggagaagttcttgaagaaaattaagtgctactccagtgaacacatgaatgataagaaagcaaagcagccttaktgctgatatatagaaagttgagtggtctgggaaggtcaaactagccacaacagtcacttaagccaaagcctaatccaaagcaagatcctaactctcttcarttctatgaaggctgagagaggggtggaagctgcagaagaaaagttggaagctagcagaggttggttcatgaggtttaaggaaataaaccatctgcataacataaaagtgcaaggtgaagcagcaagtgctgatgtagaagctgcagcaagttatccagaagatctagctaagataatttggtaaaagtagctacactgaacaacagatttttagtgtaaatgaaacagccttctagtgcaagaaggtgccatctaggactttcatagctagagagaagtcagtctggattcaaagcttcaaaggacaggctaactcttcttaggggctaatgtagctggtaactttaaggtgaagccaaagcttattccaaaaatcctagggcccttaagcactatgctaaatctacctacactctataaatggaacaacaaaacctgaatgacagcatatctgtttacagcatagttaactgcatattttaagcccattgttgagatttactgctgagaaaaagagattcctttcaaaatattactgctcattggtgatatacccagtcacccaagagctccagtggagatgtacagagataaatgttgtttcaatgacttstgwtacaagattcattstgtacccatctatcaaaaagtaattttgactttcacgtctcattatttaagaaatacatttcataagactatagctgtcatagatagtgattcctctgatggatctaggaaaagtaaattgaaaacctcctggaaaggatttaccattatagatgccattaagaacttttttttttttttttttttggtttatgggaggaggtcaaaagatcaacattaacaggagtttagtagaaactgatttccaaccctcatggatgactttaaggaattcaagacttcagtggagatagtaactgcagatacggtgggaatagcaagagaactggaattagaaatagagcctgaaaatgtgactgaattgctgtgatctcatgataaaactttagtggatgagttgtttctcatgggtgagtagagaaagtggtgtcttgagatgaaatcaattcctgaaatcaactcctggtgaagatgctgtcaacattgttaaaatgacaacaaagaatttagaatattccataaacttagacgataaagcaatgtcaggatttgaggattgactctaattttgaaagaagtttttctgtgggtaaagtgtgrtacaaaagatgctcaacagcattaatcattagatattcaaccgtgggtaaaattgcatgctacagagaaatattttgtaaaatgaagagtcaattgatgtggcaaacttcatggttttattctattctgagaaattgccagagccactgcagccttcagcaaccaccaccctgcccagtcagcaaccatcaccattgaggcaraccctccacctgcaaaaagattatgactcactgaaggctcagatgattgttagcgtttttaatcaataaattattttaagactaaggtatgcatattgtttttgtagaaataatgctttgtgtacttaatagattacattgtagttcaaacacaacttttatatgcactggaagaccaaaaaatttgcatcacttgctttattgcagtggtctggaaccaaacccgcagtatctctgtgatgtgcctgtacttcattcctttttcatagctgaataatattctattgtatggatataccacatttcatgtatctatttagcagttgatggacatttgagtcatttccacctttttggctattgtgaatattactgctatgaacaattgtgaacaagttttctctgaacatatgttttcaattctttgggggtgatatacctaggaatagaattgttgacttgtagggcaactctatgtgtaactttttgaagaactgccaaactgttttccatagcaacattaccactttacattcccaccaacaatatatgagagttccaattactacacatccttgtcaatccttattttctgtttttgtgttttttttattatggccattctactggctgtgaagtgatatcccattggggttttaatttacctttccctaataattaatgctgttgagcatcttattatgtgcttattggccatttgtgtaacttatttggagaaatctctattaatatttactcattttttaattgggttgcttgcctttttgttgttgagttgcttcttattttaaaagaaatcagactcaagaggactttagttgcatgggaaatattctaggtctgggtgatggtttcatggatgtgttcactttgtgataatttgtgcacttatatatttctcaaaaatgagcatgtgtttcctttcttgaatgtattagtttcctagagctactgtaccaaattagtacaaacattagtggcttaaaacaatatattgtctcacatttctggaggccagaagtccaaaaccaagatgttggcagagccatactccttctgaagcctctatgggagaatcattccctgccttttccagtttctgatggttcctggcaatccttagcattgcatggcttcttgacacttgatactaatctctaactttgtcttcacatggtcttctttctccctcatgtttctgtttytgtatmtaggtatcttaaatactcctctcctttctcttataagattaccagtcattgaattttggccccaccataaaaaacaggatgatctcatttagacmtccttaacttaaatacttctgtaaagaacctatttccaaataaggtcacatttacagataccgataccggggattaggacttagacaaatttgtgtgggggaacacaattcagcccactataatgaacatatattaggcttcagtttttaaaagatggctttaaaaaacaaaatggaaaacaattttactggtcagatgtggtggctyatgcctataatcccagcactttgggaggccgaggtgggtagatcacttcaggccaggagttcaagatgagtttggtcaacatagtgaaacctgtctttaccaaaaaaaagtaataatgataataaacatttaacaaaaagraaaaagaaaactactttagaaaaatgtgrtagtctaggtttctgagtcaaaatatctgtaggttaaggaggaaaaaaaattcacgggatgctcaccaccataaaagttagaaattcttaatttttgaaaaatgatctcactrtttaaaaagcacagttagatggaaaaggggacttatataaaaaagactttcaaaggatatttatctgttgtgggtttttttttcattttttggagaggaagctaatgaaaacagttcaatactcatttatgtagagaatatctttcaagacattaaaaagcatatttttagtattgccaaatacagagatttctattaaaatttccagaagacatttttttgtgtgtgttcacactgttacccatggcacattcctggttttttgtttttgtttctgtccttaagtgatcaataatattggtatttggtcattttgaacattgtgatccttacctttggacttgttaacaactggctgaggattcaaggcataaaaggaatattatgcttactattgagcctcagcacctttgtattttaatatgacatgtggctgatgatcaaccttgctgggtctcatttcatatatcagttaaataaatatatgaatraagtaatattttcttcccaagagtgatatttgattcaatagattaaaagttatttgagtccctaaacataaaaaagccagtagggtatagtagctctgtggcaagcaattttagtatcagaacacatgaatttaaaactttggacaatggccttattcagaacactaaaagcttagaagcctactctttagattgtagtgctattttggaggcatatcttttttctttttttctctcagtttttcttttttggatagtattccctgttaagaaacagatgatgaggctttaattcagtacattctcaaattgttcccactacaaaacttatttcaaagataaactttggaagttttcataggtaggactgtaagaatgttttaaataaatcctaatcattttaccagagagtataccttaaaacaaatttttctggctttatttgacaggttttttwaaaaaaataacttagtcatttttaagttgattgtagttcatccagaaagttactccatgttggtaaaaggttaaaaattaagagagtccaatttttgaaaattttcacaaagttctttttatacttttaaattagtcaaaggccaagtatttcataaagtgttgatgtaaattgtgttactgatctttgatcataatgtggaatagtagttgcactcaagatatgaaggaaaaatatgttacagggtttggctttgaaataactgacatacagcagaggcactcaccctaacatactttccatctatacgccaggcagggctgtcagtttgtggaaaggmaaactgggacctccctcagctctgccctcctaataagaccatcctgacacaaagcagcaattattctttgatgacatcaccaccgtcttgcccttatttttatgtgcataatggaagatttcaactttaaatctgacctagccatgaaagtcagtgtgagtcctgcatcatgttttcatcctgctatgtttttactttctggtagtgcttttaacacagagagtttccaacttgaaatatagagaccttttaggaagttttttacataggaatcacctgtctaatcaactacaagaggtcacacttttttttttcctttgagatggagtctcctctgttgcctagactgatgggcaataacgaaatcttggctcactgcaacctctgcctcctgggttcaagcgattctcatgcctcagtctcccgagtagctgggattacagacgtgcaccaccacacctcggctaatttttgtatttttagtagagatggggtttcaccatgttggccaggctggtctcgaactcctgacctcaagtgatctgcccacctcagcctcccaaagtgctgggattacaggagtgagccactgcacccagccagaaagtcacacagagggttacccaaactaagtctcaagatacctgtttctaatgacttttagatagcatagacctctttattgattaaataggaaagagaaaagaaaaaaaaaactctagaatttttaggattcataaaattggcatcacaataacagtaatcacttatggctcctaagaattttttctttttttttttwaaccttaaagattagttaatttaattacatcttaaatacatctcgcaagtgactacaaattctttgagggcagagacaatatattttttttaccttttaatcccttaaagaccttctacctttcctttcacatggtggacttttattaatgtccgctgaatgaatataacatattcataatatagtcatgtctatacattgattaacatatttgttatcaactgcagagtaggcccagtctttctcttttactctctgtccttttaagaattttaagagctttttggggaaaataaagtaagaagaaaacaatgagtcatgtctttgtagccatctagatttcttagctctgttgcctcattcttcctcctcattcttcccccagccacggtggagaaataaagttgtctggggkctcattactggactacccaatctcagttcccttctgtactttagaactctctccttccctcatcttgatttcactaggccacactataaccctgcttcctggagagaatcagacccatgtragctcttgagcctcctgttccatggatctctccaccaagacaagagcctactccaggctgccaacctgagattagagagttcatactctgattggtccccatagaattaatcaacggtggccaagagtgtaggtaactagatggctcattcagatctgatactcattcctggacttgtcagctgtggcctgggtggcagagtcacttaaaaacattgcagcatcttcagaaatctttggttggagtagaatagatgccaaaaaaggtagttgttggcttctgatgaaatggaagggtcaaattaaataatagctgaggtctcatcccttctacccataagattctatgatttatcactaaaacaatcacatattaggaggtcataaataattctacacaagttcttctaatctccatattttcttacacctatggtcaaatacatctctcttgcaagaattatataaccaaatattacatacactatgttagaataaagaatgaacactatcactagaaacttggaagcagatttaaatactgaaaaatattataggtatcgaaaagaccctttttattctggcagaaatatataaatctgtgtgtgtgtgtgtgtgtgtstgtgtgtstgtgtgtgtgtgtgtgtgkgtgtgtcttctggtgctatttctcaaaagagtttttttttttggtagattttttttggttacttttttatttcattttgttaagccatcaaaagctttgagattgggctgggcatgatggctcatacctgtaatcccagcactttgggaagccaaggtgtgtagatcatttgagttcaagagctcgagaccagcctggccaacatggtgaaaacccatctctactaaaaatacaaaaattagctgggcatggtggtacacacttttaatcccagctacttgggaggctgatgtgggaggatcacttgaacccaggatgtggaggctgcagtgagccaagatagtgccactgcactccaacctgagtgatggaccgagactctgtctcaaaaaaaaaaaaatgctttgaaattagcctttacctgtgtgtactacaatttaaaaggccatctttgaaaagacagtaaaacagacttttactatgaaaagctaccatctggaacccttagtaaactgactgttgtctcataaagartacaaccaagcctaatgcaacttaattgttcacacagttwtgtaagatgtacttcttctataactctacaggacttaaaagaactcataatactatatgattgtattatgggttccataaaacattatgacaatgtattttctggaaaaatgtttcctagtgaacatgcataccccagacattttacctttctcttaaattattccatctgattttactaccttgctcttgctagagttaagagttttctgaaagyttattcagtgttaactaatgttacttttcctgggccatttttgttggtattgagttttttctttatgtgatcataaagttatagtttagaacaaggttattttgttgcaagagtctatttaggtgtaatattttttaagcaaattgaagttgttctgataaatgtttatctaaattaaaatataactccataaactatgatgtggccatttaaaggggaggtatattaactttgtggaattgtgccattaaagacaaagaaaaagaaaaaagaaaagcagttggctggatgaagtagtatagaattgcaaacttacatgagataataattagaatcaataagacacctaatggaaaaagaatattcatatgatatattcattcattcaacaaattttattaaacacatcatctaccaatgaatctatgaagatcaggtactttagcaatatagaacaatgtacaataacayrtaacataagacagtccatgtgaaggcagttcattcctggtgtggtggctctattgtcagcataaccctgtgttactttcatctttctgcttcagcacctagcacatcacttctgttcaagttcacttcatagtccaacagggcagttgaagcctgtcttagtctgcttagttgccatagcagaataccatagactgggtggctaatataacagaaatgtattctccctctgctctagaagctagaaggccaaaatcaagttgctttcagcttgatttttgatgaggcttcccttcctgtcttgtaaatggccatcttcttgccgtatcctcacacggccttatctctgtgtacatagtggagagagacagagagaaagggggtggagagagagagagggagagagagacagagagagaaaaagaaggaaggaaggaaaaagagagagaaagaagaaagggagaggaagaaagagaaagaaagagaaagagagagagaaagagagaagaaagaaagaaagagagaagaaagaaagaaagagagagagagaagaaagagagagaaagaagaaagaaagggagagaaagaaagacrgaaagaaagaaaaagaaagagaaagaaagaaagaaagagaaagaaagaaggggaaggaaggaaggggaaggaaggaaggagagaaagagagagagagatctggtatccctttcttttattataaggacaatggtcctatcagattagggccccagtggttgtgatttcatttaaccttaattacttccctaaaggccctatttccaaatgctgtcactttagcggttagggcttcaacatatgaatctcaggggacacaattcactctattgagtgaacgctaactattatacaagagttcataactgagagaaggacaaagaagaaaggtagaagaaggataaaagagaaagtagaaggacgtaaaaggcattctgagttgaatcagttctgcacaggggatttctgggatatcccatacaatacttccacttactttttttgggccagtatttagtcgtacagctatgctatctacctgttgtcttctggctgtgtacactgctgccccaagtaaagattttattactaatgaaaaaaacggatattaagagctaataagccttcttaatcatatccagaactgtgctaggcgttgagaatgagaatataagttcttatttttaagtactctaaggaattcccagtctaacaggagactagtacatgtaaaccagttacctttaatataaagcgatacatcctatgggataaatgtgtacaagttctgcaaaaacagaggaagaatgattatcaacgggggagttggggagagttcaccaggctaagaattgaagaaaggaatttccagaagtggggaaaactttagcagaagttcgaytgagaatacaagatgtttcagggaactgcgcatattgaagggtggccattacttgacattctgagccagagtagtaatgagattggaaaggtcaaatgagccctcattttaatgggtctaaaatggtgcttaaaaagtgggacagcatttattgggtgatgaatttatagatgtgtgtgtgtatatattttgatacaagaaacccttctgaagaaattagttattagattccattgatgtcacaaggtgttctttttgttgttgttattggttcgkttgttctaatttctgcccttttcaagattcaaatcacaacttaaaagcaaggagttgcaagaatatatggaatggtgagaaatgattgatgttagaaagctttcgaaaattgcaatacataaggaaaattgtccaatgcacattcttatttatctgcatttatctttctatatcctgttgaactttgccgataattgtagaaacaccttggcatttctttcttccatctttatattttcttgatatcattagaaatagatgttcagtctacctcttgcatgctgaccaatcctaaattgggcgatgacctatttattttgcatcttccctgaatgcttaatcttcatgaactagaaatggccagtagaaagtcagtaagtgttacttaatttacttccgtatttattaaatttctcccagagtaaggaattatgagttcctggagcagcacatgtgtctctttcttacagaaaatttcagttccatggtgaggattatttgcacatctctgaagaggcaatggtccatccagacaaaatagcacagagccagtacataaaataagaaagtggactgtggacaagtcctgacaaaattatggaaagaggaactagtgaaaattctagcaagtcagtatcttttctggccagtacatttgtgtaagcaaattgaactttaatcataatatagtgccaatttgatttccaaaatctttgtctttttttggtcccgccttggaagttgaatctcagtcatgtacaccagaatatgaatgcgagatgacagctcccataacaaatcacccttggccagatttccgccacttggttgttcattttgcctacctctgaaattagcaaatctctgcctttgtctacttgtgccttctcagatctgctgctcctggcccattccttgatctcaatgtggctgaaagtattaagattttagagcatgtataaagataataaaggtcattcaatcaagctcttctattttgtgcattttttgcttctctaagaagcaagaatggcactgtgatttcattgttgaaatagttaagaaaataggggacaattttgataaaattagaaaatcttagagaagtatcctgttactacgtcttcaaatgtataatgataattatacaggaaaatttaaaggcatttttatcataaaatgcttcaagcaaacgagaaaattatgaggaataatatatcaaatagcaatgtgccctctacccagctttgcaaaatctaaacatttttctgtaattgtttatttttcataagaaataaaactttattaggatttttgagaaagtccagtaaagaccaaacctcttcctcacttgagatcagaaccaattgggaaatgacaaagaatcagactgatgaatcagcatggctgatgaattaaattcccactactgaaccgtagaggaggctgtctacactccagcgccagccgagagcctgacactggacgaacaaagcaaagcattttcttaacgtaggcaggctcagttctaaaagaaaatgagaaagagaggatggggctggccacacagtgtctccttccagactcaccaatcarttagtgtgaaggaagggcaggttgagaaatagccgagaagtattacaaccggtgaggcactcaccccatggaaggaaaygtcagaagtggaaagttagcatttccctctaaaaacatataaagttaaagccatgtttttattcccttttagaccctattttttcctccccttctcccatgcaaatgtaacctctaccctgaattttaagatccttatatataacaaatacttagtcactagtgttgtgattctaagtatcagaatgcttccatttaagggaaatattggctgccggttcttggggatattgactataacatctgcagttacttcagtttcaagatactcttgtagactaatggaaagaatgtaaaagatgatgctactagatagaaatagagtttggatcgaaggatgttactgcccaactaatgttctaagtgctgaaagatcatcctggtcttagcaacagcaattataactaagaaaacaaagtttagagttatctcaaaacagaaaagaaagcatcaaaaagttatctctttcctctgaaacaaaaataagcattctagtgacccttgccttctgaaatatttcaacattccaagctactgagacttttcttattttcttataaacaaactttaatgccctttaaaatactttctgatttcttttctaagcgttttcaggtgaataacaagttacattcgtttggcttattttctcttcataaaatggacaagtttttagttgagcagaggaaccgaaaaacttctgaatgaaggaaatatttggtagtgaatgatataatggaaaattgctataataagtagctgggaagaagcaaggaagggagagaaattatacagaatcattttagtttaagtggcagtgtatgattagaagcagtactgagacattgagaaaaatagtctattacataccataggaaaatcaacaatggcatctctgaatatggaattgctagttaaagctactaggtgactctaggatggacaattttttttaataggtttttggttttggttgaggtacactgtcagagtgtgcacagtatttcattttgttagttagcttcatgaagaccttaatttattaatgttaatgattgaccacttgtgtgttaaaccagaaagtatttagtcagttgaattccatcacaaaagaaatgttatgaatccgtatattttgcctcctgtttctgagaaatatggcaaataaaaaaagagaggtcaaactaaatctaatacctctttaagtcccacagcaaaataaaacataggtaggcctcattttatgttttgattatgtcttgaaaaccttgtatacaagttaaaacatttgtaaaagtctaggcatgcttcatttttgaaataatgtggtagataacttaaaatgccagtaattatwttccagtctaaataatcacaacattgagtcaggtgtggtgactcacgcctgtaatcccagcacttcaggaggccgaggcaggcggatcactcgagcccaggagttcaaaaccagtctgggcaacgtgacgagcacttttctatacaaaaaatacaaaaattaaccaggcatggtggcatgtgcctctggtcttagctacttgggaggctgaggtggaasaatcacttgagctggcgaggccgaggctgcagtgagccatgattgcaccactgcatcctaggctgggtgactgagtgagaccctgcctcaaaacaaaaacaacaactacaacaacaacaacaaagtcacaacataatttaatagattttttcatatgttggaatttcactaagtgaagaatacctgttatatgttatatgttataggtgataccgtaaggcatatgaatgatcatatttctaaaaaactttttactttggctcctaaatttcaataatctaaataaatactttgaggtatatttgaatatgttttttgttttcattcatttctattttatttttatttacatctgaatgtgttttcacgaaacaattttagctccaaactccaaattgcactattagggaaagggagaatagcttttggctcttcttgtactatttgaacattaggtaactggttactgtcttctgcacacttttaggatgtcattggttcaatctcagggtcaagtcttacccaactgtcctatgtactctgtccattcatgccttaaaagaaagaacctgaagaaaaagttgtacctttattagcaggttcttttaaatgaattttattaattaacatataatttcttctcagtaagatatgtgagctggcaacacattgccaatcctatggttatttttgttagtatgcacaataggtagtttcatgggtcaggaaagcagaaatagtatacaaggttaaagaaatgattttcagttctctaatttccactggaattattaaacatataaataaacaaaaaagaagtaagataactcactgtccctaggtgaagcaatgaaagtaagtgaagtagtaactgtgtctcctgtttcaccctcatgcttggacatgtgtatgccttcaaaagctcacatccaagtcatccagaaaaattagcctgttaaatagtataggagaatcaacaatggaatctcttagtgcctggaatttgcaattgccagttaaagctagtaggtaaattaaaaataatttattttacagtgtatactacctctttgctttactgaccctcaaaaacgcctgctgtgtatactaacaaaaatacctttataactggcaatatcttactgagaaaaagttataagtaaatgaataaaattcatggaaaatattccactaacgaaagtaccacttttattcagattcttatacatgcaaaggcttacaatatcatatttctgggtaaatacttaaataggatgccaccctgctttgttttgaagcgtagtacgcctttccgtatgcagtgctccatgctgtgcagtcacggaaattaatgagttcagcgttcaggatgccagggcagctggagaacagagttctgtgctcatgtggcttacacaaacacacgagttgtgtttcccacagtgggatccagggacccctgaggttctgcagcttttttatttggtgaaacatagatccgaaagatgatgctgatgtggtgaagggggttggtttctgaaactgtttaagaattttagagatcaagagtaggtctgagaggagctggcaaagcaggcatttatttgtggtgggaggatatggggaaagagcagatgtctgtagatactacaaaggaaaataaacaccatgaaagaacaaacttatgtagaaaaattttaaaggaagattttttaagaaaggatgtttgggaaacactctaggagttattctgggtagcacttataaaatgggacaacttcttacagccagaatgacctttatactgaaagtcttcatttcttttgatttattccatcctgtcccatttaacaaacttgtattaaacagctactttgtatcaagaactatacttccttgcctcctttccaccagacacagatatacacatatacacacactcactttgaagttcaaataccatttgtaataactggagacccacaggactttagcactaaaagtcaaaacaattcgcttgctatggcaagatgaagttaaaaagcagcttcccaggatgaaacttggaaaatgcttaaatactgaggtgtttatttggatttgcttttctaaacttgttgatggaggtaggtatcttgctgacatattacatcatttctgatgaaagaattttagtaagatttcttgagccagattttcttcttaacattaattgtattgggaagttccaattgtttgaaggagacactgagttggatatattattttttacatcaaatataaattttctgtatttgagattatgatgtcatttccaaatggttgtgttgcttctgtactcattggccaaggccctataattatttgtcatattttaattctctttgttccccatatctttaccactagaggtctgtggctcctccttctcaaggttatggtgctataaaaatactcatttcagatttcaaaccaactagaatgatgtagtactatagagtttttggattcagttatactttgagtcaaattttatcttttacagcaaccatatacatccacactgagatcaaactcacttaacctattaagagtaataaaactgattaaaatttccaacccataagactaatattataaagttgttatacattaaggaaaagggcttccaactttcacaaactcttattactaaaatgtttttcttccaacctcctgtattgcctcaaaatggaatatatttcatctgaatttagtaggtaaaagtaaatttggagttatagaaaatacttaatatatcaccttttagttacagtgagaatatatgactttaggagtttataccatgtgaatggggtgaattaactctttccaccaggaggctttggcaagaggtaagagctaccaagaatgtaccagggctcaggcttggggaagagaggggcctctccagctcttcattatagagctcatactttctagatatgctgtctgattctcaggtggttcaggtcggtgaattccttagtagaatattaatatactagaaagagtcactgcagggtcaccctgtccttgtaatagacttgcaacccttaaaataggttagaggggagtaaattttcattagagtgaaagaaggcccaacttgtgattggctcagatcctaggtggtatcacagatatgcatcatgttttgagcaactgagatgagaatccaaggactctaactgaatggaatggtgtcatctgtactcctcctccctggctagctcttccacttagaaggcctgacaccctcatcttagattttcttcatgtatgtcattgcagccaagtttagaaacaggagatttgctatgaaaataagtccatgaatctgctgtctcatccccactgatgtaacatacctgtattgtgtttcaagatacagtcatcaaaattagggaaaagtcctcttttgaaagaaaaatcaactgccaaatggtatactgattctttggattctacctacgaaatcagttagctcattttttgattattctcttttgctaaatgcataatttgtatttcttgcagcaattaatacctgaaagttatttgtaagctcatttcaaatgtgataaactgaggttcatagaggtgaaatcacttgcttttttttttcaggagcatcatcttttttttttttttttgagatgaagtctcactctgtcacccaggctggagtgcagtggcacgatctcggcttactgcaacttctgcctcccaggttcaagcaattctcctgcctcagcctcctgagtagctgggactacaggtgtgcacctctatgcccagctaattttttttaatgtayttttagtagagatggggtttcaccatattggccaggctgctcttgaactcctgaattgaggtgatccgcctgacttggcctcccaaagtgctgggatttcaagtgtgagccaccgtgcctggcttagcatcatctttttatgactgtatttccaggccctaccatatattcaattcagagtaaacacttggttatatttgtggagtagtggaatatatgaatgattgaataaataatatagatgaaaagattagttcctgtatctccagggatcactatctttctataccaccaaagaatttgccctaaaaccattcactgtaaaaacataattatgattatatcttgtcttaatcttatgtcattatttcattccttatgttaaaaataataaaaataatgttaattctatgatttctcctatttctaaattgcataaacatatgtaagaagctactgaaataaagcaatagcattttaatacattcccttgtcaccatttatttgataccctcttgccttggcttggaatttgcaatattcagaattgcatttgttgttgaatattcctatctggatattactagattgggatttctgacccacctagtccaaagacagaatttctttattaagaagccaacaactaaacaggctacagtaatactccttggaactcaaggatgcgtacaagagggtggcttccttcaatctgtcaacagcctctgtcacctccatttatcctttttctgccagtcctattctcaaatactccagagctacaagatgattaagagccatcatgagacttttgaggattgttgtgagctgggttgttatttttatttttatttttattaatcagaccaactcaatagcaccctagttacagaaatcctatgatttggcctcataagatcaatgttgaaatcttgcttctgtcattaatgcaacctggcttttggcaaatcactcaacctctctgagcttcagtttcttaatacacaaaaagaggggaatgtctgctgtcctgcctcacctcctcaaattattgaatagctcaatatcattactgttattattattattatattttaaaatgtttgtaagcagaaagcactgcagagctgtaggttgcttctccctctttctcacttagttttcttacatatcaaattccatcctggggtaaagtaattgctcacaatttctttttataagagatatccttcaacaccagcaatttcatctttctctttttttaactcttgcatatatagcatatataaccatatttgaatgggagcaagtcttttcatttcttttctacttggacctataagttctagctgaagtccttcaagaagttagatctggagctctgtggccaggacttttctccttactcagactttccagtcattccccaaatcctttccagcccattgctattgtagaaaagtcttctccccaaatttgcctctcaggagatgcagttatgcagactaatatgtggctgtcttctaagctcatcctcatatcactttgtactagccctttctagttttaggactaagatgtaaaaattgaattaatatgaatagtggttactactttggatttggaagcctgtggaaatgtgggcacatttctctgccttcccaagctttcttctccttattttcagaatgatgatagtaatggtatttaattatagagttgctggcaaattaaatgagagtaacacatggtyagtacacaatatagttattatttataaggggaaaaattactggttttcaattgctggtacatgtgaaatcagaatttcttttgacatctgtcttatctatgtttatttcccattattttttgtattttttctatattgtctctgaagccacctctgtgttttgcttttctgggagtggaagtggaggctcggttgtgaataagtacaattttgytttacttctggtacataaaattccaagacaacttagtataacaaaattcacattgaactaaaagttatgaaaagctgcttttactgtttactcactcctttaaatcaaaagaactgratgtaaactatttttttatgtcatctcctgttcttcaggctcttcggtgcctcagaaaacataaaagagtctgatttacaatcattttgggcaaattgcctgtagaattctaaggacaggaaatgaaaaaagaagtacagcacacacccccagacattccacacaacatgtagaataaataaacagccccaaaaaggaaaccaaaactgcttggtcttatgttgaggagggggtaccacaaatggcttttggagaaaatgtattaaagatgatgacatgctagaaaaatccttcaggggggtgaaattgaccctgattaaagatgatccttttccccttttctctacagcatagtgagtattttttatttagataacttccattacctgtattgacattatgaaaaagaaataccacgttacagagctgtgctttccaaaccttaataggcagggctgccctggggatctcgtggaagcgtaggtagtgattcagggaatgtggatagggcctgaggttctgcattattcacaagctcccaggtgatacagatgctgctggtttatgagccgtggttggttttcggtcatcttcttcaacaaaataattggtggtgatgttcttgtcttcatctgttcaagagtggttttcaactggggacaattttggcctcatgggaatttggctgtgtctggagatttttgattatgacaactcatgaagtgctattggcttcatgtgggtaggggacaaggatgctgctaaacactctatagtataaaggatagccccttataacaagaattttctgacccaaatgtgaatagttccaaagttgagaaaccctgctgcagaagtattattttatgcatttcttgtatcaaaaaatactttcttgaaattgttcaaaaaataaatacacaaaacctgtgagagcaaagaataggagcatctactacagtcatgcatcacctagcactagggatgtgttctgcaaactgtgtccttaggtgattttatcattgtgcgaatatcatagagtatatttacacaaatctagatggtagagctacacatctaggctgtatatcgcctatgtcttctaggctacagacctctacaagtggttactatactgtatactgtaggtcacggaarcacaatggcggccgggcgcagtgactcacacctgtaatcccagcacttctggaggccaaggcaggtagatcatttaaggccagcagtttgagaccagcctggccaacatggcgaaactcagtctccactaaaaatataaaaaaattagccaaacgtggtgtcaggcacctgtaatctcagctactcaagaggctgaggcatgagaatagcttgaagccgggagacagaggttgcagtgaacagagattgtaccactgcacaccagcctgcacaacagagtgaggctcagccttaaaaaagaaaaaaaaagtaaagcattagtgtgtctaaacatatctaaacatagaaaaggtacactaaagctattgtattataatcttatgacaccaccattgtatatgcagtttgtcattaaccgaaacatcattatgcagtgcatgactatttagtttagagagtaagcagcatttaaaactgtcttcaaatatgtgaaagactattatgcagaagatggtaaccagctgttctctatcacgctggaagaatgaacaggaaatgtacataaaaggacccgtgcaattcacccattctttttctgctwccttcatgccagctagacaaatctcttcatgatcttgcaaccatatttgtcctggcctgtgtcttaatacttgcagagaccctcccaaatcctgggtacacattttcttttcactgccaaatctcatctctttctccctttaaaaatcttaattgaaaatttctatctccataaaatcttccttaactaagatgaaatagttgccagttcatctttaactagagctggcatacttcttccttcaacatgttatctgtcagtctgaaaatatgttactgcccatctgtgtacaaggagttgtgctagattttgataaaggattaaaaaaaggtaagtaagagagtcattrtttttaggaattttccaatttggggggaaaaatctgacacagataactatatagtatttaataattatctccatgagaggtttcttaaaaaataagaaaggaggttttagaagtttaaagattacttctaggtagggaggtcaagaaagactttacaaatagatatatgggtgtatctttttttttgtttctttgatgaatttattcttcaaggaaaaagcagttactattgtcgccaaaatttaaagattataaattagagtagtgtggatttaaagtatatttatgaaaaaagttcatagtgagcaagggttaaaatattagagtgatttaatccactcacaatttataagactaggaaagataatttttcaggatctatgtggctatatggtggttttaacaaagaagactgaatttagccacctctgaatgtacctgatgaggctctgtaattttataagacagtgctctttggaaataattttgtttgtttgtttgtttggtttgtttgagacagtctttctctgttgcccaggctggagtgcagtggcamaatcttggctcactgcaacctctgtctcccaggttcaagcggtgcccctgcctcagcctcccgattagctgggactacaggggcatgccaccacacctggctaatatttgtatatttttagtagagatgggatttcatcctgttgaccaggttagcctcaaactcctgacctcaggtgatccacccacctctcaaagtgctgggattacaggcatgagccatcatggccccctggaaagaattcttagttacatctaggagaagaatattttggaacttcacaagcatactttaaaaaccagtaccaaagcaggaatttggcaccatccatttgagatggtgattctagaacttctttaggagacagtcttacttactaagagtttccacaacctgtactatgagaaaattaaaaagaattaaccctcatcaaatatgtagtatgtgccaggcactgggtagaccctttagatatatcatgtgatttaatctggataacaactggtgaatttatcaacaccaacattataaggaggcttcagagaattagtataaatttccatccaattaaggaagggaaacagagcaaatctcaggcctgcataggaagccatctctgagtggagaccatcagcttgccttttccttttgaagcagcaaggacaacatctatttttataaagctttacatggtgatatgtgcattctctgtagttgaaatgggaaaatgagctgttcagagttcattgatggccatggttttctgcagggctcactgctggaaaactatctgcaactgtattagtcatatatgaatctgagtttctgcctgctcttttccacacattctgaaaacctcagctctaggaatggtacagatattaaattagtatggaatttttttgaatgttaatatttgtgttctttaaagtcattatggttttttattttttattgtattattattatttttttattacactttaagttctagggtacatgtgcacaatgtgcaagtttgttacatatgtatacatgtgccatgttggtgtgcggcacccattaactagtcatttacattaggtatatctcctaatgctttccctcccccctccccccaccacacaacaggctgcggtgtgtgatgttccccttcctgtgtccaggtgttctcattgttcaattcccacctatgagtgagaacatgcggtgtttggttttttgtccttgagatagtttgctgagaacgatggtttccagcttcatccatgtccctacaaaggacatgaactcatccttttttatggctgcatagtattccatggtgtatatgtactacattttcttaatccagtctatcgttgatggacatttgggttggttccaagtctttgctattgtgaacagtgccacaatagacatacgtgtgcatgtgtctttatagcagcatgatttataatcctttgcatatatacccagtaatgggatggctgggtcaaatggtatttctagttctagatccttgaggaatcgccacactgtcttccacaatggttgaactagtttatttggtttacagttagtaatacagttaagagtggagaccttccttgagttttcattctttgagcttctttttttttaatagaaacagctttcgatggtaaccttaaccatgccttccataactcaaaacatgatggactcttagttaactctatgtaactggattttgtttttctcctaaagttgttctacgctgctgcgtatcattcaatgttgatgtgaaaaattcaatgactttcagcggcccggtggaagacatgtttggatatactgttcaacaatatgaaaatgaagaaggaaaatggtaagccagtgggttttgttgttgttatttacttatttcacaaggtaatgagaaatattatttgactacagtttcttttatgaatgaaactttaacagaatgaattatttatggtagaaaatgcagtctagtcatttggcaatggaagctaacttaaagtaaaaaaaaaaaaattccttggcaatattagaggaagcgattagtgatttctgttgatgcctggattgacctcaaggaaggtctgtatccaaaaaagctattgttccataattatgttttttggcaagaattctttaattgttctcatttcagagtagcttaaatgcacttgtttgaaattcagtaggaaggattcggaggcaaatgagatggtgctctgaaagggtttaacacacttccgtgagtttggtctttactgatctactgagcttggtctaatgtttataatgaactttattgggtttctggtatctaccttcaaaccctttaatattggttaagttcattgtagataggattttttttttttttttctgagatggagtcttgctctgtcacccaggctggagtacagtggagcgatctcagctcactgcaacctccgcctcctgggttcaagtgattctcctgcctcagcctcctagtagctgggattacaggcgtgtaccaccatgcccggctaatttttgtatttctagtagagacacggtttcaccatgttggtcaggctggtcttgaatttttgacctcgtgatccacccacctcagcctccgaaagtgctgggattacaggcgtgagccatagcacctggccgtagatatgatttttaaagtatatttaacttgttgaaaattatataaactgaatattagagttcttttgcttaatatttaatagaatttttagtaaatgcaatttttgtttaattggacattctaggaaagaagagcagtagctaaactttagtttaataacttaaactaaacaagcctacatttttagtagctgtaataataagcaaaaagagatttatatctacttggataataaagatctatgaatcactataattatttcattaataaaaatatgtggattttctgcattttgttttatcttttagacttggttaatttgataataatgccctaaagactataaaaagtaatgagttctcacattttttaagtacattattttatgctaggtataaactagaatttgttgagatacttcactcttttattctccttacaaatatctcagatgacaaacccaatgctacatgctaaatttttaagttccctttccctccctcctatactctccacccatcccattccccaatttttaaggttaaatgagtacagccctccctctagacaccagctttattcttttaggaattataccttcaattcaggtacctctgggagaataatggtgagtagaccaactggtcagactttgtgcgtaagctataataaacagaaatgcagtacatgttattcttaaaaagcttaactttacataaacacatataaaagttaattttcactaattactaatagttacacaaattttaaagaggagtatagcaaatagcaagctttaagacttaaaccacctacttaaaatgaagtatctcttttaaggatggttaaatattgctaaaatattttatgaaattctcattttcaatttctgatatcagaaaaacctgtatgttttctttcttatccwgtcctgtctctgtgattttagaaaaatctgatgtcagaagtccttaattatatgaatgaaccttagtagagtgaaaaggggttcatatttctttttagaagccttagtgcccccatttgatctctttagtcactgtttctcatgataagaacctatcctattgtgagatttccaccctctaaattctacagtccctcctttcaaggcaccagaagtcaaagcaatggaaaattgaaaaatcaggcctgaatgaagccttgatgtcatgaggaatgtccttcctaaggttattctatctttgtagaaagttaaggtatggatgaggaaaaagaaagacagccaacactggttaaggaacaaaagagtgcatagattggatagtaagaataaggttgcaagaacgatgttgctaatggtctgtctgaatgaatctacactggactgaaccatcacaattctacatacatttgtgaggtaatgttaataagagatcggggactatgccttatatcttggtttacccatgaagctgagttgaattgtctctgaaaatatttgttggtgggttaggttttttttatttagccatagcataaatgtgggtcagtcaatcaacatgtatttatgtaatacattttatgtgtctggcattatgctaaattccatgggaaatatttatacataaaacaaatataaaagctttaacctagtcaaggacatacatgaaatgtttaggaatagagaatagtgccaacaaccagtgcagaatagactataaattcaatgggaattcaaaacaggaggagatgattcttggttcttgacctaagtcttgaaagatgacttaactttcaatatgagaagaaaaatgtcactccaagcttgggaagccacaagagcaagggcccagacttgagaataagtgaggtgagtgtgttggtaagtaaacaggtctcatattgggatgaaaaaagagaaaaggatgatggcagatcttgaaagacaaacacaggagcttggacctaagatgaggacgttgagaagccatcataagttgtcattttatgaaacttaatttgggaatttacatataaattggattggagaatggagttcctgaaaactaggaaatatatagactcaagaactataatctggtacttaagggatgagccttcaggctgtattaggggcaactggaagaaaaaagaaaggtgtattcaagacaaatcaagatgaatcagtaaatcttggtggaagtttggaaatggtcaatgaaggtgtaggagaggtcagatagattccaaaatttctgtactggctcattgggaaatgggttgtcattgacagagaaagggaaattcacttatcaggaagtgggtaagtctatttttaaatagctccagttcaaggtgatttctaggtagttggaaacctcagactggaatgcaggtaagagggagaagttaatgtgttagtggaaatgcctagaaaacaaagactgattttgcagcccacttgcaaccctgggcactaccccacatctagcatgaggccttatacataatatgcactcaatcattatttgttggctgaacaactaaatctagtttaacactctgttatcatcaattaaaaaaaagctgcataaaaaataaagttaaatgtgactctcctagggaaatgcaactacttaggaccagagctgtaatagatttcatctctacactcagtcttgtgcctttttcttcattagaactatatttaaaagtaaatgttgttaaaaactatctttgtggtaggtaccagactttacatattaatatgtgtgtaagtttgtaagcatttgaatgtagatgatatcagaaacctaaatctcacgttgacatttattatttacaatgattttatggaaaagttgtgaaaaatcagagcaaccaaaaagatgtgggcaattgaatttaaaagtaagcaaattacaaatacctaaatttccaaacttttaaggatagcatggtagcagcatattgttctaaagaaatctgggatctggtagtgcaaaataacctgtagaaacatgtttggatgttctgtaagtgtctataaaaacagatagattgcagacttacttcgagaaatgtgctacagaataattgacatatttggaggaacatggattttgttatttaattatctctagaggtaggcaccttcataagtcatatttactgctcatgctttcgaatttcataaactcatatttaaaaaaatcatcctgacccatcttacgtcgtgactatagtacgcctatagaaggagcacttgttagcccatgacaagtacagtctgtgtatttgaaaaacatagctttaattctttcgaaagaaatataagttgacagaaaaggtagccttatgtcctctttactgttcagaagtttgctctgaagtgtaatttatatcttttgctcagaagccacatgctttctcagtagcagaacacatcatacatctgattaagatcagctgttgttcattatgtttagcatgagctggagcatccaagtaattgcaatgtggttcagaagaattcagaaagaatataattgccttcataattttgctttgaggaaaagaaattcaaacatgctcagcacagcacaagccttccagatttccagatttagtggtaaacatcagcatggccaggtctcagccgaacgggaaaatgtgagatgtctgtttggggctttccactctaatctgttgctgctttgcttcattccttccagcatgtgtgcctacccttttaactgcccttcaagcaacctttcttgggggtttcagtgacttcactggacctgtctgatctcaaagtagattttcaggatccacccttgccaaccttcaagccaatgtttatcaattatcttgacttcatgccttttctctagaggatcctgctttatgccaggtcagggtaccaatgggctcatgtgattgatgccctatttccaataagtctgtgttgtaaaagaaaaaagaatccctgctaatgtagagctattccagactggggaggagagacattttaagggtttacacaattttctgtaacagattttaatatgcttattttacattgcttctaacgccttttgaagttgaaatttcctcattgccaaacttgtcatttctttggctcccctcatttccacccctccaccttttatgagcaaatcactgcagttaatgggtcactgtgtaagtttcattctctaagatgaaaaaatgcttattccatttatttaaaaagaaattggcgagcagaatttgcttggcactctgagagtgactttggcttgaactatgtattagacatcaaggcagagttagttgaaaaggatgttaatgaaataatgtaaatataagacactcttttccaagaaactatcttttgcagggaagaaaacataaatatgaaacagagacatcagacaccacctactcttcaaataaatataataatgggcataataacaagataactattgtgaatagcaaatatttctgcttactaaatattattataattgtagcttattcatggagaaaagtgtttctctcactttgatgatccttgagttgatcagatgtttctccagaaatgagtaacgatatccagaacatgttttgatcttctcagtctgcatacaggtcattacaaaaatgccatataaaaagcaagatctaataggaataaaacgtaataagttaaaactaacttgcattaaattttaaaataatgattctcacagtttataaaacaatgtgcctgggccttcaccttgaccctgtgggtttgggcggatatcattgttatcatctgtattttctagacaggaaactgagacagagaatgaatgtccaaaggtttaatatagcaagtatgtcacagggtcaggatatggaacaccagccttctgactttttagccaattctccccctttagcaacaaggattctctagctgtttgacctggagaaatgcctctggtgtcactcaaaggcatgtatagcatcccacttaagctgaatatatattctctaaaatggaaaaaaaaagattttacaatccagacctcttggctggtcacataagtataaattctcaggtctgccttattcagatttttaagtacttgacacagtcgttaattcattcattcaatagatatttattgaatgcctattttgtgcttggtactagtatgagcactaaggatgtgtttgtgaacaaaatagaaaaaccaatccctactattgtggagcttatattctactggggaatagagaacaaaaattaaataatgaagttaataaacaggtaggttacatcaaatgccagaataggatcagtgttgtgagaaaaaactgagcaagagagtggattgagaatgctggagattcctgaaattctgtaaaccctatgctaatacttttctaggatcttgttattttgatgcagttggagaaaagtgaggcttccttaggattcaagtggtaagatacacgtactttcaagcttgttattaaaagtttcatgtttgttttcaaagaaaacagatactaggaaaatacagaaaattagcagtcctatgatctgctaacctggtctttactattggtcccaactcccaaactccctgtctcaatcctgggctcctacactctaccactttctaagttctcactccgcaatcttcacttatctcagaatatgcaataggccgtggttgagattgctgtatcaggtcagtttccaattatcaccatatcctaagtgctttctcttgccctagagatcaaacataaactccagaccttttcctccagagccaaatgcttgccaaatctcaagctctctgttcctgtctataagcaagctttattctgagttctagccacccatactttctcattatcttcccttttccatcttcattctcctgtctccacacttttccctgggctatccatatctccctttccttctgccttacaattcacaatagctctcctattagcatgctgtacaagactcacttttcatcagttatcctagattttcccccacttgatattacatgttttccaactagtgagtcagttcttctctacaaacttatatttgttctattcagatgatggaatcttagaactggaaaggactttgagggcctaactcccatccactataaaaacaccttccgaaacatccctggccagctgcaacccacctcatcttgaccagaggagctgcctgacagayctacgtatgccttatcagtttaaatcttcatcgctctctacaagcccaccacccttctacctcctctgtaaatctcactagacaactgcagctattattttccaaagaagaaaaagagacagagagagagagagagagagagagagagagagaagctactaggtcaaaatttaatcctcacttcctgtttcagttaactattgctgcataataagtcattccaatacttagtcacttaaagcagcaatggtctataaattctcaagatttttgaggattgaataggtattcccctattgcctgggctcatcatctggtccctcaactggggctggagtgtccaagctggctttcctcacacgagtggaagttcatgctgtcagctaaagcaccaattctgttccacgtggcctcttatcctctgttaagcaacactgggcttcttcacatcctgatgttctcagctttcaaaaacaggtaaaatggaatctgcaaaggccttttaaggcctagccttagaagtcatagtatcatttgtgctgcattctattcatcaaaacaaatcctagattcaatgggtggaaaaacagattctacctcatgaaataataaaagtcaaagtcgtgttgcaaaagtgtacacaattccaaaccatcgaccacccttgcaaaytgctcaatactgggctgctcagcgtgctgcctagggaatggtcgctcttcctcatttttaagacaaacctctccttctggatccaccctgtctacctgctcagagattctactccctctcctgtgaaatcaggatttctcttgttactgtttctttcttgccatcatttagccatatgcagattgcctccatgataaatttggacacatctcaagcccttaatggtttgtcattgccctgaaaaaaaaaagccacatttattaacactgcccatctccctcatttttagccaagttacttgaaatgaaatctgccacaaacatgtacctctcattcttgcctcctattctttatattgtttccttctttggtttctgtgacactgctgttttctgattcttgctccctttctgattacccttgcctagttttcttcctttgctcattgaaaccttaagtgttatttcaccttcagatgtcaacatttagtgctcttctcactatatttcgaggtggtaatatttacttttagggcctcaaccatgctcatatcatgctcatacatgttccacatggtttctgagatgttccccagcaagactgagcccacttgcctacagaagtaactcattatcagtgcatcctttcttggcctttcttccttcccactcttcttttccccatctctatacttatgcatacttggaattgcctccaaaaaacttacctgaaccaaagtttttgtcttggatctacttttggagaaacccgaactaagacagcttatatcctaaatatttatagagttagtccttccatcctctgtacttcctgaatccaaatcctcatctggattactttaggaatccatatcttgtcatttgactctaattttgttcctcttcaatttacttatgacacttcaagcaaataagctttgtaaatcaaaaaggtgatcatgttacacccctctttaatagcttcattggttcccaacttccccctacatagaataaagccaaagttcttaaagctgactatgagaacattcatgatctggactctttttacctctctagcctcaacttctactgcagttatactgagctacttggcatttatcaaaggagtggtattcttacttctaagactttgctgaagttgcatcaagttcagacctattcaatattgcaatagtacatgtatagttgtgcttctctctctaagttataagcaaactaaaaattgtgttttattcacttttgtatcattttatatcctcaggacctggcataaatgcccagcatgtaaaatattgttaataaacattaattactccagcctcaaattaaatactttctaaaatcgtaggctcatttttttctctaaactgtttttaactgtaaaaccaatttattccattacgtattttacaactgaaaatattaggaaaaaataatcgtaacctcattaatataatttgttatattcttgatgtattcctgattaatctttcaacatcgatgttagttgtttattcatctgaaataaatacctaataataataagaactaacatttagatagcacatactataagccaaatactgttctaagcattttatatacattaacttatttatttttttgatgatcctctgaaatggatctccattttatagataaaaaaactaaatcacagatggagtaattgacttgtcctaaccatatagctaagtgaatggtaaagccataatttgaactcatataggctggcaccaaagttcatgctatatttcatggagaagattaaattatttaatacacagaaagcacttagaacagggcctagcacatggtataaattcaataaagcctagctgccattatcagtggtagtataatgaacatagtaatttggtgtctttcatgttaaattagggcacagattttcactaaattagataaattttcactttgagttcgatcataaataatttttcatcctaccatacaatgaatgtacaatatgctatagaatgatcctgaaataattagtttttatttaccatatttcttttactctttcataattatatataacactatgagcattatctttgtgcattaagcttttccctcttactttaggtcattttatttaggatagattcccagaagtaaaaattatgtattaaagggtttgagcatttttgtagttctttatacaaatcagaaattgctttccaaaggcattatattaaaaccatgttttagagtctcaatagcttaatatttacaattgttttataaaatttattttcattaatactagcatgcctatagggcctacacaaaataaatcccatttcttttcaatatgacagactttcaaatatttaaattttcaaaatgtgtgcctaatcaatttgtacttcaatgcaacttctcagttctcctgcagacattctttctccatgccgaacatccccaactttcccagcatcttttgtctgacaaatttaccagactcctaactatctgagtcatagtctcctaaatacattccattgtgcatatgtccctcttaatttagatatttcagacatggcctgaccagcacagaacacagggggactatcactgcttgaccagggcatctatttccagcactgcagactaaagtcacattagcatttttggcactaaaatacgctgttgctcatgtttatgtgctatcatctaaatcccccatgcctttttcacatgaactcccattaagtgagggctcccacatcctgcactgatataaataatagtatgcagctgagcgaagttatttatgtaggttctaagtaaactttagtttatttatgtttattgttccagaatgttgagattcatctgaattcctaagtatgtatattgatatacttgataagtatttttttcttgctctgtcttatggtgctgattgataactatatttatactttttatatcttgactaaagtcattaataaagttgtcatctggctgggcgtggtggctcatgcctgtaatcccagcactttgggaggccaaggtgggcggatcacgtggtcaagagaccgagactatcctggccaacatggtgaaaccctgtctttactaaaaatacaaaaattagtcgggcgtggtggcgtgcacctgtagtcccagctacttgggaggctgaggcaggagaatcgcttggacccaggaggcggaggttgcagtgggccaaggtcatgccactgcactccagtctggcaacagagcragactccgtctcaaaaaataaaaayaaaaaaakaaaataaaaaaataaagttgtaatctaacacaatcccaagtacaaaatctcatactatgtaattaagtcctttgattgctagcagccagagtttttggatatggctactcagccagcaataaatcagcaactgtggatccacccaagtatcttactatttactttagttcatccgattcctgaagatatcatgggagacttaaatgacttgttggaactaaaatcagttgtgattatatgttttttccattaattactgttagaatggttttataattctgtctaaaaggaaagtaagtgattttaacctggatctcataaactatccttattttctaagcacttataaactagcacatgctaatattaaatcttatgatgttccaatgtttatatttcctgacttctctataaaattagcagttcatcataggaaaaagtcacttatacttccacatgtgttttataagttaatacagtagcagacttagccaataattattgattatttcagtaccccaataaaaaatatgataaagtaatataaacaaaataataaagcaaaatctctgaaatatctatcctacatatacacacacatatacatgtatatacacacatatatatgtatatacacacatgtatatgctatatatgtatattgtatatgtatgtgtgtgtgtgtatatatactttttaatccacatcaatatgcaagaggtaggctctctgcttagtttacataacattaaattactaatagcatgattattatctgattatgagtgttattgtcaattatcttaaaatcagtcataaaacaactcatataaactgtttctcaatgttcaaaaatgtttactgatttatttaacttccagggtgcttattggttctccgttagttggccaacccaaaaacagaactggagatgtctataagtgtccagttgggagaggtgaatcattaccttgygtaaagttggatctaccaggtatgtaaaattaaaaaaatctggttttaggccaggtgcggtgagtcacgcctgtaatccccacactttaagaggtcaagacaggcatatcgtttgagcccaggagtttgagaccagcctgggcaacctgacgaaacctcatctctacaaaatatacaaaaatagctggatggggtggtgcactactgtagtcccagctactcaagaggatgaagtgtgaggatcgcttgagctcaggagtttgagactgcagtgaatggtaattgcgccactgcactccagcctgggtgacagagtgagaccctgtctcaaaaaaaaaaaaaaaaaaaatcaggtcttaaattatgcccagtattctcactgaaaacagattttgggctgggcgcagtgtctcacacctgtaatcccagcactttgggaggccgaggcaggcggatcacctgaggtcgggagttcgagaccagcctgaccaacatggagaaaccctgcctctactaaaaatacaaaattaagctgggcatagtggtacatgcctgtaatcccagctacttaggaggctgaggcaggagacctgcttgaacctgggaggcagaggttgtgttaaggcaacatcacgccattgcactccagcctgaggaacaagagcaaaactccatctcaaaaaaaaaaaaaaaaagaaaagaaaaaaaacagattttaatcaactcaagaaaatattagaagtaatctgtgtgtcagaatggtcgagcggtctaaggcgctgagttcaagaagtaatctataatcatttttcatataatcatttataatctataatcatttttctataatcatttatcttccagattgacatagaatgccattttgattccctctgtccttaatttgctttagaaagtcatcaaggagcatacataaattagaataccgtactaattttataacttttaactctctgcatttttcagaattctttctaattcagtggtaatgtgaaagaacttctccaaataaacctgcccaccacattccctccacaaaatttaacttagtgcctggttttcaagaggaaatagaatcagaggaaytgtaatagataaatttaattttaaaaatagaatcacacaagataaatttatattgaaatagatgtatttgacataaatagtaggaatgtgaccggaaaattcctactaaaattatctagaaattagaaccctgtcaatgttctatacaatattacatactatggaaattatttatagccccacaagtttatttcacatattgtatttttcagttctcctttttttgaattttctatttgtttgtttttatgaactttttttctttacatgcataagcatacttataatagctgctttaatatccttgcctgataattccaacatctggaatatctcaacatcactttccatttattacctttccttgaggttgcatcacattttcctgtcttgtcttgtaattttggatcataacctggattatatttttgaattacaggtgtggagattctagattctgttatatgcctgtgaatagtcttaactttttttattagcaggaaatttacttggctcaactcaatttccaagcattgactttcttgcaatgacaagtagttaaaatctctattcaggttttatttcagctgggctatttgaaatatactctgcgcatttaytattcaagtcatctagttatttggataaaatatatatgcatattatagaactgttgttttgtggctctttttctaagatatactactctcctcctcattttgcagctgctgtcattgccctcaatctctgttctctttttattcagtacagtaagactaggagttctatttgagttttagccactgaccagggccttccctaggttgggggtgggttaggggtgggggacaaaaacaaaacaaaacacaaaagcacaaaactcatttagtgccagtatcttcttccaagtatggattcccctccattttctgccacctttctagtgccttcaggtgattgtttcatgtattttttttaattcttcctagaatttatagttgtgatttgcagaggagctgttttgttaggagttactcctcccttactggaaattggaatagttttaaaattaggctagagattttagccacatcaagtacagtagggaagtttccactgtagtccctaattgtcccaggaatgctttttctgggtcaagctttgtatataaaactctaatccagattatacaagatcaatgcatacaatcgcccagctctaggtgctttcaaagcaaaccagactaaactcttggacaaaggccattgcgcagatcaggaagtctaactgaccattccagaatctctgcttccattccccactttaaatccacatacagtcttaacatgaaaacaacctctggaacaaacrgtgagacaaatctttctcaacctgaattttgcctctttctaatattccactctactaagcagatttagaagttcttgtttttcctgtccagtctttttttcttttttagtgtgagaaagtgaaacttcttgccaatattgttaggctggcatgcttcatgcttcaggacccaacattcccttcagaatgtcaaatgyagtctctttactgtgtttcctttatcaaaactttctggacactgctctaatattcctctagtttcctttgtcacccaaaggatgtcctcatgattttggaagtcatggtcaaaaaactggtgtttgagttttcttttctgatcttctacccatttccccttttcttgccaaaaatcgtgtttcatcactggtcatttataacaaagttataagattacattatatctacagtattatgagattaaaaactttgctttaattagcaagaacgtgcaaaaagcaatcccacattctcattgccctgctagttctgcattctttcacagttcagcaaaactatctgaaatagtttctgggacatgagccaactcttcagccttagcttgttcattatattccttaagaagacttggaagactaattagttgaaccaaaagaagaatgtgctatgatatgagcaaaacaaatagaatgtcttaatgagagatgcttaaaatttcactttgtgaaacttttcctccctcataaaattttgttctatttttagttaatacatcaattcccaatgtcacagaagtaaaggagaacatgacatttggatcaactttagtcaccaacccaaatggaggatttctggtaagaatggagagaatgatatttattgacaacagatatgctatcattttaagtctttgtaagatctgttatataattttcagtctaatgatttctaattttaaaacaattttttaaaggcttgtgggcccttatatgcctatagatgtggacatttgcattacacaactggaatctgttctgacgtcagccccacatttcaagtcgtgaattccattgcccctgtacaaggtacagattttatgcaatgttcttgcatgtttgaaaagcctatgcaatgaatgagacgtatgtatacaaaggaacataccaaaaagcttaaagtattttcttagctaccagcattaccaatttaggtaaatgtttgctttgccagtatataacaaaatctgactgctatttttggaattgatattagtgtaaataactttacaaagtcatttttaaacatcatagataaagctgtcatgckgcttatatttaaagaatgagtctctttgaagaaagaagtaacttcatttgagatatgctcaaaaactgttttataaaaacttatataaaattcatattgagaaaatttgcaaagataactctcatacaatactaattaaaattcagtaggtatgaattttatcccacaccaattgttattgaaagcaatgaatatttttatcatctttactttttcgaaaactattttttattgctaaaacaatgtgtctactttggagaacatcagttcatcttttaaaatgaacttctttcagccatgaaagcacttcatatgcctctgaaaaaaatagattccaaatttgacaattgactccttttattgcagaatgcagcactcaactggacatagtcatagtgctggatggttccaacagtatttacccatgggacagtgttacagcttttttaaatgaccttcttgaaagaatggatattggtcctaaacagacacaggtatgtgactttgtgttttgatttctgttgttctaaagataaaaatgcacaaatttttaataaaaccaaatattctgaaagcaaattaatcaataaaactaaagttgagaatgaattttatatccatttcctgttcttatttctgataaaaaggacattactttaagctgtgttattttctatttttttcttttttcttttttctttttcttttttagacagagtctcactctgttgcccaggctggagtgcagtggtgcaatctcagctcactgcaaccttcacctcccaggctcaagcaattcatatttctcagcctctccagaagctggaattacaggcatgcgccatcacacctggctaattttttaaatttgtaatagagatggggtttcatcatgttggccaggctggtctcaaactcctagcctctggttgatacacctgtctctgcctctcaaagcattggtattacaggcgtgagccactgtgcccaacctaggctgtgttattttctaaacagaaaatattatgaaagctgccatttttaatgcacttgaaaaataactcctatagagttctataaactcatagtttaatttttacttaaaatggatatagccacttttggtaatgtcagagccgggtgtcagagtttgtaaaaactaatctgacatcccaaacaacccatcacattataatctctcctctcatattatacaaataagttagtaactgaccagaggatactacttaaagcctgttgtcctttctgttaataatttcttttccctaagttaaaagaaaatgcccctggctatctctgcataaaatcaaatagttgtttgtttatccccccaattaatatctatttctaaacacatctcctttattgccactaaatgaagtggaacttctcacacagcttttccactttagatactgagtttaatttaattacatttaattaaatacatttgactgatttaatgtttattaaactcatatgggcatatatattaaaatacagggcagacataatggataacaggcaaataaaatgtcaaaatgaagtcaatgcctcaggtcaggaattagccctagaatcagagcctaaaagattgttgtgtggtttggaggctgtagagagcataggagactttaagattatagtactgcaatcaatacagtgatcttccttttttttttttttttctgaggrctttactttgggagaagtttctgaggcactgaaaaagcagactgactgcgttaatgtttgccacacctacattaaatttggaacataatatgtgcacatatatatacatacatgtgtcttcatgtgtctgtgtatatttatgtctctcttaatattttgatatctatgtatatataattttctaaaaggatggtggttgaaaatttcaaagttgaackcaaacttcaaagtraaatgtattgctgcattccaaggctgaataggtctctgtagagagtgagtggaagggtaaggttataaatatcctgctggacaatagagaacttgttgaaatcagtgtaaaatcattaaaaatgaaatgggcttttacgtatcacaaaatgtaattttccctggaagtgacttatttgcaattgaccttctcaagtgaaattactagtggatggtaggggacctttttatcccgtcttgctacagggtacagggcagcctgcatcttaacagaccaactccaggatgtgacttgytcttccttctggcacctgttcctcatggacctccttttttcccttctgagaccactcttccttcctcctttcctcgcttcccctatcccttctctccttggccaataagatagcatagagtcataagattaaagctggaaagaatcttaaaggtcatttggcccccaacctcaatttatgaaggagacacgagaggctaactgatttgtttaaggtctttctgcttgctgatggcagattagaacacacacagctctctaattgtagcccagtttgytgttgttttttttctttctgagggctctacttctagagaagcttcagagccagtaccatctaatgcccctgaatagtagatttcaatccttttctatttcatgaggatgactgtcctcatccttcctcaggcagcctcttggctgaaaccgtgctaggcttggcaatgactcactgcctggactaataccttaaatgaaatggcttgtgttcccgctttctccacttttgcccatgatgtgcgttctttccttcttcttgttttgtccatcccatttgatcttcttacctaactttttccttccaaagctaataacatgcttgaaatattttttacaatttattatacagccatctaaatattttattttacctttaaattcacttatgtatattactcttaaaaattaatttatttgtagctatttgtgaaaattagtgcagctgtgacatgtctgaagttggtccacaactttagaaagaaaatccatacggctcttttagaacaataattacagcttctgtgaagatctatgccagtgactccattttgtaaagaaataaataacagtcaattgcttatatgctcaagctattcttctgcaatttcgatgtttttcagttagaactataattaatttacatttctgtgttgagagtcctaaaagaggagctattctgcctgtccaccagaggaattctagcctgccagagtgggcaacatgaagttatatgtattttctggagggaacaatggctctattcagacaaattcaggagggcccttggggtccagatgctaccagtgaatgggaggaaaatgaacttaccctgcagcagaagagttcagttacatttaccaagatccaggacctcaatccacagagaagaatatttctgaatgaagcaccctgcacagtgtcgtttacattatcttctgacttcacccaagggaacctgatttttaaagagagaagctgattatatttctgaatttttatgtcacatcttgctttcatcattgattgtggagcttaaccatatacattcattcatttattcagatgtatgtactaagggcttactatgttccaagctctatgctatagcttgggtaatagtggggaagatgacagacaagggtgatgccttaatggtgcttctgtctaatgccatgtttctccaattatggctcatggaatttctgcttccaaatcactgggatgcttgaactataccccagattttcaaaatcagaatctctgagggtggggctataagcctgcattatatataagcaacccatatgattcttttctgtttgtttgtttttttgacaaggagtttcactcttgctacccaggctggagtgcaatggtacgatcttggctcactgcagcctccaccttctgggttcaagcaattctcgtgcctcagccttctgagtagctgggattacaggcatgtgctaccatgcccaactaatttttgtatttttagtagagatagggtttcgccatgttggccaggctggtcttgaactcccgaccacagatgatccgcctgcctcggcctcccaaggtgctgggattacaggcttgagccactgtgcctggccccatatgattcttaaacagattaaagtttgagaaacactggactaaggcataattattatattagtgtgcgtgagtgtgtgtctgtctatctgtgtttgctgcatactgtarataataggcacctcaagagcaaagtctgcatcatcttcttatcttcgtcagtggccagcccagtggtttactgtggcacagtaagtcctcaatgagcacttgttgagtaaatgtttgtatcatattgagtccagttttgtatttttctctgattattggacatttaatgagtcttttttctataactggtattttaaaaattattttaagtatattactttatactttattctctagtattcagtcttttctaatctttttttttctattttggcttatgttttatcagtgactaaattcataaataattctctaaaatgaagagattggaaaggacatatttaccaagccattgcttttgctaaataacatttaatagggttttaagtataatgcatgtgaactctttttaaagtttgatcatctttcagtggattcagaaaagaaatcctgtcatagaaaatttggaaagacatttccttttcaaagaaaatatgtgctgaaaagcatgcttatctttcatgtagtcttacagtaattctttccaaaaactgtttacttgacaatcaattctttttcttgattggttgctaatgtaatttaaatccatttgatttgtttgtttgtttgtttttagttttatttgtttcttttaatgaaagcattcaattccaccctatgattggcagaattarcttctggaatttattctcccctttatgtattctatctctgtttctgaaaggaacagatgtaaaaatgaattgtgagaaagattacccagaggagggtgcaaaagatagaaagctaagagctggacagagaacttttagactcctcatccataccaaatttctaaaagactatgaatgtagttgtaagatttgtagagaggatttctctgtagaaagagcctactcagaaaggcttcagtggggtcatacacatcttagtatgtgtatactggagttgggacacatagttgattgactaatgcctaactcctgtctgaattgtcagagcatgacagcagctgttatgtctagctgctgacagggaagtcggagcagaggtcactgcactggagtcagcctgcatccccagagattgttagaatgcatgtgttttcccaggattggcatgggtactcaaaagcaagagccagtgtgaggtcatgtcagggcctgtccttagggattactggaagtgagtggctgcctctgcagagaatgcagaagatctctgtaattcttaggaactgaggcagtgggatgcattcactcagggcaagggtgtaggtgagatatctcaatgaagggagttctmcaaagaacccttgaaaaacttgtacatacctattaggacctgattcatcttaggataataccaatgcagtaataatttctctatccttatttatcttccctacctctgtccctggaaggtcagaaatcacagttagcactctaagtgaaaacaagtaggaaaacaaataaaagccagtcatgcatctttctcaactacaggcttcttacctcgtgtaagcccttagtagaagtaggagagaagatttaactacaaatgcgctttgatgtttcgccttgttggttttaatttagacagaaccatatgaaagtattgctgtttgatcttttttttcccaacctacaaatacagcaatttcatttggtacagcctaaattaaaatatataactttttaaattaacagacattttaaaactaagaataaaaaaaagtcataagatatttatctttccatctagggatagcaaaatacttcactttaaataaattttgaaggactggtgggccacaaataaaggttatattctaattacacctcctgtatttttgtttgctgtattgattagttacacatttggtacaatagatatagattgaatatgattcctattctctgcagtcatagatttgtcatttagtaattgcaagcaataaaaggcagagtcaaagatatggaatatttcccaaagtaactgttacctccaaaaaacaaaaataaaaaaaaagaaaaggaaagggggaaggaaggaaggaaggaaacttacattaagttttccatgtgacaatttagtatacattagggaaatacaacacaacgatggaaacattcactctaaagagttactcaaaatccattctatgtttctgtgtggcccaattaagacttttgcaagcatagtcaaggaatttttgtcaaccaattttttacccaagacagagtaaaggctataaaattgccttttaaaaatcacctataaaaacaaacctgaaacactctgagcttgccattaaagatatgatggtgtaaacattatggaggtcttattgatcctcaatacctaaacataacattgcttttaataataaatgaagataatataaatatgtcaaataagtgtgcattaccctaaataaaaccagtaaattgtgaggcttgatataaaagtgaaatatactaacggaacaatgtctagattgttcacatcaaaagtgtagcatagcattaaaccaagcaaaatgaaacagagaaattaattaaattttaggaatattatttatctttctttttactgctgattttatggccatttccctagaagccttaaatctggggcctgattcattgtttgtaggtctgaaaagaagcctgagggagacatgcagccatacctttgtcagtctgcttacagtttccgaatgtggggtagggaatggggtgaatcttctctctcactagcctctagtctccattctcccacccctccagccatcaggcactagaataatcattccgaagtgagttcagaacatttccctaataacaaacaaaaaagaaacaaataactcttcttgttgcctgctaaataatatccaagctctctagtggactaactggcatctgaccacctggcccagccatttctcatgcatcctgcttccccttacacccgyctcagtcaattttttttttttttttttgtgggtggaggagatggagttttgctccgatctcagctcactgcaacctccgcctcccgggttcaagctattctcctgcctcaggctcccgagtagcttacccttcagccattcctgggcccttgccttccttgttcawgaagtgctgtgctcttgttacttgcttttcctgtgattccctgctccatctcaagcgctgtattctaggagaatttcaaatgtcactttctctgtaattttctatgattatcctacccactgttcttgagaaaaatgccttcctctccyatgttcccatagcagctgcaaccgtgagagcacatttccttactgctcttatcactcagtagcattgctctttgttttttgggtctgtctcttctagtagactgaattacatgacgacagaattgtgccttagtcttttcatttatggaagatagtctagggttttatgtttcctagcacatgacatgagccatttatgttgaaaaaatgggagtttttgaattttcaccttctcatgtataaaatcgttgtttttagtgacctctttcccttactttgcttcataaagtcatattgatccactgagctggaaggtacttgcttgtgggggattcccctggacaaccctttacattgtatttcagtcttttctttgcaggtgtttacccacctagccctattcccctcagccctaatttctcctatagcccttgcccttctccacaaacacagtgaattaactttgttttaacctctcctatctttgcatttttgagcctacgtcactttcattgtagcatcttccatgaagcaagagtccagataaagataccctttttctagaacctgtatctattatgtatcaactttattatgtttctgaacacttgtttccttaggaaataatcatctacctgtaaatcagtcccatttatatccctctttataatgacaaaatgttaaacctagcctctgctaacatagcttcagaatggtttgtgctaacagttaactgggattgtatcmtgtattatcactacatttatatcctgacttagtcacactggaagcatgttgtagggtagggctttgtaccatagtttgataaaaggaaatatacattggccagacataaagcctgagctcttttcatattaggcaattgtgcatcttacaggaacacacaaaaacacctcattgtttcaccttgtcattacttctgtaaaggaacaattgacttggtaatattagttattgaatgaaagcccagaaacttagcttatgctgggcattaaaatttgggtgctggtgtaaccctgacttaacaagatagatatagaagataataatataattattaattaatagataactccattccttcataactctttgactaaatatacttatcctagttgagtttctgttgctataacaaaatacccaagactagacaatttgaaaaaaaaaaaaggtggattatttagctcatgattctggaggctgggagggccaagatagggtggctgcagctgttcagcttctggtgagggccttgcgcttgggtcataacatggtggagaaacaggaatggaagcagccacgtgcaaaaagaccaaacacaagaggcagcctcgctttgtaacaacctgttctcttgtagtaactaatccagccccacaagagtgagaactcactcctgtgataaagtccctcttgactcctctttttgcctcttaaaggcaccacctcccaacaccactccattggagaccaagcatcaacatgagttttggtgtctcggtggggacaaaccatattcaagctgtagcagaaattcatagctactttagatacttctttttcttaaacactcttatcatttaagatagttgttaaaatcttaaacatgactttcagtttcataagagactaatccaaaaggccctcctttcagtgttttctgatagtgtccttcctttcatgttcacacactcacttttctccctctttcttctctgcacccaaaagaaatgaagtcattggataattaatttgctttaattgagcagatatttataaagtgtctggacgatcaagtattatgctaggtgtcaagagcaataaaaaaaatcactgaaatgttgttcctgattctaaaatcttccaatttagaaatgaggtaaaataatatattgggacagctacaatgcatgatggtatgtcataaatataatgaaggtgaatttaaaacacagaacaattagttgatcttgacaagtaagtaagtcttactgttgtagaacattgtttcccagtctgaggtgttgaatatgatcctcacaaaaaaatattactttaaataagaataaaatataccaggtcttccaattagtaatccacaatgcatgtttttaaagactctgagaaaactttcaaaagaatttgcttataagtctaaatagaacaagtagggataggagtaagagaaaaccttactcttttgcaccatttgcaatttgtgacagttttcatagtgataggagaaaggtagagatggggaggagtctgccgtaaagatatatatttaactttattttactcattgttttccaagattatttgaccatagaattcttttttaaatcaaacttagtaacatacaaagggatgctagtattcccaaaaaaaaaaaagtgagtggatatttgtgtgggggcttaccagaaaatatgattgtaaatctcatatttaagtggaatgttctaataagtgttacaaacctcttgttcatgtaacaaaattcatagccaattgtgtacctgatgtatgccatagcctgaatcagcctttaggtctctttggccttggattgtaattatctacccatctatttattttgttctacttaatcaagaggtttaaaccacatctccccaggaggtaaatgtatcctttccagttgtctctgaaaaggaattttccttctgcatgtgactccttatcccccgtgatattataagaaactgttctttctatattcatctactcttttactgataccacaaactgctctttacaatctctgggaaagaatgtccacatttaacccggttgcacctttttagctgtcatccctgcatacccatttctattcatcaaaatgcctaggatatttccacctccatgatttgttgtcatcagctctctatccaacttccaccatctgacttttgtatcatcccaacgtaattggctacttcaagtcaaatattaggattactggttttttttttcctttttcctctcaatttctaggatgacttaaactcctttaattatcatctttgacatattttccaggctgagggccactttgtttccttccatagtactttcataatctcttggctatttttgagctggctttcagattcaggaagctgaatcctccttcctccttgaggattttcacgtgggagagaataaatatgcttgtgattttctctcctcttgcttcctcacgatgttcatcacttggctcactttttaacttgctatttaattctcatactttatttgattctgctacatacatttacattatgcttgttttattagccttaaattataagctaaggtgaaatgggaactatctctgttgaattgaatctcaccaatattcagcacaacattacatttgtttgttttgtgatttgaccctttgtctgtaatgaaaattaacactaggttagtgccaaagtaattgcggttttgccattatttttaataaatggtacccttttctggggaagactcacagcacaccttactctttctggttcctaagaaaacaagcaccccggtatcagccagggaactacattgaatgtcatttccctgagacttgagtttttccactgctccctcttcacatttcccagacttcgttgtatctctctttttctgcttatcattatttccctgctatctcggttttccatttgcttatgcgaaatgttacagtcatctagtaagaatgtcttagggtcagctgtgagcaaagcaaaacagcagtgaaggataagagaatatcaaaagccatgacatagtccatactctttacccctgcctgtccctctaaagttaggatgtacttgggaagatatagtgtgcactcaaacagttgagaagaatgyaatactcacagacaagtttgtttcagagttccaagaaggggaagctcaatatgggctatcctggcaacaaggtaagaaaagttttgcagagagagtggaactggaattaaatcttacaagattagcttagtaggagggacaaagaagtgcatttggtaggagtggagttcatattggggagtcctgaagatgggggtgaatggagaatttagcattggaatattragggactgaaggtcaagaggagaaaactggattttaacatatggacctagtatttcaaggagtagcttgaagttttatctatttttaaaaaattagaataaaaatctatmttttaaagtatatttcgaagtcattgatacaggcaatggagagttattggaggtttttgaacaagtatgttataggatgaaagcagagtttcaggacagttagtctgccaggaatatgtagaaggatgtgaagagagtggaaatgaagagagggagatcagcagcaaagagactgaccattgccatggtccaagttcaaagcaatgatgtctggcctgagctaaggtaatgaggtaggaggcgagacttgactctggagtcgggctccaacaccagatcaaattgaggactagataaaacagggatgaggcagaagatgccttccataaacacgcccaccagggtgccatgttagtttaccattgacatggcaacaaccaggagttactgtcccattccatggcaatgacccaaggactcaaaagttattactccttccctagaaagttctgcatacaccacctcttaatgtacatgtgattaaagttaagtatgaatataactgcaaaactgccctgagcttctcctctctgcctgtgaggtagtcctgcctggcaggagcagtcacggagcygtaaggccaccagagctgtaacgctgcagcttcaaaataaagctgttttcttccacctctggcttgcccttgaattctttcctgagcaaagccaagaacccttgtgggctgagacccattttggggctcacctgtcctgcatgagtaggaatgcagggacacagttgacagctgccttagatccagctcccagaagcaaaccctgagaggacgattcacatgatagtgatwtatttgtgaggaagcatttccaacagaaagcagatgaattggggaagcaaaacaaggtatcaacagaggacaaaggaaagtgtaatttcaagtggaatccaggcctcagcttgatatggaaggggagtttctacttgagtcaaggggctgatttctcattccctgcactcaccattgcctgtggatcagggtgatggggagctgaggaggacgggggactcccagacactcctggttttttcagtctttggggtaaagcagtctagtagctcaagtgcagtcatctgaagagagtctcaggtagagttgttagaagcaaagtatccagagcagataagggaataggcagttataactcatcttatattttaagatttacaaagaataagcttttagaagccaggcacatattggaggtggatagatggatgatagagatgtaaaatttaaagcactgatttctgacttaccaacattttgagttttttactattcctagtgtgaagataatttttccggacaatccaatggttcatagtaggttctttaagatatgtaaagtgtgttgtaaatgtaaagtattaacacacatgtggcaaaaagcagtcttgttaagttggcatctcttcagctcctctcatgtgagctcatccccacatgtaagtgagataaccctttttcccaaggagttggcagtttacgacaattagattaaaaccaataaatgagaacaacgtggactcattagtaaaaaatagttgtagtgtttgacagcgctcaaatatgcaacctcctttgagattcatggtcattcctttaaaaggagaccaggttacaatttgtgtgacttgtgtctagcagcattcaaagccacagaagcatatagagaggaggagataattggatttaacccgagttggaagttagccaagtgagtcattggagggaaaaaaaggttaaatgagttaaatgtttgcaaataaatgattatagtcattggaccatggaatctagtctaagtaccaaaaaaaaaaaaaaaaatggcagtattaatgaattagttggaggtcttgatatggtcagggaattagtgaaatgagccaaagttaatgttcaaaaagaaggacatttgaaattgggattgacctgctgacaaggtcttccaaatgacaaggtcaaggataagaccttgggagaagatggctagaggaaagattactgatgctggggaggtcaaagaaatgagagactagggtattccacagattatcagtggatactagattaatagattattaagtagatgccaaaattttcaagaaaaacaacaggagtaggagggaaaattttcaaagttctttagcctcttaatcaaataaaaacaaaggggaagaaaaacaaagcaaactgtaagatgtccttaattgatgagcaattaacttccacaacagtrtttgttcactttgatacctagaattagccataatgattatccaagtaacaaaaccattttgcttttatttacactgaacatttatatacccaaagacatgygtatccatggatatgtcccttaataattattcagtgtttccaaggattactaatcaaaaactttagggtcattgaagaaaagaattttaaatttatgcagagggtaataaaaatgttcctcacattttattataaataaagaaaatatcctgaattgcagtcatagatgtgtctttatccactttattatttttgtgtaattagttggctgtatcctatcttgttcccaaagggtcttytggtcayctttattccaaatatagtagctctctcagaataggtggtaaaggatattgggtgaaagataaactcacagaacaaggctaacctggacatgaattgagcagagtgcatgttcattcagctgatgatgtaacctcatcttacaattacatatattcyctagttatttcttatttatcttatacctaactaagcaactttaggagagaattcatatgttctattattttttacaaaatatgatatatgtatttatgtgtttgtttcatcatatactctaacatatctcagttaactagctagttaagcaaattcattgagtagccatgaartggcagtggcactcagcagaagctagcaggttgaggtgactaaagaatggaggattttagatagatgcctttttastgagaggaaatagggtgattgaaagagcccttggrtaagggatacacatcttagactagaccccccttccaccacttcactatagggattgggtgttttcaactcagtttcctcacttatgaaacattatcatgtttctgttattataatttaaataattagagaagaaagttttaaaaagaccattaaatatatatcatagtattcttatttaagcataaggacataattgctccaacataaccagtgtactctagagggtaactcaaagatgataaaaattgctttaaatttgggcttctcttatttgtttctaaaaacacaccagaatatgcttttagtttccaaaaagacttagtgtgaaaatgtacatataaacagacatgaaattaagactaaagctttctgacatcagtgatttcagcagaggagcctggaaaccagttactgagccttcatgctacttaagaataaggttagactaagaaataggatttgctctaaagcaagtaacagaggcaacttcaccaacaggcaaagtaggcaattgccttggaaagaaggcaggcttgttgcaaattacctcccttacccaagtaatgaatcacctggaattcctgaattaaagagacattcctttgggcaaataattttctgagtctggattttgagataggatggttaaacaaaaagtcatcttcagtcacaatttttaatgcagattagtttattggttcacatcaacctttaaagggagatgtggaaaaagtgtaggagagatagccattactggggccaggaggcaggtgggaagaggaagaatatggagcaagggaaatcaaatctgggggcactttccctcctgtatttcactgcatgaaggctctgcagttagctgcctgcgttatccaatctgtggactaaagggaatgaaaggaggaaggcagtaggaaaggaagacaaaacaaggaaasaaggtggagttgggaagggctgatttgggagaaatgaggctgcagcaaggttagacaaagctcactgctcaagtgtgtaaccctgcaggctacataacctgattattcctccagcttcatggtgccctcttctttcctcacagccctggccatggctcactgcctttctttccattcttagggtagatctatctctttcccatcctggtcttcttcacatacacagtttcccctgtatggacgctctgcccttctagcactcactcttgaagtctcagcttctgagaagccttccctggacccccattttcagtctggcctctagattatattggctgattagggattttcccatacagtcctttccacagtttgcaattgttcatgtatttgaatgwtcacgtgtttaatctctctctccttctagctttagagaagctccatgaaggcagagaccatatcagtgtgtttcatattctacccaccaaggcctaccagagttactctgtaaaatctgttgaattagataaaccaatcgtttgagaagtttagtaacagcatgtttgcttttgttctttggactacgaacagtcacagaatggctatgcttattactgtcaaaatagaagcatttgtgtactgataggtttgcaaactcatctgaaatgtattatatctgattcacatggttaacctgaagaaatctgaacaggaaatttggattgacgtataactcacagtggcttggtatttcaggttggaattgtacagtatggagaaaacgtgacccatgarttcaacctcaataagtattcttccaccgaagaggtacttgttgcagcaaagaaaatagtccagagaggtggccgccagactatgacagctcttggaatagacacagcaaggtatatggataaaaaaataaactaaagtaaaagactgcaaaaataactgctcatgatttagccttttggcatatcaattgaaagtttaatatgacaatatttaaagccattttgtttaaaatgagattcagaagattaaataatggttacaagatcagatgtttgtatgacacaatctcaccatccttcttatccttctcttrttacaagggtttaattgatagagaatccattttaaaatatcactgcatctatattttcatgttcttgggtactaagacaatattagttaatatttgtttcatttattttttgttttcaacttctaagagtctcaatctaaaagaacggattaaaaataggtctacctctactcaatatatatttatattctagaatgtccatgtattttcagtacttgatttaccgttatcgaagctactagrtaagaggtgttaaggcgccaaattaaatattgtctatttraaatcatttttagtgcaaagtttgaaagaaatggaaaggatattatcatttgtaatcctctctccttttttactttctttagattccctccaatttacaacccttcctttcttccatctgcagttttccttatggtgaacacataactcagtctgtggttgaatttcattttataagaacgaacrgaattgtcctctcttacaaatgtagaacactttatttcctgtgtgttctcttatctcattcattaaactagcaaacttctgaacaaattcaaaacaatacaaaaatcacaggaaatgtaataagtagtttgattaatgttaagaatccttctgttaaatgtcttcaacttctgaactcttgccttaggtggaaagctaattacccatgctctcacttcatctgcctgctaagatgactgttttaagaaggttaaaaaagttaataatgatcctgcaaagaatggattggatattcaaaattttataatttcatgtacagcttttgcctcatgaatattagaaaatcatctggctctagttatatggggcccaagagaaaataaccacaaacagatggaggtaattggacatttacctacctattggatcacctattggatcaccaayttgtatacacaaagagtgcacatgtttaggtgtaccraatgcacccccattcaataatcaattaaatgtgactgcacattcgaagtaagtcaaagtgttctttgaaacctctgagcctgtagggagctgtacgttttccaaaggcaaycatttaagaatgaatattcatctctgaaaacwaactgaagaaatattctggctgcttttgcttctgcataaatacggctctaaataccatgtccctatgtgttttttgcctctgtgtttcacaaagggtatagctgtgggacacagagtttattgaattttgattatacattaaaattmtgtagtgatagtaccaagtatttttctcctacattaattaccttttcatgtttaagcacattttaattgttttttattcctttcaggcagaagttgcaaacaatatttttaatatttttagaattctttaccttcattttcagtaaatcccagttcaaakttttgtgtgtgtgtgttcycttcttcctatcccaaatttttacttttgtcaataaacttacagtatttaatcatgaggcctggattctcctgtcttgaagaaagggacactcttgatatattttaattttttaaagcatgcaggaaagtcaatgcttagtgccaagaaaggacactggatactggtactttgaggacaatgacaattttttaaggaatgtagttgaaacaggaaaggtgtactcaggagttctgtcaatgtctaatcttccaatattacataaagccagccctgagtttagaacagtcacattttatttatgaaaggccttytaatcatctccttcagctgatgttcattcaattcwtttgtaaccctgatatttaagagaattaggaagttttagtgayctaaggaatttgaatttcaaaagtgattgaatctcatatgatattcgcatacaaagatctgttaaagactaacatgtaacrtctgttttcacctttgtttgtatactttaaaaagtcagaaaatcggctgggtgcagtggctyrtgcctgtaatcccagcactttgggagtctgaggcggctggatcacctgaggtcaggagttcgagagcagcctggccaacatggtgaaaccccatctctactaaaaatacaaaaaaaattagccgggcgtggtggtgggcgcctgtaatcccagctactcaggaggctgaggcaggagaagcgcctgaacccaggaggcggaggttgcagtgagccaagatcgtgccactgcacttcagcctgggcaacaagagcaaaactctgccytaaaaaaaaaaaaaaagccagaaaatctacttgtatagtatgttaaaaattattcatgatatttgttaaagattgtaaggaagacatcactcaagaggaacctttatgatgaaggtattgcagtaaggaagagagatagggctcagctttgactacagtgaggacaagtgggcatttatagtcaaggaacagggcagggattggcagtaacatcaaggctagggggattcttgctagactggctcaacaggattcttgctgaaggcagataaatagtaggaaaaataaactgtttttctctttctatattctaaacacttgacatgtcacttctgatgccagatgtgtgggatttttcccacatcgaccagttatctgacatcagctgcatgttctagaattcaattcagttctgacaccaactagagtttatgcaaacctcccacagattaasggctcagtccttcaagaattcattccaatttagagccagtaggtttccaggtacccacgatttgtccaacgtggctacaaattagaccccttacttgggtttgattatatgctagagtggatcacagaactcagtaaagtatcttacttactattattagtttattataaaaggatacaactcaggaacagcaagagatatgtagtgcaagctatgagggaaaggtgtcagagctgccattccctctcatggtgtacctccttccacctgttcagcaacctggaaactttctgaaccccgtagttcagaaagttttacagaggcttgatcacaggcatgattgattattaactgattctctagcccctcaatctttcctggagaatgagagctggggctgaacgtttcaagcttctgatcatggcctggtccttctagtgatcagctcccatttaggagcccaccaagagttacttcattagaacaaaagatactcctatcacctaggaaattcaacagattagaatatctatgtcagaaacccaggttaaagaccatatattagaacaaaagatacacctctcaccagtattgctcaggaagttatgagagttttaggagttctgcaccagaaaccagaggcagagaccaaatatatatttattatttgttaaaggaaaattttagacaaattaaatttgacagagtttatttgagcaaagaatgattcatgaatcaggcagcagtcagaaccataagaagttcggaaagatccattttagcagtgtgagcaatgggcttttacgagctgaatgcaaaatcaaattaaagaaatgacttgattggctatagctaggcatttaccttatttgggtatgatctggtggaaagttagaggttacttgccaggttctgattggtaaagtctctagttagaagttagttgcagtttctaattggtaatgtttaagttttgttttactgtttacattgaattggactttggtttgattatataggaacatacggcactggagctgtctcagcctaattgcctataaattcaattcttttaaaagataatatcatggaacagcgtaatmagatttagagggtggggaatgaggaatgtgatcagataccaaggatgagggatttccactaaattgattaagccagattcttgcttaaactggactaagtgggtaaagaacacagcccagggtcagagcccagtctagaagaagatgtaaaggagcctgactcggttttggtcaaggagagggtctttgtcaagtatagagggcagagagactcaaagaaagtaaaaaattagtacaactatatcctgtatatccaccactcagaactgacagttgtcaacatcttgtcatatttgctttaagtccttcgaaaggaaaagtcatcayatagaatccttttccccatttcaccagaatcctctcttcctgcttaaagatatcagttatggtatatttagtgtgtatctgttgtgcaaactctttggaatgttagcttaagacaggcgtttccttggcaaatctatcccaaatggcagctgtttgtctgtacaaccaaatatctaaatggaccattcagtacaatgattgctgtactttgtaccaaaatcctagaaatatatgaagtcttttcattactttagtcctaaataaaatatactcatctcttccaagactccagagcgaaaaggtttgagtaaaaggaaataaagggggaggggagaagtgtgtgtatatatttatatagaatacatacaaaacaaaaattttccatttccctgtcttctgtttctttccataagtgctgttcaattaaattsaaattcggttttttgttttgttttgtttttgagacgggaaggtgtctcgctctgtcgcccaggctggaatgcagtggcgcgatcttggctcactgcaagctccgcctcccgggttcacgccattctcctgcctcagcctccagagtagctgggactacaggcgcccgccaccgcacccggctaattttttgtattttagtagagacggggtttcaccttcttagccaggatagtctcgatctcttgacctcgtgatctgcccgcctcggcctccctgaaattcagggtttttttgcagttaggttatagcattttcccctcctctccattgccatcttctcccatcctgctctcagcagcctgtgtgctaacacatagttcaggccaaatgttttgtaactccttcaaccactttttgctccctaaaacccaactgactactccatggactcagagcatcaccatctgcagtctattactcccatgtgaaagactgcagatgtccctatccccaggacactctcaagcactcacagccccactaatactctgttctctctcatctctcctccccagattagaggattttcgagccattctacaaatgtcagagtagctgtgggggaagcaaaatctcaagcaaaagtttctgctagacgcagaagaaaagaggcctgttaaatgagagaaggggtgtttacagagaaaggagcacctgggggagtgtttacagatctggccttctctgaccatgatgtatgcctcagtcacaccctccctttgaaatttccaaagaatgaaatactgctgcctttttatatataggatgtgtggtgattagcaaaacggagacctctccatcatctgaaataaatctaaaactattacaaacaaggctcattatgcctcccaacttgaatgatgggcattgatgctaattttggagggaagcaccaggctacctagagtagtcagtgtttttgtttagttttttactttgtctattgtaaagtggtgtcttatcaacctctcttttgtttgtgattactttagaaaggaggcattcacggaagcccggggtgcccgaagaggagttaaaaaagtcatggttattgtgacagatggagagtctcatgacaatcatcgactgaagaaggtcatccaagactgtgaagatgaaaacattcaacggttttccatagctgtaagtgtgttgccggagatattttcaaactcttaggtgtagagaagagctgtgtgcatattgggtaattttatgaaagtcacacaaaccaggttggaaaagagaaaggtctccatttgaaggtaagccctgggaggacagacttggatcttgctccctctgggtccttagtacccagcacaatgccaggccaaacagacactcaacaaacaatcattgaaaggaaggaaggaaggaagaaaataaggaaacatgaaaagaggaagaaggaagsaaaaacataagaaggaaggaagggtgagaaaaagaggactgaaaaaaagaagaggaaaagaagaggaggaaaggaagggaagagggtgggaaggcgggaaaaatgcctttgcctttaaataagagagaggatttgttcagtataacaagagcagtggccattgggcttcccttccccgtctgagcaattttcgactmtctttttcattaattatcttcccccatcacttagctaaagtgggggaaagtgccagttgtctctgtttaaatattaacaacttctgacgtttgacacttgcttttcagcgaagtagacaggaattgaatttttgttttctgatgcaatttataagctcctggtatagacctttcgacctaaaatgtagacattctagtggggaacaagttctgaaataaaaagttacccaaatggtatgccaattacttcagagctagctctagttttaacagtgtgcttcttcaaarcagcttgmagttcttctcagacattagtgcattactcctgtaacctcattattcctrtagcttcatggaacagcaggtgagggagctgagaaagaggcaagggcacccagtgacttgggtggtcccagaggacaggggcaaagtggcttaaagtcctctgatgagacgtgtggtatttcctctgggatggtcactgatactccccagggaaaaggatgagggcyttactgaagcaaaagaaaagaattgagaataaatctgccactgccttctctctagtaaggaacattcaaaagccactgcactgccttcaagactcactttctcacattaacattgagtgtacrttatagtatttcagttgytgctctaaactactatccatttttttttttaaatggagtctcgctctgtcacccaggctggagtgaagtggcacgatctcggctcactgcaacctccaacctcccaggatcaagcaattctcctgcctcagcctcccaagtagctgggaccacaggcgcacaccaccacacttggctaatttttwtatttttagtagagatggggtttcaccatgttggtcgggccggtcttgaactactgacctcaggggatccacctgccttgacctcccaaagtgctgggattacaggcgtgagccaccgtgcccagcccactatscatttaatgatacaaataaacaagtctttcgtagattataaacagcagcactttaaacagtaattttagttcttttctaactttctataagtgaaaaatctgtatccttcttaatcaaactatcagttttttaatctaccattctaaatctaactttaaaaaactacatgtagatgtgcagtgggggtgagctactcagatgggtagggggagcctcagacctggaggaaaggggtgggggcagccctcaagcccattgcccttgtgcccactatcctcccaggccacagtgcagaaccatggtcggaagggtgcttgaggtctgttttgtaacaggactttgaaggcagcaccatggagctcttcgtttttaatgatgccagacaaggctattattggaaaaagaaatgtgaagccaaaaaattcctgtaccttcatggtcactggaggccaagactctccttcttcttagaggatttggatattcttaaaaaaaaaaatcaagcaatagcaaagggctcagtgtctttcctttattttttggattccaggagcatagccttgaattaatccgatccttgcttcgttcaggccaaattgtaatcatttgttgaaacaaactttatttgtttctctgtttagaactatatctgtgtatttattttaataatattataagcatccatggacctaccacccaaattgagagctagctctcttttttggtaactacatctgagcacatttaccacctgccttcctccacctgggtaaccatcagtccactttctacattcctcaaccctggctctacttttcaaaataatatttaggcacccatacatatccaaaaaaataaattttaagaatatttcattgtttttaacattttaaaaagagtgtaatgctgtatataatattttggaacttttaaaacttaatactatattaagattcatccataatgttgcatatctgtatagttcattctgtttttaaaaattgaagtgatatttacaatacagtgaaatgcaaggtttcagtgtgaaaagtgtgcacgaagtgaacaatttggtgagttttgacaattacgtgcacccacataagacttaatcaagatatagagcaatttcatcactcccagaaagtttcctgtgctttcttttttaaaatgtatctttaatttttatggatacacgatagctgtacatatttacctggtacatgtgatattttgatacaggcatacagtggctaatgatcaaatctgggcaattggaatatccatcacctcagacacttatcatttctttgtgttgggaatattccaagtcttctcctgtagctattttgaaatatacaatatgtttactgtagttgtcctatagtgctactgaacactagctcttattccttccatctaattatagttttaaatccattaactaacccctcttcatccctgctcttccccactactctttccagcctttgataaccaccattctattcagtaygtctatgagatccacattttcagctcmcacatttgagtgagaacgtagtgatatttgtccttyagtgcttggcttatttcatttaatataatgttcttcagttccatccatgttgctgsaaatgacaaagttttgttctttttaatggataaataatattctgttgtgaagatataccatgtttttttaaatccattcatccattgatccatacttaaggttaattctatatcttgtctattgtaaacagtgctgcaataaacaggggagtgcagatatttmttcaatatactatttcctttctttgggatatatacccagcaatgttttttttttcttttttttttttcattttaaatacacacctcctgtagtaaccactgatgtgacataccaccatagctcacttagatwgccaattcttgaatttcaaataaataaaactgtatagtatgtactgtgtgtttagcttttcactcaacataattattgcttgtgatattttgtgtactggggattcattttttgttattgttatctattttatagaccacaatttgtactctactgtttatagacattttgcttgtgtccagtttgagttattgttataaatgtatcatgaacactaaaaaaaaaaaawaaaaaaaaccaaagtgataatcttcaggtaacacttgcaactatggtaaaaactaatttttttatttattacagaagtgattttttattataaagttttaaaaaaaatattgaagcaaatataaggaaacacctagtgtcctaatatacagaaatamaaaataatatattatgatacacattttttcacattttttatgcccatgtacttatgtgatttaaaaaatagaattaggtcatatctacatattggggatttttaattttttttgcatgttaaattttacatattgttttaaaaatgttttcattatcttgaacatttttatattaaaaacagttttaacataaaaaatttttacattaaaaactaatttttttaggcagaaaaagtacaaacctyaacaaagctaattagttggacttcatcaaaatgtaaaacttctactcttcagatgacactgttgagaatatgaaaagacaatctacagacgggaagaaaacatctgcaaaacacataaaggacttgcatccagactatatacagaactcttacaacacatttaagggaaaataaacatctcgttttcttttaatgggaaaaagatttgaacagacactaactacactgaggaagaaatactatagcaaataattgtatgaaagagtctcaacatcattagtcattagagaaatgcaaattaaataagacaccactatacgctaacacaattgctaaaactaacaagtgaacaaaaaaaactgacaataacaagtattgacacgcatgcaaagcagctggatctcttagacatttctgatgggaatagtaaaatggcaaaatgggacgattactgtggaaagcagtttggcagtttcttaaaaagttaatcattcacttattgtatgacccagcactttcatttctagttatttactcaagagaaaagaaaatatatgtctattacagagacctacatgtgaatatttrcagcagcattattcataatatgttgaagctgcaaacaactcaaatgttctcattaagtaaattgtggtgcatccatacaatggaatgctactctgcaatagaaaggacccaactactgctacatgcagcaacacggatgactctgaaaagcattgtacaaagtcacagaagccagacacaaatggctacatactatatgattccttaaatctgacattctggaaaaatcaaagctataaggacagattatttatcggtggttgccagggttgaacgaggggaggaagggattgactataggggcaggagggaactttttggggtgatgtaaatattctacaccttgatgtggcagtaacacaactatattggtttgtcacactcatagaattgtacatctaaacagggtgaattttactgtatataatttattgcaataaaccttaccttaaaaaaaaactaaatgtttgagaaaacctgcttggacatctaaataattatagttaacaatcatatataactcctgcttctctctcctcttcataaaaaagaatgcccctgtctccagcatttggtttcaaacaagaatatctcaattgtttattttcyagattgccaatttagattaccacttagtccagtatgtgtttaaaatatatrtgtgctggactgtgccttggtaatagtttcaggaagaattgctcattcaaaagcaggcaactcacttgctgattgcctttgccagcagataatgacatcactagctggaataatatcaaagacattcagaaactatgaatataacattacttttgaactgtcagattttaaaaatacagctgttagtaacagggacacagagtacaagaggagaaattttcacagacatacaaaattgccctttatatttttctacaccaattgtggtgtttatataacagttaatattagggagtctacaaattttgaaaatcactcttccataaatatgaaagtacataaaaattccattatgctaaggtactctacactgttgtttactgacaaaatgcttgagatcctttatttaacacatagaatttaaaatatattcttgctgtttctgttgtgtcttagattcttggcagctataaccgaggaaatttaagcactgaaaaatttgtggaggaaataaaatcaattgcaagtgaacccactgaaaagcatttcttcaatgtctctgatgaattggctctagtcaccattgttaaaactctgggagaaagaatatttgccctggaaggtatgtctatttatcttattgctgcatgttctctctgcaattcaaaatcagtataatgggatttttgtatttattcctaatacatcagtaatactttttttttttttttactgtgtacaatatctagcatggaacaatgctcttttatataaatctgccattaagatggctgtttctcacaacactgtgtctgctagagactctctttgtaagggcatggtagggcagtgctgatgggacagccgatgaagacaatggtcaatgtagatgtgccaggacaaaaatgtttccatgtgctttgttccttttctgttacatagatttggaaaatgagggtactacctctggtttgggttttttttgtttgtttgtttcttcatttcatattgagctactacaagagtgctcttatgcaataacttctttgttcacttattttctctgtattttgctccttgcccattttaaaggtcttcatggaaatttgccttaaaatccatggcaatgaaacattggttcactgtatttgtctaaatcatgttacttctttgcagatttttccttgagttttcaatggtgactggctgttgaggataacgagttatggcattccctattctgccttaggtagaggatgtcaagtagctaattactttggaactcgatctttcctaaaaaacaaaaaaaaaaagtcttcagaattgttatgccaggcaaactggcaaagcttctttcttcacattctttgatgatctctagtctcagggaacatgcgccttttctccaactagggagagaaaccaccagagaattcttttccccttaggctacatccaaatccagttgaccctgtccttgtgaggacacactgaaagactgttgtttctacatcttaacaatagaaatttaaaagcactttctcagtttccctgatttgattgataataggaaacagaaagacaaaatgggaatgagacacaactgaaaaaaagtagaccattttgattgagcgtcaaggggctgggaaaatgcagaaaaattagaatatgaaaatgtacagaaaggaaagataattatttagagttatggctttcaaactttttttgagtgtgactcacgataataactacattttgctttttgacccagtgcacataaatatatacatataaaaataaggcaaagtttcacaagataattcttattacatgtgatgcactgtgatggtttctcatcaattccattctaccctaatctctttcaatgaaaaaaaaatgctggctatactcagtctgttgatttcatgactgggtcacaatccgtacttagaacatttgatttagaggtgataggaatctacaggccagccagactgaatttctgtgcctcccttttcccctggcctctttcccctgtgcctttagaaacagaacactctaattgtttatgagtctggagtcccagctgcttctgaagaactcagctgtcttgtgctctgtgtacaagtcatttttaagtggctttggtctctcaacagctctcccggtgtcatttaccaataaaccagattatgagcttggctggccttaaggaaaatacataaggtcttccaactaattgtgtacttttaatttttaataacatgggctaagatatgatagaaacaatctgtaaaaataatttaaaagaaaagttacatagttacatttgatagttcaacagaatacagtgtcatttctaaatctccttttaagtaagcaagtaacctaaaactggcaaaaatgaagcccacttcagctaggggagggggagatcaattgcctgaaatgacatttcagattatttctaacctaactacaccatggattaaaggtgacaggttgaagagcccaaacactccaagaagtctctatatttaaatatgacatcattttataaggaactttacagattacaaatgtcttctatatcatctttgttgctacactacaccaaaagcagtgttttgactagactatttcttatttttttcatgagatatttaaaaaggctttatttctttgttgctcgggaaatctccatttcctgtcaacatgtatcttaagatgacaagtagctgtgattatgaaatttctgtttgccaaggacagtgccatctattgaggcaagtatgccaaggacttgcttagtacatcagaaaatagtctactgtctccatttcccgttgagcactgggagaaaatgccaacatttctaaccagaggctgcacagtggttagagtggctggcccaaacacccatgaacagtccagggagaagtttgaagcaagaagcccaggagaatatagtggtctattaccatgatgccactgcagcaggaagaacatcacatagcgtccttctgtctgttctcagctgaaggcagaatagcggcagggcaggtgctgaaaataatgcaggtttccgttgctgcattcttattgatcttgcagataagtgagaaaacacctgaaagcattgtggactgaaaatacatgtttaaattaaagttaaaatgcatctcagtcatttaaattacagggcaattcacacaagagattaaaatgatatatttgaattcttcactgccgcgtctaatctagtcctacaaaggtaattactgatgtatttgttcacaattttatccatgtaaataactaacaaatagttacattcacaaatttgattattctcttgcctcaacgaaagggcagactgactttcttaagtgctatttttaacttatctgcaaggccaaataaatcagtaacccctagtgcaagcaaataaatcaacattccatcaattccctcaggaaattgtggctttgggtttgtgaatattttgagaataatttgagagtagcagactgccatggaatgctctgaattatctctgcatttcagtaaagagcttcaaaatgggtacaggatcttttaaaaatgtatgattgaatggcatgtgggcagccctatcacaaagacccctctggatctgtgagtgatacttaccaccagtaattagagcaaataaatgcatactaaaatacctaaaccctttatcacacaatgaaattctgacagaatctatggcctgaatatgggtgggactgatggagttgagaaacctctttaaatatgtgaatgaaatttttttcagtcccataacatattaagggagtttagcctaagggctcagcagggttcccaaggcatgaatttggacaggaatttcctactgtagtacatccaacttgagccttgtggacccaaagcaccataggatccacaacatgctacagtataagaatggagatttctcaacccctctggcgaggacagggctgctaatgaacaagaatttgagacatgagccctttgactatttttctctgtcttctacccaggcctacctrgaaattttgggttgagaaatrtatggctgaaaatgccctaagatgtttgaagttctggttggtaagaccacaagctctaccaggtatctgtattctgcaagtcagtagtgcrtgaaaaggcattgttacttatttacagtgatattttcctatgttatagcyacagctgaccagtcagcagcttcatttgaaatggaaatgtctcagactggcttcagtgctcattattcacaggtatgttgaccagttggtgaaaaatgaaatayatgtttgcaagacttcccttcccaaaaccaacatctagccatcagtatgtaagtgcaacgtgcagttcatagcttgaacaattatgcaggctatgatgatgttttctaattcaaataggaaaatatcmtttcacaagcttcttattaagaaaatatgttctctcacacagttcactacattgtactaatagttgtgaatcagacagtgtgagctttgccttgtaattatgtatctgtctaaatgaaataatttaacatatttgctacagatgtggaatatttttccacagtgtcaaggaattcaagggtcttattagaattccatgttcaagacctaggatgctgggcacccagaataaagtagaaagacaagattagaaaatatatcatttgcagttaatgraagaaaaggcataatggtccttgcaaaagaatattgacatttccatgtgcaattttactgtataacttgggtaagttatttgtgccttgatttccttttctgtaaaacaggtatggtagcaatagcatctaactcatagagttatcatgaggattatataagctaacaaatgtaaagcactttgaacagtatacctatacacattgttaatggtgtttaagtatttccccttattatttttattaaatattattatcttatttatttgcatgtaaggactgggtcatgcttggagcagtaggagcctatgattggaatggaacagttgtcatgcagaaggctagtcaaatcataatccctcgaaacacaacctttaatgttgagtctaccaaaaagaatgaaccgcttgcttcttatttaggtaaggtttggatataattataaaagagttgttttacttttccattttttacctttagcattatttgcttatgtttctataggcttgcaaccatatagcaggattatttcaacragttgggtattttccagaacccatgcaaagttttaggcctctgagcagctttagttagtcaaaatgacatacatgggggtccttttttgttagtagggctgtctaatgcagggaatggtttaggttgatatgtgccctttctgatatgttcagtttctctgtgtctggtatcaactttaacttcaaggagaactttgaacctggtggacaagaaatgagagtagaaaaggaaacctcgacttctcctatatcctgaaaaccaaactcatattgtcttaaatgtcttctatcattaatttctctctatgggtcctaatttgggaaaagaaaaatgtattttgtcatgtaacttcttctttaatagctccattcacaatcagacaaatattgaacttaaacccagtgatataacatgatcttgtttcccagtgtcttgccagaaatgaggagttgtatgtctggtaccactttatttgggatctataccaagctgagcaacacctgggggatgccagggaactctcccctcactgaaaaaagatattcaccaacagttgggaggacctaaaataaaaaggaccatcaggatatggcttcccagctcttactcactcaacaaatatttgggggatcctcttttgccccaggcattgatcttagtgctgggaataaagtgataaagaaaacacataccttggcctggaarcattcacagcttcacgtgttagccttcctctctgggatctttctgtcccggagacaagtctttttctctctgtcccagttgctttctattttaycaggaaggtggcaggtctttactgcggtgtttatacatctccttattgaaggacacctattaaagctgtaggagcagcaggacttaagaagaataaaaggactagagttttagatgactaaaaatgtaacagtcaacagcagctgcactgtgactgctaaaatctcttaagacatgtagaactgcatgaatgaaagtccagtctgtttctcatagaaatcctgttacattccactctggtcagacaacagctagagtatctggttgttctaagtatcacatactacaaggagaaaatgacaaactaggatgtgccagtaaaatattacacagaaaagtcagctcccgaagcaattccctgctacaagtctcactctctcgaaaacttaaagaaattgaaggttagaaaacaaagtgtgcattgcatgtattttaggtatttggaggattgtgatataaaatataggggttaggcttaaaattcatttcaaattttagcattaaaagagatcctatggagcatgtagtcttaatttccaatcaagaaactgagagatagaacaattatgtcccagctgcctatggcaggtgtgaaaccacaattgaggcttcttgattcttatgtcagtgtttatatcacgataccaaaataactgattctgggttgattaagaaagcactgcacaaatattgagtaccagcaatgtgccaaacactgagtttatagggaataaaaagatagatggggcaggtcagttcctacactgataaaccttacttttttgggtgagagacaataatgaaacaagcaatcactatcagtatgatatgtgctatgacacagaatacctaaaaaagagggctggggattagattagatatcttctaaaagttcattacatcctaaggttctatgagactgtttatgtgaaataccttggaatcaagaaccagcttaacctgaggcttctgttatatgtagaataaatatagaacatttatcttcctatataatggatgacatataaattagtaaaactccttatgaaaggcatttgacaatgtgtttacagagctataaaaaatgttcgtaccacatttatacagaaatttcacttctgtggacctaacctagggaaaaaaatccaatatttaagaatgccaagtgaacaatgatttccattgtattattatttatgttattgggrgaaatgccattatcctaaatgcccgaaaatatgcaggtagttaagtaaatagtaaatccacttaatgaatattacacacccataaaaataaaaattataaagctgctgattctatgatactaaagacttgaagcagttatggtacaaggtgtacaattagcgatagcgatgaggtcatagagacttgagcttgttttctgattctgcccctggctatggctttaggcaaattactctccccctcaaagcctcaattttcctatttctaaaatggaaataattacaccatatatatcatttgggttgttagattaagtaatgactatatttagtactgtgcctgacacacagttaacactcaatgggtgttgtctattattttattatgtaaatgttattatgtatttttttattrtgtaatgttatataataaacattcctcttattagtattgtggtaggcagaataatgatccccaaagatgtccatgtcctaatccctggacccatactttgcatggcaaaagggacttttcagatatgatgaaattaaggatcccgagttggaagattatcctcagatatctggctggacctgatacaatcaagcattctaaaaatcagasaacctctcctggatgtggccagagggagacagaactatggaaaaatggtcagagagatgcagtgttgttggctttaaagatggaggggggccacaagccaaaaactgtagatggctctagagctacaaagggcaagaaaaccgattctccttgataggctcccgaaaggaacactgacctgccaatatcctgatgtttagtccaggaagctctatgccagacttctaataaacagaatggtaagataaaaagttcatgatgctttaagccaccaacttgtggtaatttgttacagcagcagtagaaaactcatacataatacaaaataataatagtagctgacattagtactattactaataagtattgagtatttacaaatttaaagacactgtgtgaagtccacaaagatgtgtatgatattgttgccactcttaggaagcccacacattttaattgataacactgtagtttttggtattcttaattatatgtgattaaattcctttaaagtaaataaactcttaagaatcctaaatttgtcattcccaaaaacctttggttaaacgttgcttaaagcagatgtggagaattcaacttaaagatgccactgcaagtaagaaaatattaagaatcttatttctgagcacagtatttataatatatgacttctctctgtccaaaaaggaaatttttgggtatgttttctacagtgtgctgagattttcttttctgtttcagaaattatttcattagcttactcacaagtgagggtatatgacattttgccaacataaagtctaatacatgtaagatttctttcaaaatagaaaagcattcagaaaaggcaggacaaataccttgtgttttttttcacccaaaataatattctaaatctgaaatgaagttttcaaaatgtttctttgtgggggtcacaaattgagaagagactgagtgtattttttcataaactgtgtggattgcaagttgtaaggctatgaaaaatcttatgaaggaagcagaggcagaggctctgttagaaaaatcccatgcttatcaataaggatcaggaaactgtaagaactcaagctgtcaaacatctgtctcaggacatagtcctaccccatctttctattacccaaactgccttatgccaatacaggcattgcaagtgaatttggtggtgaaaatacagctgggattatgttcccctgcctcctccacccacagtttgctgaattctattcctgccatacagcttccaaaggagaaggaaagatgtgaggcaatgtcatggcatcaagacagatcatacctgtttcccattacctcactagatcctggcccttttcccaagaagtgaattatgagagctgacagaattcattcttcataaatccatgcaaagggctatgccatccattttagcctttttttcctctttttttttttctctttatttgagacagagtttctctcttattgcccaggctggagtgcagtggcatgatctctgctcactgcaacctccacctcctgggttcaagtgattctcctgcctcagcctcctgagtaactgggattacaggcgcctgctaccatccccggctaattttttatatttttggtagagaccgggtttcatcatgttggccagactggtctcgaactcctgacctcaggtgatccacctgcctcggattcccaaagtgctgggattacaggcatgcaccaccgcgcccagcccttttcttccatcttattcttttctttttcaggaaacactattaagcttaaatatttataattattttccttcttttaaaattaggctttacttggctctggctctctttttcttttcttctttcttgtctttagacacccaagcctcaattagtaactacgctaactggtagttactgtccctgagattatttcagctaatatttttagttatcaagtataagtcatcaaagagagttaactaaataatctcacaactcctagcctcaaacataatttttaactcatttttaaaggaggccttttatcaagttacattcacagctctgcaaattacacacacacacacacacacacaaacacacacgtactaacactctcattctactcccttctttatatttcttagcagagtggcatgaaataaaacagccttcattttgcacattcttcttttccattttatgtatgtataaacatggcctgaaagattcattttaaaacaatattgtggttagtaatacaaacatgtaacacattacatgttcgaaaaaatattttagattctattatgtataataataaaaaaccctcaaagaaagatgaaggaatgagaatgtgaggaatattcataaaggataatatgcctgaggaatagtgttcctttagcacttgtaagaataaacatactgtataaaaacttttgttcctttttaacatttttgaaagaaagtcaaacctactttacagtaaaatacttggtaagtgagttagaaaaatgatctttttctcagtgagaagtgctattctgtggcattttgaaaaataatcttacttctgctccactgaagaaatctggttattaaaagagttattccttttataaaatcaaaatctgcatgtggcaatttttattcattgatatggctctcttctcaaaacacaaagaacaaatctaacttttcactcaaaaattaatcttaaagacacaatttatgctcttcctgtaagcagcctgagatgatctcttaaaatggtttactattcacttgacccagaacaacccaaaaaatcattcaaatcaagagattgaaatcttcgtgttcactttaagaacatccatgaagctacccaggcaatcaagggttatgtatatctgaaaagccaccaagtatctgaaagatgtgactttacagaagcagtgtgtgccgttccatcattgcaatggtggagctggtagatgtgtccaaagccaaaccgtggagctggacagagggtttatggccccaaaagagtgctgaaagtttgttgcacatgcatacaaatgtaaaaagcagtgctgatcttaaaggtttgtatgtagagtctcttgatcattgtgtacatctaggtgggcgaagcacccaagatacactggctctgtttacagggctcatggtcagattaacccatacgtgacctccacccccactatcgcacccaccgcactgaaatgatgcttactgaaatagaacaaatttttctaagccagaggaggaggttgcatagaagaaaaaggtattccagaagaaaccgaagaaacaaaaataatgacccaggaataatttcaatataaaatatatgcaaataaaatcaaaagtagaaaaaagacaatcaaaattttaaagagcatggaagctcaattaaaatagaggagagaaccgggcacaatggctcacgcctgtaatcccagcacttcgggaggctgaggcgagtgcatcaggaggtcaggagattgagaccatcctggctaacacggtgaaaccccgtcttactaaaaatacaaaaaattagccaggcgtggtggcgggcgcctgtagtcccagctactcgggaggctgaggcaggagaatggcgtgaacccgggaggcggagcttgcagtgagccgagatcgcgccactgcactccaacctggacaacagagcaagactccatctcaaaaaaaaaaaaaaaaggaggaaagatcagatacgtgaaaaatgattcaagctctgtgttgaataaagtcacattaaaatcacagaaaggtactgttgttagacaatgtttaacacctattaaaacatacacaaatttaaataatagtgatgatacacaaagcctgggacagtttcatgaaattgtctttcatatggcggttcatagaacaaagtagtacaaattttctggaaacaattttctagacactataagaaccattaaaaacgtgatccagtgatctattccttgaaatgtactgtcaaaaaatccagaagagggacaaatttaaatgctccaaggtgtctttgaaatctgaagcataataccaaaaatattaaaaccacctgaattctagtgttttatcgggaaatggccatgtaatataaatgcaatgtctttatgctttaaccaagagaaatcatcttcaattatttaaaattacaattttaaaagctagtagcagcacagaaaaggtttacattttctatgattccaattatatgaaaagtgttaatttctgtagtgcagacacatatatccaaatgaaatacaattgatttattacaaattggggtggggatgtgcaattttttatgtgtgtcatcattgttatatcatttgtgattttaaataatgaaaaactcagattgggggaaaataacttctcaggagaaagcagttgtggtagatagagagcatattaaaagcttccaccaaaacaaattcttacgtgcattgaagaaaaaatattattttcaaaatataaccatataaaaatgattatcttggccatttaaaaagagtcttaatttattacatgaagcctttaagggtccaggtggtatacctggaatctttcttttgttaggttacactgtaaactctgctactgcttcttctggagatgtgctctatattgctggacagcctcggtacaatcatacaggccaggtcattatctacaggatggaagatggaaacatcaaaattctccagaygctcagtggagaacaggtaaacttgaaaaatattcttttatttaaattaatctattcatactctatgtatatttactgtctattgtcctaaacttaaaaatgcaatacccacatattcagtaacaactgggaacagggccctgtgttaggttctttggaaggatgtatagtgtctgtatctttgtcttcatgttggatgggtgtggaggtaagatatacaatagatgtggatacagatgtacaaatatatacacaagaaaagagatccaaaacattaagaggcatgaaattaccagtggcccagacaatacagtcagaatatgatgggattgctttaagctaggattggtgcagaaaagcttattagaagatgaaattcgggctgaatctacaagggatgatagaatgtggataggtagaaagagcagtgaaagagaaagttaaaaagataacatggacccatatgatgtgaggttttgaatggcaaattaagagcttggattttatcctggaggtaatgggaaattgtctgtaatatttaaaattgaaaaattcttattaggtagtattgaatattaaaagaagtttgggaaatgatacatgaaataacatttacatatgtatatataaaaactgaaagaaacatcgtaaatatgcaaacatttacacacacacrtattaactgaaagaaagatctaacatgctttttgttgttgttatttttgaattgtgatagcttgggaacttttgtttctaaaaagttttctgtatttttcaacagttctacaaggaggatttattaactttattccacagtccttttacagagggtgggagaggggttcttcttagccttcactaaatattccaactctctagactagaggggcaggactgcatcagccctcctgctctgcaagagtccaagctgcagcccagcgcagcagtaaagctcaggtgcagggatactcacattaggcaggtccacaaactgcactcgctttaaagccccatgccctgcaggagcagtatcttttatgacaacaccatagacatagcttccagggtgtctacaaagggcaggccggctacaagagtaactgcactctgggaagtcaaaaatatgtcatcttcatcaggtacttataattcatttatagttccacacagcctgaatacaatattccagtaagaggttatttttacccctgtcagcgttgcttagccttagtggtaaagttgaaatcccagccacagcagattcccagggcaacagagttagagtagctaaaggtcagctcctcaagtatcaggtgaaagggttttattaactctttgcccacatttacgcttggaaaacgcataacagttagaawaaggctattgttgtagctcaaactggaggtaagagaacgtaaaataagatgtcagcagtaaaaatggaaaaggaagggccatgacagatatcaataataggaagttgacaatagtaaaatgaagcattttagatgaygtctttgatccattatcactccattaattgtatacaagacaagaagtgtcaaattttatgaaaatttgcatatgaaagttgaggagagtatcatgaatgatttaaatcgtgaatgatttcagtttcaagcctgggaatctgaaagaaaggtggctccatgattagaatgtcaacacctcaagcaatttagatattttttaacaatgacgtttggcttttagacatgttccttgtaacagtaagcacaaattcagatatttgaaggtgccagtaaagtaaaatcaaaataggtaaagtcaatgagtaaagctgctgggcaaaaaaacacaggaagtggtgggaaccatggccctgggcagcttgtgagcttccactgagctccagttgacggttgccatgtggggaggaaagcccagagttgcaagatcttctattttatttatgtttataattaattcaacttttaaaaaaacctctcaaggccctcaaaagcctgtgagaaaagtgcattcaaaagtcagtgtcttttgcccacatgcctagaagcaatgtctaggactgtagaactgaagccttgagaaggaagacagaatgatgtttgcaattgccttagtagaaatttttaagaaggattggtcatctagggtaagagaatggaaaaaggctacaggtctgagctttagaagaggccaaaattcagaaaatgagagttggggaagaagccagtaaatatgaaaagggtggtctatgccacaggggcagaagcaagagagtaagagtaaaattgcagaagccagtacagggagatgtaccataagataattgttaagagcatcaaatattaaacatagaataatatttgaaaaaattaagcatttaggtaatgaagtataagttctctgcttttctctaaacagatttctatctttaaatgagaaaacatattgctacaagggatgatacccctgcaatccttccatatttttctatgtcccatagctgctgggataaggcttaaccatttcattgagaagacaatcttccaagactatgaggtgaaatatgccacaccagtattccaggacaactcagctccttataatgtatttaaacatatattcagccattgcagcatgcattctactgcttatctaattttatttccttaaaaaatcactatagtattactgaccttttctgatttgtggagaagaaagagaggttagagtgaaatctaaagaaattcattttgttactgtcaagcgatgaaatctgtaacagctgttcatcctcaaagatggaaccgactgatattctttatcctcatgaaagagccaataaataactttcagggagcatcaatttttatctttcatttcctttgccaactagctcctcttctagattgctagamgtaaaacaaatgtagatttcagtttccttgagaatttctgttgttcattgggctgttttgtttcattttgtgtcctagattggttcctactttggcagtattttaacaacaactgacattgacaaggattctaatactgacattcttctagtcggagcccctatgtacatgggaacagagaaggaggagcaaggaaaagtgtatgtgtatgctctcaatcaggtaatggtgtctgagtttggtagaaatccaggaaaatctcttccttctcttcattttttaataataaattcyaatttttcactcactttgaaaaaacagagcaaagaagctatcaggattcattcactccaccaacccctcagttttgaaatgaccatttataattctaataaagtagctccaactcttagatattttctgcttggaaatgtgaattatgtttaacaatatataggataaaggaggtaaatataaatctcactaaactgctaaataaacccacaaggcttatttaggctgggaggcttatcagctctggcttggagatagataataacctcagcagttaaatcggatagggtggagggggagaagtcatgagtttcaaggcagcaacactgcaggcttccaggaaatacttcactgggctggagtgagattttgtcttctgttcctgactttagacatcattttttaagttaaataatttttaatttcttcattagaagagtgttttgctctttatagcaaagccagtgtttatctatttagcttttccaaatatgtacattctctcctaaattgattattttaaataataaatcatgtgtctttcttcctatcattttttggcttcctcctgtcaactttttttgtcctgggctgttttgtcctttttccaagaaagtgtattcttgattacctttgctagtactttctgtctgggttttttttttttttccttccactctaggcagctttagagaaagtttcctttctgagcagaataaattttcgctttgcacaatattgggtgaagaagggatagtggcacaaattaaggatataatattatttggcctgaaaaagatgctctgaattgtatactcaattgcattaaaaagagattccattaaartatgtctcccacacttctaccatctgctctttggaatccctaactttactctcagataggcacactttttaagaaattttaccaactttaccactaatgtacaaatggctgttaatagcactgatttagtatactttaaaaattctactctgctgtagtaatgatggaaatacataaatatcctgtttatctttcttccagacaaggtttgaatatcaaatgagcctggaacctattaagcagacgtgctgttcatctcggcagcacaattcatgcacaacagaaaacaaaaatgagccatgcggggctcgttttggaactgcaattgctgctgtaaaagacctcaatcttgatggatttaatgacatcgtgataggagctccgctggaagatgatcacgggggagctgtgtacatttatcatggaagtggcaagactataaggaaagagtatgcacaagtaagaattgaaacctacagattcccacccttcagtgataagtcggttcaatgccaggcattacctgtctaacttcatgagttatttaatttcttcctcctgaccttattgggaaactggatttaattctctttaagtgttttttatagattagttactatatatatatacacacacaaacaaactataaatatacacatagtatgtatatagtatatatagtgtatatataatgtgtatatagtatatatatatacacactatatatactatatacacactatatactatatatggtatatatagtgtgtatatagtatgtatagtgttccttatagattaattactatatatacacactatatatacaaatagtataaatatatagtatatatagtgtatatgtagtgtgcatatggtatatatagtgtatatatacacactatatatagtatatatggtatgtatactatatatagtatatacggtatgtatactatatatagtatatatggtatgtatactgtatatagtatatacactatatatactatatatagtatgtatactatatatagtatgtatactgtatatactatatatagtatgtatactgtatatactatatatactatacatagtgtatatagtgtatatatagtatatatagtgtatatatagtgtatatatagtatatagtgtatatatagtktatatattgtatatagtgtatatatagtgtatatagagtacatattgtatatatagtgtacatatagtatatataatatatagtgtatatatagtrtatgtagtgtatatatagtatatacagtgtatatatagtatatgtagtgtatatatagtatatacagtgtatatatagtatatagtgtatatatagtgtatatagtgtatatatagtatatagtgtatatatagtgtatatagtgagtatatagtatatatagtgtatatatagtatatagtgtatatacactatatagatactatatatagtatagatacactatatatagtgtatctagtatatagatacactatatatagtatatatagtagatacactatatatagtatatatatctatatattagatacatatactatatatagtgtatctactatatatactatatatatagtgtatctactatatatactatatatatagtgtatctactatatatactatatatagtgtatctactatatatactatacatatagtgtatctactatatatactatacatatagtgtatctactatatatactatacatatagtgtatctactatatatactatacatatagtgtatctactatatatactatatatatagtgtatctactatatatactatatatggtgtatctactatatatactatatatggtgtatctatatacacacactatatatagtatatagatacactatatatagcatatctaatatatagatatatatattatatatatagtgtatctactatatatactatatatactatatatagtgtatctactatatatactatatgtatagtgtgtatctactatatatactatatgtatagtgtgtatctactatatatactatatatggtgtacctatatacacacactatatatagtatatagatacactatatatagcrtatctagtatatagatacactatatatagcgtatctagtatatagatatgctatatatagcgtatctagtatatagatacgctatatatagtgtatctagtatatagatatgatatatatactgtatctagtgtatctacaatatatattatatatagtgtatctactatatactatatatattatctatatactatatatctactatatactatatatttcatatatagtgtatccagtatatgtattatatatagtgtatccagtatatgtattatatatagtgtatccagtgtatgtattatatatagtgtatccactataggtattatatatagtgtatccactataggtattatatatagtgtatccagtatatgtattatatatagtgtatccactataggtattatatatagtgtatccactataggtattatatatagtgtatccactataggtattatatatagtgtatccactataggtattatatatagtgtatccactatatattatatatagtgtatctatatactagatacactatatatagtgtatctataaactatatatagtgtgtgtatatagatacactatatatatagtgtgtgtgtgtgtgtgtgtgtgtatatatatatatatattttttttttgagacggagtctcgctctgtcgcccaggctagactgcagtggcacgatctcagcttactgcacgctccacctcccaggttcacaccattctcctgctttagtctcccgaggaactgggactacaggctcccgccaccacgcccggctaattttttgcatttttagtagagacggggtttcaccgtgttagccaggatggttttgatctcctgacttcgtgatccgcccacctcggcctcccaaagtgttgggattacaggcgtgagccaccgtgcctggccgtaattactttatattttatacatttatctagtttcctttctgttgttattttccatatctccaggatttgactttttgaaacagttaaaaaaaagaatactttgtaacaatgctgtttaacatctgttaaatttagaatgggacatttagtgtgtcccgttctaaatagagggcactgctttctgaataaggcaaaaataattgtatgacttaaccaataaaggaaattagattcttgattttatatttaatgtccatgctgttataataaattgcattaaatttatatttatccattaagttgatatattttcgtcaagtgaattacgatttctaaaggtttataattttctcgcaagtaatccttagaaaaaataaatctgaatattaagtttaagctgcagggaacttctgttattcctgtttgtaatttgttgtcagttaacagctctaatccataagtgtattttttttccttcattagaaaaataacaagttacaaaagtgcttaatgcactacactataaaaacaaaagaatttaaaggagtttgaatgtaattgtctgctctcaagtaatcatagttggttagatattgaacaactacttacaaataaaacagaattcactaccttctagcttatataatttgaaaagaaatyagaatattaattatttcattttctatttgagtgttctctttggttctgtagtcaacagagctctcaaaatctattcatgtaatgcaaacatgagtgatttttcataaaaccataatgacaatagtgaacagaataaagggcttatttcaataagagcacttgtatccatttgataaataatttgtttctgttgaaaatctttatggcattatttacttaacaagagacaggcaatattaatgactggggcatgatggaattaggaaatgcaggaagagagttctttcttatattctaatactttattccttcagcatcaatcctgtaaatttaatggggtagcatttgaagtagaaaaggaaagctaaatcattgtcagatgaaatagatttgtcataaacaacttgttttctaaatggtggtaartcaagatgcaactttaaacaaaaacaacaaaaagaatattagagttggatttgtttaattactggcaaaatgtttttccaaggaataggtgaagatgtgcttactcatttccatgagaaccagagatgctgcttatgtatgggataatccagaatcaatcaagcccatagaaccaaggagtcagatatctcctgaattcttcacttaaaaaaatgaggaggattgctgggtgcggtggctcatgcctgtaatcccagcactttgggaggccgaggcaggcggatcatgaggccaggagttcgagaccagcctggccaatggtgaaaccccgtctctactaaaaatacaaaaaattagccgggcatggtggcgcgcacctgtaatcccagctattcgggaggcagaggcaggagaatcacttgaacctgggaagtgaaggttgcagtgagccgagatagcgtctcaaaaaaaaaaagggggggaaatactttcaaacgagcctcacctgtttaaggatgaaaaatgtttccatttggtttgccttagtaggcttcttattttatgttatttatgtggaaaacaagaggctcagaagacttgaagtttagggagggtttgtaagtcctgactgcttgccatgggcttctgttaaaagcattagcttaagcttgaaccaatgctaagtcaggaagtacagatatcaaacatactatgtatggtaatgtgcacagatcagtcttcaagacatactcatttgtgccatctcaacgttgtgaatacatctgagtggaattgagtctcttgtgccctcaacttttaggacaatttttgaaagacagtagagattacatattggaaaatgtatttgatgggatgtgttatttatacccagccacaaagttcagtgaactccaaattgacccctaggacaatattatactcccctcccccctttgctgatatgatatgttttcaagatttccagtacctttagatatgtctgtgtgatgggattggctaggaagcagaaagcacagaaccaattactcatactgtttcctttgaggattagacacaatgacactatataatttttccctctctctggtgtcagtgaccttgtaatgattttgtctgtactataaaaacagcaatatcctctgggaacatctgagtatttcctcttatctccacatgagggacctcttgggcggattcccaaattaacaaaactgattattttgttaaacaatttaaattctcagatttatttgaaactgttttgaacagactcttctcatatgaaactcttttttttggattctcacagcgtattccatcaggtggggatggtaagacactgaaattttttggccagtctatccacggagaaatggatttaaatggtgacggtctgacagatgtgactattgggggccttggtggtgctgccctcttctggtatgtattttaataacatcctgttaatctgagactgggtcacttgcagagctcccagtgtgattggagctcatgtcataccaaatatctatttccttttgtgttccactatgcaaatacaagttattcagttgagtgagctggaagagtcaatacatcttaagaacaaagaagctatatgaaagaaacaagtagaatgaactcttaatttggtgtgtctattatgtggtttacactaaaataggtattctgttttaggagaggtataggggaagagaagatcttatagaggatgtatataaacaagaaaatatccctaatatttggttgcttacaaggttttagagataatcgactttgtattcatttacctgatacatagaaacagataatcgcgtagcactctctgactctgtttatattgttggtcaagcctagaggcatcttaagtaatatcttygctcagcctttaaaatgcctaaatccccaaattggcccagttctttcagatacatacattcataatgctttattaattatgaataaataataatttagtaggcaaaaataattattgcttactaaatatcctatctcaaaaactaaatatcctatttcaaaaactgttctgtttgaaagaaattactaggaagtcaagaatcaacttaatgagaaatccacatgataattttgaaaaatatataataaatttcattaagaaatataaaggaagggtttcataaataaaatctatttatgccaggtgactttatgggaagtcygcatgttgattctcctaaattaatgcattggtttactgtaattcgggtggaaacatacatcaatgctctttttcccaaaaatctacctagaagagtaataaagtataaaagaaaggtgaagatagagaggtgaaaatagatgactttgctataatttaagataatgcttaagaactaatggtcaaattaaaatggtrcagtaaattgtgcacatacaataatcactatttaaaaaaaaaacctttacaatagaggggaaagaagactgaagggtgatacctaagaaaagggaatattaggcagcacagtggctgggactttggggaggactcaccagaagccaaggctcaaaaccagaagtcagcagtgtcagggacaatggatatacttcaattttgtttgaaatgttaatcctgaattagtttattatgctccctttagctcacaaatatttattgtattaattctcatattaaaaatatgttttcagggtttttatgctccagttttgtttcaaggctttcttgcaaagctttgcaaacttatttatggcctctcctgccccaaatcaaggcattgatggcccaaaatgatagtcatttccctatcatagtccaggctccactgacagcagaatggaccaaaycgatatactgggacacgaagactaagattcacaatgcctaacaagaagtgagagtggatacaagtgacagatgataggaaaaacgtttggaagcaaatagtgagagtcttgtcatgagacctggactgactcccaagaaagatctggctggggcagagaggatgtgtggggtggacaatggtcgaggcagcttcatgcctggagaatccatattactaagcaggaaactaggcatgttcattcattgctgatgaaagggtaaactggctaaaactcattcgaaggtctttatcaataagtgtttaaaagcattccaatgttcctactttttaccaaggatttaacttcctaaaaatgtaaagatacaatctagaagtacaattaaaggtgtcatcacagcactgtatgtaataccatcttttaataatgttaaatttaccactatactcagaaaccttttttttaaattaagctaaatatccaatgagatgggattgaatgcatagattatggtatgtgcatatgctggtatagtctgcttccattaaaaataataaatcccattaaaaataatgttctcagaaaaatgtaaatattggaaagctgttcattgtaatataatgttttaaaaatttgtaggcatacatatgaagatgtgcttttgtatatatgtatgtatgcatgtgtgtacgtgtatgcatgttttcttctgtaaagaaaaaaccactgagtgtactaaatgttaatgatgattattgctgagtggtagtataacaagttatttgtgttttctttatgcatttctatgatgtttatattttctatgagtccattgttttaacagaaaaaagaaaaccacctttttttaatgcaaaagcataagtagtgacctcattattcacaacatacacagttataaggggctagctctggccacaaggcagaaaccaggtaaaaatgtgcagtaattgttccggcttggatctaagacaatgacctcagwatccatatattctccatgtctgagatcttactctgatctcattttggattagtagacattactgggctttcgagttaaaacgactgagtttaaaatcccaggtttttcctcttaatagcttttgacctggcataaaatatttaacttttcagagccccagttatcaaacgtaaaacaaaaaaatgatgttgcttataattaaccttaagaattaaatgaaatagcatccatgtctagcacaatgcctcaaatgttattttgcttttccttcctagaaatagaggaagagctgaactcacaaggacagacaatattacagtccagacaagagatagcaggggyctacgggctgttcagggacctttagacttctttcaaatttggaacaaactcgtaaatccccaaaatacagttgattctggggtttcacctggacacttgattccatctcttttccatcacaggaaaaactagatctttggtgtttgaaccaaaagccccaaatggtttccaaatataacctacatgtcttagaacatcagatataatctcttctgtaacaatgattaattaaagaaatggagtcctgagcgctgtattatacatgaagcagaaccctcttccatgcactcactttgcactcccaagttgatgacattcattaaatgtaaaaatgtgtgagtaatcccattgtttttgtttgtaggtcccgagatgtggccgtarttaaagtgaccatgaattttgagccaaataaagtgaatattcaaaagaaaaactgccatatggagggaaaggaaacagtatgcataaatgctacagtgtgttttgatgtgaaattaaagtctaaagaagacacgatttatgaagctggtaagcaaaataattatagcaagtacttttgggtagaggacaatatatttgctctagcatgaygaagtccagtargatattgtattttccccacwtggtgagctgcacgtcatatttgcmccagtgaagatgcagaaccttgaaaaaaaattctgttgcaaaaggaataggttatggaacccagtcaattctggagcagaaattacatgtttgtatgcagtgccctcaacactccatagtttctgtctggctctcctacttgctatgtacaatgagacgcttaagaaaaaaataccgattcagaggtagagtttagaaattgagctacaaatgggcccagttttccttcctgtaggtttctaccatgactcttctctcccttctcttgccccctcttgggaaagactgatattgcagagaaccctaatactttaccattcccacatttcygagatcctttgttccattgaggtgaccctagtttccgagagtcagacttgttctgtgtgtgtgttctcaggtgcatcaggtcagcctgtgcttcctcttcctccctccgttctccactttctaaggcagctttttaatgatgttgaaatatgctcgaatcaaagctataaaggccattggctaaagaagagaaatttactctgtaaccaaatacaagcagaatgagaaaagccattaatccttaaaatctgtttttcttgatttgttccatatgtgcatgtatatgctctgaaatagcctcctgactagaaagatcaatgaggtataagaayataaaataatgattttgagttttatatgtaactttatttcagtcttatttaatttttgcaaagtaattaagtgatcaaataaggaatattgtagccttcatatacagtgtaagatttcatttattttctttattgtggtatgcttattttattgaaccttaatagtggtttgaccataagctgagataatgtcattttatatataaatagattaaaatgtatatatttgtaaataaataactaaagtatatttttgtccctattgaaatataacataatcaatattctaagcagggttccaacatttctaaacttaaaaagaatgttttaagtgaaaatataataaatacagtggtggcctggcaattagatgataggcaggtgtgcatgtgtgtataagaattataaacaataaatgtaattagacactgaaagcacagtgaactcagagaccagttctatagagttcctcaaggttatcttcatgactgctaatatcattgttataacagtgtggatatgctgaacaatagaatcttttttgattgattgccaaagagatttttctataatgctaatttaataatctgtacaatatgagaatcacttcaaataaacatttccatcaattattttttraaatttttgtagatttgcagtaccgtgtcaccctagattcactaagacaaatatcacgaagttttttctctggaactcaagagagaarggttcaaaggaacatcacagttcgaaaatcagaatgcactaagcactccttctacatgttggcaagtaaatcatatatcgttgctgccttattccaaatcaagaatacagtagagatgtcttatttcaagtcaatcaaattcttactgttttatttcaaaatgcacttatgatgtcataaaggaaatcttgtttgttcatttttatcataaaatcgcaggtctaattttctcatttccaaatatttgtaaaactatctctagtcttccctgtctgcattatcagacatccatatattatggaacggcaggaaaagacacagtgttctagttgacaagaaaccttattcatgtcttcatttctttcactcattcatttattccttcaacttgaaaacatttaatttctgtgggccttgtctgtcagttgtggttggtaagtgattaactgctctgggggcagactgctgggctgtatgctttctgggatccatgtaactacatatctcgccgtttgattttagagcgaaggggaaaattatctggtattttctatcatctgtaggctttgtgctacttcagttttttttttttaattttagtggatgagggagttttggaaatcaaactattaatgtttagagatggctggtaagccagtgtgaatcatttaaaatgtattttgttgggacactgtgtatatggggaatgttcccaacagagggcaggagtttcctaaacattttcttaaaatgtacatgagagtgataaaaacaagaagcagcatgaaggtaatgaggaaactgattttagtaactgacattaagacttagagacttgacggtaaacttggagctttaaaggaaccaggccaattttcctacttctgacttatttctgtattattgatatattcatagtctgtattttgaaaattgtagttcaggggcaggggagtgacagaaaatgtgcacccttttgtgccacatttgttcttcctcagtgattttcatgttgatatgcttcatgatacttatcatgaagcttattctgtcaggaccaagatcaatctattatttggtaaaataacactggagttgcccctcctatttagttaatcagaactgaacacttaggaattagaatgtggataaaatttgaatgggtatgaaaccagatatggcattgtctccaacctgctaaaaatcatctcagtctatgtttgtccacaaattcagtgtctaagttatgtccaggtactggtgtttaaaggactgaaatattttcaaaatttcgaaaattgttttggattttgaaagaagcactttgaaatttgttctggagtcagccagtgtagaatttgtatcccaaatattccacattctgagagactttggcaacgtcgtttggtctcttagagggtcaatctttcatctgtaaaataaggacaataatagttactcatcttagaggactgttgaaataatttgcaataatgtatataaagctcataattttgaatactataaatgattattgttattggtggcatgttaacagtattaatcatattcacatcctttccaaataattttacattataaaattcttggccaggcatggtggctcacgcctgtaatcccagcactttgggaggctgaggtgagtggatcacctgaggtcaggagttcgagaccagcctggccaacgtggtgaaaccccgtctctactaaaaacacaaaaattagctgggtgtggtggcacatgcctgtaatcccagctagtcgggagctgaggcaggagaatcacttgaacctgggaagtggaggttgcagtgagccgagatcgtgccgctgtactccagcctgggtgacagagagagactctgtctcaaacaaacaaacaaacaaacaaamaaaaacttatagctgtaggtatatattatattaatgaaatgtaactcattttatagaaagtttgcccttctgaagttgggaaatgttcccggaagtgttacataatgatctttggcttgaggtctcaagaaaaactatattgtgatgcaggtagctcctatgttgacacagccargtgtgatgttgccatcactccagcagggccctctgaggaactggaagtgagtcaacaggtcatactctgaaacctccacattcccctatgccccttgtcagaatgccaatccctctccagggaagcaaaagcctgatgagatcatatgtcagattagatgcacaagaatgctgcagtaagcctgacccttgggaacagaagaaggagacataacaagatcagaacacccggtaaatatgataccagtgatatattttatgtttcaccctctaggacaagcatgactttcaggactctgtgagaataacgttggactttaatcttaccgatccagaaaatgggcctgttcttgatgattctytaccaaactcagtacatgaatatgtaagtcagatttctttaaaatacaaaataccaacttgtgaacattttaatgtcactagtaaactgtgttttttcactactctgcattgatcacaaagaacgaacaactaactggaagaaagaaaaaaaaggcaagcagattttattcctggtcaggaatggagaaagagggagctcttgctctraagaccttctcttcaagctgtgaaaacctggggaattttaaggagttagatgtggggcagggaggtatatgtaagcatgtccagagaggaactccagatgtacaagtacagctcataaacatgcttccttatacaacatatgttcaagaaatggtggccattttcttctatggcagggactttagcattataatgacatgttaatgatctaaaggtaacaaggggttgctggttcttgtttgctccgttttctcaatggctttatcttcctctggtaattggcaaagggtcctgaagctyccaggccgtctrtagttgtttttcagcaagcttacctacagataaatagactagaaaaaaaaaaactgtttaagaaaaaataatgcactttctcagctatctactgtttaacaaaataatgaactttctcagttatctactcttcaagaaaatagtaaactttctcagccatatctccaggtttgccctggtaacattaggaaaaagcttgaaacccatgcacacataaccctaaatcaatttaaaatgttttaaaaaagaattaggctcttctagactttttccaatccttctaatttcctattgttggagtttaagaaaactaataaatgacactcatttttacctcatttgaatttaggaccaatggaaagaaatctcccccattattctaataagcactggattgcagtgtatggtttaggtataaagggtgtcctcacrctgaagcatggacttagaccaccagtaaccacctaggtcatcagcagtgctgatccatctctgtccttcttcatggagcccaccttgtaaaacttgtcaaatggagtagagccaaatgtgtgcttcctgtgggtacagctgctctgagaatagaaatgagagaaagggactgagttgtgttcacttagttcctgttcccaaagttagagtccatgtgccacccctgagagtggagtgaggggagagaagagggagggtgtcactagcgtggctccaatggaagagatatgagggatggggaattctttttccccatacacctatcttccattctcccttccttcctaccagatatattgattgtcttatacataccaggcattggagcttacagtcttaacactggaaacaggtattaagtagtaattagagcatatgctatggaggaggatttcagagctctctaggaacttccacctaggctgagaagtcaggacagccctcctgaagttgtgccatttcagtggagccctgaaggatagggtgatttccaccctatttaggggagtttggggagcagaggggatgctaagtgtgaaagtcctgagcatgaaggaaacaacgacattcgctagtgtggctgacgctaaagagcaagaaaggaggtgacgtgaggtgaggccrgaggtaaaggcaggggccgggtcattcgggacttggtgccactgcacaaattctaaacttttgaaagagcagtgcagtgcttttgaaggtttttatttggttcagccacacgacaggatgcagcagagtgaagagtggttggagggaaacaggtggatgtgggagccccgtgggaagctattactttagttcagggaggaaatgagaatgcttgggtgtgaggtggtggtgggactgcagaagcaagaaaggattggagagatatttagaagaggagtagaatggacagggcttggtgagttacatatggtggtggtggagaggcggtcaatgaagaagaatcaagcaaaactcctagatttgtggcttgaccgttttccaccctctcaactgagctttatgatattcctaagyatttgattaattttaagagaaaaatctcatgattagagttgagtagatttagatcttgcagtacttgactttgtatttcaaaactgtccttccctggcagacaaaagccagtgcaaagcacccatgaaaattgtgcgttcttaaaaggacaagcacaatttacatttgtaagtaaatgtttactcttctcccctataaattacagggataaatataaaatcccttaagatttttgcagggaaattctccttatgagttgcttaacttaytttggctgtatgccatttttgttacacaaattgatgggyaattttcaacaatgcrtagctaaattttgaaaaattctttcctgtcatcatttcagattccctttgccaaagattgtggaaataaggaaaaatgtatctcagacctcagcctgcatgtcgccaccactgaaaaggacctgctgattgtccgatcccagaatgataagttcaacgttagcctcacagtcaaaaatacaaaggacagtgcctataacaccaggacaatagtgcattattctccaaatctagttttttcaggaattgaggtaaacttccagtttttcatttatttgttctcttaacatcatttacctggcctacttttcatgctactgagataattgcttttattagattgattttgaaagaatagaaggaattttttacattagtcctcaccaatggtgaaagtattaagctttttaaaaaagttttgytttatttattcaaatatgtatgtcttttcttagattctgtgtgagaaaaggatagctcatgtataaaaactgtrtgtttcataaaatccttaaaccactgaaactgaaacagagtcaaggaaaataataacaatcaaagccaaaacagttaacagacgtacagagaggtacctctgtgttaagcaaaaaaaatttacctgcaggaaaatcaagataccatatctccctttctatgcaaaatccttactttggcaagatatttgtattaaataactgtgtcttattgatttgtaacagaggtttcttttattacattggcaataaaatatattaatctgtgtaagatgctatatcagaggtaatcagtgtttccaaatgtgaactttgctcttaattctgatctccaaatgaatcccactgagttaaaattttgtgtatatttatattaattaatattacatacaatttatattaaaagcaatgcacttattaatattatacatagtattaaaacactattgtctactttctgtaaactcagatttcatggacgtttctctctatctgttaggatatcacttagagacatgatgactaagacaaacctaaaaataatgtcatatattactatattttggattcaactaagaatattaattacaggctgggcatggtggctcatgcctgtaatcccagcactttgggagaccgaggcgggcaaatcacggggtcaggagatcgagaccatccaggctaacacggtgaaaccccctctctactaaaaatacaaaaaattagcaaggcatggtggcacgcacctgtagtcccagctactcaggaggctgaggcaggagaatcacttgaacccgggaggtggaggttgcagtgagccgagattgcaccactgcactccagcctggtgacagagggagaacaagactctgtctcaaaaaattattattattattattattataaatacaaatgtacaaagtaatcttggggaaaatattaccacaraatttttctctagtaaaaattattgcctgtatcctcctatgctgacttaatggcctggcagagaggcatagctaaaaaatctgacagtgcatctcttctgtgtatattaacagtaacaacagtaataatgatggcaaccatttcttgagtcacatcatggtttaggccctgtactaaggatttcacttatttcattttcattaattcttttgtaagtaggtatgactgtactgcagagatgcgaagataaaacctttttttcatgtttcaacattcttgtaattgcattttacaattgataacatgtttatttacgtggcagtgttatttttacttcttatgggtatgtaaaaataatggcatatctcatgttcaatggcattttaaactggaaaaaatagagtatatgactaaaccacttgatagaaaatcagtcccagagaggtgaggaatcttaacaaggataaagctaacagtggtgcagtcagggtttaaattctggtggtcacgggtcagagcctatgctcttatccactgcactaaactcctccaatgactagcattcactgaagactgctctgcaccagtcttgggtgtctggattattttatccagccaccgcaatcactctgtgagggaggtgctattagtacttccattttacaactgaaaacttaggtaggattgtgagatatgctttgtctttcaggcacccacaagtgatgttttaggatttccatgagtgtagaacagctggtcccagaattctgtgcctcttccagctaaatcgagacaaaaatagtggcaaggcagtcaccaagacacatctgggaaaattctgraagaacacgtatcaatatttcacctgcttgtccactctgattctgtttgctttctcttcctaggctatccaaaaagacagttgtgaatctaatcataatatcacatgtaaagttggatatcccttcctgagaagaggagagatggtgagcagatcatacaaaatacatgtagaaattgaatatgaaaagtaatatgtgcaaagacaaatatataaatccttccaatggtagtttaggataatacggatgaaaaatgttcagttcaaaattgtgacagattggaatatgctatggtcagaatgtttgtgccccaccaaaattcatatgttaatacttaatccccaatgtkatcgtagtaaaagatgaggcctttaggaggtcagtaggtccagagggtggagcccccatgagggattagtgtcctcataagagaggcttgagggagactgctcaccccttctaccatgtcagaacacatagcaggtgccatctatgagaactgggtgtttccagacactgaatctgttggtgccttgatcttggacttcccaaccctcagaactgtgagcaatatatttctgttatttataaaatgcttggtataaggtattttgtacaaggtatttataaataacagaaacatatttaacaaccttgtaacaattcttacacaggcaaactcgaacaccaagacaagatttaaaatttatactacataacatatctaatttatactacataacatatctgataaaatggagctgggaaattctgttattggagtctcctaggtagtaggtgtctctggccttcaagaaaaagaatgcttcaaatagattggtttagaacttaatcagaaattctccttccatctctctctttctaaaaaamaattgccttattgagatataattcacgtagcatggagttcactcgttgaaagtgtgtatttcagtgggttttagtatattcaccaaattataaattgtacagtcattacgacaattgattttagaacattttcacacaccacaaagaagccacgtatgcattggcagtcactctgtttttcctcaacagcctttctcccaagcccaggcaaccactaacctgctttctttttctatggaacaaattgaatttccaaatatcaattgacttttattggcaattctagaatcaggcaacaccttattctgtaaaataaaatgaatggtggatgagctgaggagaggaagttgactttatagagagaaaagggctgaagaaagcagaaacagaacraaaagttgattggtcatttcaaagttattttccttgtaaaagtgaaagcagaggggattttcttatcatgctgtttgaaactggcttgattggggatttggtgattatctctcacttttctcatctcccaaaaagtcagacaaatgacttaatttcggctttgtggtgtggaacttaagcattatttagtctgttgggcctagagcaagagctgtccaaaccaatgacctcctatatgttttacttaacatgtttcttagtctattctggctgctataactaaatactataaactgagtagcttaaaagccagaagtttatttctcacagttctggaagctgggaagtccaaagtaaacacactggtagatctagtgtctggtgagggcccatttcatgcttcatagaagatgtcttttcaatgcatcctgagatagcagaaccaggaaggcagcattctgagttacaagggtactaatcccactcatgagggctctgcccttatgatctcatcacctgcccaaaggccccatctcctaatatcatcacattagtgtttaggtttcaacacatgaattttgaggggaaacattcacattatagcaatatgtaaaacatggtagacattcacattgaaaaagaatatgtatattatatgttattctatctattttgagatacaataaggtttcattttgtaagacaatgtttctcaaataacttcataatttgagtttaggtaatgtcatttatggaaattgaatattttagtcaaagtaaatttcttatctgttactaaagacatatttttattttataggtaactttcaaaatattgtttcagtttaacacatcctatctcatggaaaatgtgaccatttatttaagtgcaacaaggttggtttacatgtgtataaatgtatgtatatgaatgtatattgcttcttctgtgtatgtcgaatattttgctctataaactcactgacagtttcttccaggttgtaggagatcagtagaagtggaaggcaattaaccactttgcttcacaaaaacacccttaagaataattagcaaaataaagaaattttcatttaatagaaataattcacctagattaaagcaatggttctatgagctatagaagataccataatcacacatcatttatatctgccaaattgcatttaaattcataaaaaatttactgataatttaaaaactttcactggctgcccatcaaggtcaaatgaatcattagatggacttaaagttttatgatatccttttgtaatttaatatactttattcaaatcagtcagtacttctgaaaggtatcatagaacacacagactaacaacagcaaaggctcaataaggaaagtgaaatagtggtctaactttcttctaattgtaattatccactgacctgtctgcagtgagatggtgtcttttactgttttattcacagtgactagcattgtgcctgccatattataatcactacatagatgtagacgaaatgaataaattagagaaatgaattaatggattaattaattctgtatgttcaagtcaactcaacaaatatttatttgacatctattatgcacaagatattgagttagtcactgtaaggaatataaaaattactaagggcatgaaactcctcatagggtaagtattacagtagggggttgagtctagtataaaattattgtaacctgggatagaataaaaacactccattatagagatagaaagctttgtcagaaaattaatagaagctgaaataatatctacttggcaatgggaacccaagaaagctttatcaaggaacttataattgagaaagaccttgaagggtagatagcatttcacagagaggtcactgaatagcaccaggtggagcatttcaggcaaaatatatagcttgattaaaaaggttatcaattttagctgaaatataaagaatacataaagtagcaatgaaaataaacagggagtgtgcattctatcatattacgctaggtactgaatgtcagtcaaggtattatttcttaattgaacagaccttgaaaagccagtaaagtttttgagaggtaaagtcatctgtacagagctgctgcttatggagatgaatttaggaaggctgcagtgtggaatgggtgagagaaaaggggaccattcatgctaagagctgagtcacacaaatacctataatccaaggcagcatgctgctttctctgtcctgctgcttatgagccactttatacatttgggaataagcagagccattaaaaagtactcttatgcccattctgtgagacaatatgttaggtgcttggtcagttggtggaggggtatgtgtaaaataataatgaaagctaacacttactgaatatttcctatgtcctaggcacaatcttaagcactttatacttattactaatttaatcatcatttattactcatttgatatcccattttatagatgaagaaaccaaaacaaagacagataagtaatttgaccaaagtgtatcagtgtccaagaacaatctcattctctggccccagagccagtgttcattactcgttatatcatttgtatgtgttttctaatacgaggaagtatgtatatgtgtgtatgcacatatatacatgtgtttacataatatataatttaaatgataaccaaaatcaagagaataaatcagtgyttaacaaacaatatgatcatcaagtacttagtatggaaagactattaaagaagaaaacaaaagaktttagatttactctcagctgtgtgaccctaatcacttatctttactaagtcctcatctgtgataaataagcatcacctgggggcagatatgtggttaaaaacagaaattcctgcaccccaagttggaacccctaaatccatatttctaagggaagcccagtaacctttgtattttaacaattaaactgagggattcttatcaatattgtcatagaattttgaaaaacataaatcagtgtgattgtcaagtctagtcgcacatcagaatcaacttgggaactttcaaccataccaatcatctctgatctccttcttcaccccaattaaaaaaatgattaaaaattatactcttacatgcttttatttagttgccaggataagcttctctttcaaacacttagaaatgtctttaaatagtcaagattttaatggtttgtctgaatgtgccgtgtattttctagtgacagcgaagaacctcctgaaaccctttctgataatgtagtaaacatttctatcccggtaaaatatgaagttggactacagttttacaggtaggagaaaactacatttttatgtggatgcctttctattaacccagtggttctgaaartgtggtccctgcctggccaagggcatcagcatcacctggaaacttgttaggcaaattctctggccccaccagaaacctaccaaatcagaaactcggaggatggggttaaacaagccttccaggtaattctcatgcatcctaatgtttgagaaccattatactaaataacccaaagtgttaggtgttagtgataccggattgcatttgctgtccagtcttaattcccgaatgcaagttgaagacccagaagtccttcgcaaaacacgatattttcttagaggccgccagcatatttcttggtcatcgttctcatcctgtggaagctgatcagtcttctcaatctggacacacaagattaaagcatttctcattgataagagctgtttatttcttccaccattcataaaccattctttctcttaagaacttcttatctatcccaacacaaaccatgttgacaaactttccctctataatttcccctgcttaagcagaactccaagcttttgccaaataaacatgtgcaatatacttaaaaggataagaatcagtggcaagtaggtttattctaaaagtcttatcattttattaattttttaataatagtggctaacatttattgagcctttgtgttctgtcttatgtgatcctcatgataacactatggttcaaatacaactactatctccattttccagttgaagaatttgaggttcagagaggctaatttacccaaggttatatattcaggaagtgttagtttaaaccatttcacatgcttttttttttcttttaatttaaaaactgttttaaattgacacgtaataattgtacatatttataaggcgcttggagacgttgtgatgcaagtaatatatagcaactaaacagggtaattggaacatccattgtctcaaacatttatcttttttttgtattgggaacattcaatatcttctttctggcttaataatttattatctatggcactctctctttactaaatggagactacaaaaatggcatgattataggacatacatgtagattgtgctaatatttctcagcctttaaattctgtctccacttttctgtatttttctgtatccacttctattggtgcactgacttttccccaagagttttccatttacttaaaatcaaattttggcaaacacttataaatattttttgtcttcccttgactgaagtgctgcttaaaaacatactattttactctaccaagttcatccaaagaacatgatgaagctgtgtagagaagattgaacttttaagtttagcagtaaatataggactttaaattatgaaatggtaaaaatttttaatctatttagaattcagcattacattttagtttcatttttcactaggtataaatggtattagtgaatttacagaaacttttcacttgttaaccatgaaattttaacttttaaaactcatattctagcattttggggtcaaataagcatcagtgactattgaactaaattacataatccttctcactctcctcaaagatttaattttacgtttcaaggtaaatgaattcccctatgatttgaaatccctacaagtatttttgtggaattacatgatatggagaaagaaaataatgaggccaaataaaagttaaactttgttatgttttatttttcttctaattaattttttaagctctgcaagtgaataccacatktcaattgctgccaatgagacagtccctgaagttattaattctactgaggacattggaaatgaaattaatatcttctacttggtaagaaattacctctaaaatagtattctaaaggagttatttgtaaatatataaattaaagtattaacagacacataaaaatatgttgcttcaatgtttaatctctatattccagcatattttctttataatttcataaatataaatatagacatataatatataaatataattttcaatttatatttttctttataatttcactgaagatttaaatttgttgtaattatattttcacatcagtttagagatctaagcctctaatttcctcaaaataagataccactagaatgactttctagaaaaaaaaaataaactatgggactagatagatgctaccgataaacctgtagactttacttacattattttatcagtgtgactgagaaaagcactttttcattaattatgactatatcagaaatttgttatcacaattgtcttggcaattttttttacttaacaaataagtatgtatcacattctccttattgttacctttcacatgcattgtactataaattactcatgttggtactaccacctccttaaatgatgttttctattacatttatttttccttttaaatccttcataacaaactctataccactatagcaaacaatcacggaattttattttaggtaatgcctagttactgacacagactcaagttaaaatcactcaaggaaaaaagagarcacaattcaaataatggatttaaatatgtattcaaaaatatgagataatgcaacaaaattataaatgaagacagcctcaatccttttgggaattgccaaccacaaaaaaaagttctctcatagagtataaataaacgtatactcccaagattaatttcattttttaaaatttgtactctttgctagaattcctatgacaatttatgctaatttccctggaaattagcataaatgccaatcactctactggattctaggacagatttttggaattcaggctatcagatttctccagccctattcactttccctgaactagaaaattcagcaaaaaaagaaagaaaacaaaaagactttgttgcagaactttatatattgtaacttattagggtccagatttgaaataggtactctctcttataaaagtgttgatatgaattacattgctaagaatattcctgagcataaaactttgtgtgtatctctgattattttgctgaagtaaattctagaattggaataaaggagttttttaaaagaactttttttaaggtgaaacccggtaagtttactgctcggaattttccctaggaaatttttggtgatagaaacaaagatttcagggatgttcttaacaatattatttataatagtttaaaaattaaagcctgggcacaatctaaacacttaacacaatgaaattacttacattatcatatatttagtgaagagattatcatatattcaatggagagacaacgtaatattttagaaggcacattttggagtaagaaaccataatgctgctatttactagctttgtgatcttggaagttcttaattttcattccaaccttcttacctcatagataaaacaaagataatatgaggatctgcttcctgcagttgttaacagggttaaaagcaataatgcatataagaagattagcacagcatgtggcacatagtcaacaatattgatattgtggttgttatgaacagtcatattctcaataaacttatacatttaaaggaaaatgccatagcataatacattttacagacagggtacaaaactgtattttattgtgttacaaattttataaatatgcatatatgcaaataggacaggtaacctacactaaaatgttaccaaggtagttgaagtataggaaacgtttattttcagtattttccaatgtttctacaaggaacattttttaatcagaaaaaaatggtaattacagaacacaggatttcttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggaccacaggcgcccgccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggccagaacacaggatttctaactgaatatcaggaaacagaatttgactggaaatcaagaagataagagttagggagcatgtttaagggtccaggtgcagctggtcaggaacctccagaattccagaattaaaggatgtatttcgtctttacaaacccaggaaactgcttcagatctgaggagctctcagtctggaaggctcagttgggtagatcactggctttccttgggtctatctatgtagatcaaggcgttccctacccagctaaagaagctgcacagggatgccataggtttcaggcctgcagattatgcttcagcagtaggaaggggacaactgcatctggttgtcccagttcagttgtaccttttaagcagggaaggacctctggatagtgagttcagtttcctgttgaactttatcctgcccacctttccctctgagctacactcactactggtagcagaacatgatactaagtggaaactttgggttagtggataaaatcgaatggagactgagatgaaagtaaatctgactctcataaaaccagattatcaacagccagtgtcacggtagccctagctgggggtagaattgtgaagggaagcagatgggagtctggttttcctgtatagtggtggcagatcccatctagccaggattagagatgatttatgggtttaaggaattatggcaaactgggtaaaggcaaccaaaaatctaaattgttccgtggtctcccttctttccagtttcaaaaagactggtatgttaaaaaaaaaaaaaaraaagaaaaagaaaagaatgagcmtggcaagaacataataacagacaaaaacttccaattctggtcttctgttaatcctaggtctattaagagaatgggggatggaggaacaatatgattatagctgatacatayggctactgaccattaagtgtccatattttctgctggctgaattatgccaattctctgtacagcaccataaaggatctacatttgtttggggattcaaaatattacacaatttacttcatcagctagaaaacaaagccctacataagacagaagaattctattaaaagaggaagaaagattacatttccatttttttcttgtagattagaaaaagtggatcttttccaatgccagagcttaagctgtcaatttcattccccaatatgacatcaaatggttaccctgtgctgtacccaactggattgtcatcttctgaggtaagtcatgtgtgccttggaattatgtcattactgttatcttttccactttatgtttaagccttttgttctgcatgatacttgtaataaagaattttaccaaagtaacatggagaggtatttagataattaaaagcaaataataatagatgtattattccctagagctgctgtaacaaattatcacaaattgagtgacttaaaacaacacaaatttattctttcacggttctggagtccagaagtccaaaatcaaggtgttgacagtgttaattccctctggaggctccaagagagactctttctcatgctgtyttcctagcttctggtgacaactggcaaccctagtcgttccttggcttgcggcagcatagctcctatctctgcctctgtcttcacctggccttctctgtgtttctatgtgttctccttctctctttgtgtttctgcacactcaccattagatttagggtccaccctaaatccagagtgatctcatctggagatccttaatataattatgtctgcaaagaccctatttccaagtaaagtcatatttactagttctagggagatttaggcatatctttggggaccactattcaatccactagagtagattttaaataattcattgttatgaaatgtttcttacacttttccttgatttgtggtaatcaaacaactctataaagtgacttcttaattgtacctaagcatgcacagctgcaaacaaaatagtataattgtatttactcacatcccaaataatagcaatattgcaccccctttatatttttagcttgaatgagactatatgatggttcattatggtttagtgcctaaaacaaaaaatcaccataagtattgaattaatgtgtgcatgatgtcagaatttggaaatctgtcttttcatgcattttttaaagtgttcccagaaatcaagaaatagcaacaatgctaattggcttgtgatcayttaaatgttttcctaagggcaaggaaaaaataagcctttggaatttccctctaatccaaaaaagcaggtttgygaaaatccagaagagaaaaaaaaattgtacttttcatactgcttaggaaactttaatcttattaacttttgtcaaggatattgacagtactggggaagcaaaaggtttactaggttaagtctagaaccagctatcttataaatatagcattttaacataatatattaacatctatagggctgtctgcttacgtctacctcccatgtagactgagtgtcytatccttggtgtgtagggaatcaaaagtattactggatgaatacataaatacagatgaaggtctctcgcttttcaattgtttcatgagccataatattgaacaagtatttttgttgtttttgtttccttttttttgagacggaatctctctctgtcacccaggctggagtgcagtggcgcgatcttggcttactgcaacctcctcctcccatgtccaaatgattctcctgcctcagactcccaagtagctgggactacaggcgcctgccaccacacccaactaatttttgtatttctagtagagatggggcctcaccatgttggccaggctggtctygaactcctgacctcaggtgatccacccacctcggcctcccagagtgctagaattacaggtgtgagccactgtggctggccgttgtttttgtttttatcagtagaatttaaatgcttttctctctctgtagtatagaatttataagcttatctttgattaaggtaataaattaatgaatgtattaatcacgtaatagtaagttctattagcattctttcttttccattacaacctcactagtttccattacaattcaaaagtagcatggtaagagtacatattatcttggggtggatatatatgtatgtatggctggtgcataacaacctttcccatacagcacacttacaaagatggatctctaatatatggcaatggctgtcattcacagattctttacactactgcagcaagtcatgtttttcctctgatatctggcattgtctgataaatgtaatattttcatttctagaatgcaaactgcagaccccatatctttgaggatcctttcagtatcaactctggaaagaaaatgactacatcaactgaccatctcaaacgaggcacaattctggtaaattaagacaagtgctatttttaccttttgctttccaaatgaataaaattgatatcawtcyagaaataaccatytgragaatttaaatatagatatttgataaaacggcaagaatactgatatgtatctctggacatttaaacaggactgcaatacatgtaaatttgctaccatcacatgtaatctcacttcttctgacatcagccaagtcaatgtttcgcttatcttgtggaaaccaacttttataaaagtaagtaaatacatagttctatgcactkattgaataatatcaataaatattcatttaccacttagaatatgcaaggcaywgtgctgcttttggaaagaatgtgcgactggaagtataagaggatgtgaccaagccccagctctacttaaccagctatgtgtgtctcatcttccttgtctgttaagaactaagatattaccaaggtcccctctggagagatatacttttttcaatctctcttatcctttttctttgtactttaagagataaatacctttccagtaccaaagcttgcacttatcttaatactttggaactcagttaatgtacagagtataataaagtggcaacccttgaccccagtaacaaaggaaagagctaacatataccatagacttactgtgttttatcagactgttattatatgtataattttataatatataggtatatatgaagccttttttcttttttttttttttgagacggagtgtctctctgtcgcccaggctrgagtgcagtggcacgatctcggctcactgcaagctccacctcccgggttcacgccattctcctgcctcagcctcccgagtagctgggactacaggcgcccaccaccacgcccggctaatttttttttgtattttagtagagactatgaagacatttttaaccccttataaagccaaatctgtctgacaataagctactttaaaactttttattgtattttgtattatttatttctcaggaagtatttagttgaacatatgactttgccatttttgaatttgattatagtaagttgctatttttatgtcattaactgttaatattggcaatttcattttttaaatttcaactttaattttagatacagggagtatacatgcacgagtttgttacatgggtatatttgcaggatattgaggtttagggtacagattccatcgctcaggtagtgggcataatacccaataggtagtttgtcagctcctccaagtagtccatggtgtctactgttcccatctttatatccatgagtacccaaggcttaactctcacttatacgtgagaacatgtggtatttggttttctgttcctgtggaatttgcttaggattatggcctccatctgcatgtatgttgctgcaaaggacatgattttgttcttttttatggctgtgcagtgttccatggtgtatatgtacatattttctttatccaggccactgttgatgggcacctatgttaattccatgtctttgctgttgtgaatagcactgcaatgaagatatgaccgcacgtgtctttttggtaaacagtttctttcgggtatatacacccagtaatgggattgctgggttgaatggtagttctgttttaagttgtttgagaaatctccaaactgctttccactggctgaactaatttacatccccaccaacagtgtataagcttttccttttctctgctgcctcaccattttctgttattttttgacttcttaataatagccattctgactggagtgagatggtacctacctcattttggcttttatttgcatttctgtaatgattagygataatgagagttttttcatatgtttgttggtcacctgtatgtcatgttttaaggagtctattcatgtccttygcccattatttaatgtggttatttgttgattgattgcttgctgagttgttcaagttccttattctggatattagacctttgtcagatgcatagtttgcaattattttctcccattctgtaggttgtctgtttactctattgataatgtcttttgttgtgcagaagctctttagtttaattagatcccacttgtcaatttttgtttttgttgcaattgcttttagagacttagccaaaaattatttgccaagaccaatgtcagagagggtatttcctaggttttcttataatatttttatagttaaaggtcttatatttaaatctttaatttgtcttggttagtttttatatatggggaaagttaggggtccagtttcattcttctgcatatggctagccagttatcccaacaccattttttgactagggattcctttccccattgcttgtttttgttggctttatcaaagatcagacggctgtaggtatgtggctttatttctgaattctctattctgtttcactggtccatgtggctcttctgtaccagtatcatactgttttgattaccgtagccttatagtagagttcgaagtcaggcagtgtgatgggtctggctttgttctttttacttaggattgctttggctacctgagctctttttttagatccacatgaattttagaatagttttttctaattctgtgaaaaatgatgttggtactttaagagcaacagtgttaaatctatacattgctttgggcagtatggccatttaatgatattaaatgaaaggttttttcttttatttgtctcawctctgatttctttcagcagtgttttttaggtctccttttagagatctcttacctccttggttagctgtattcctggatatttcagtgttttttgtagcttctgtaaatggagttttttttttttttttgagacggagtctcgctctgtcgcccaggctggagtccagtggcgcgaccttggctcactgcaagctccgcctcccgggttcacgccattctcttgactcagcctcctgagcagctgggactacaggcacccaccaccatgcccggctaatttttttttttttttttgtatttttagtagagatggggtttcactgtgttagccaggatggtctcgatctcctgacctcatgatctgcccacctcagcctcccaaagtgctgggattacaggcgtgagccaccgcacccagccctgagttgtgttgtttatttgactctcaccttgaacattattggtgtatagaaatgctactaatttttgtacccctattttatattctgaaactttactaaagtcatttatgaattctaggagttttttggcagagtcttaagggttttctaggtataggatcatattaccagtggaaaaaagatagcttgacttcttctattcctatttggatgtctttatttctttatcttgccttattgctctgrctaggacttagagtactaggttgaataggagtggtaagagtgggcatccttgtcttattccagttccccaggggaatggttccagcttttgcccattcagtatgatattggctaggattagttacagatgactcttattatttggaggtatgtttctttgatgcctgtctctacctagagttcttgtgctgattctttctcatcttgggggactgatgttcttcaactgtggtgtaagttgagtgtagtcatttgggtttgtttctggatgctttcagagggccaagtctctgtacgggatctttatttgtgggtgtatgctcacaggagtgtttattagcaaagtaatttttggtgttgttgtttgagctgtgatccagtagagggcaattaagggtaatgggcagtagataggctcttagtcttgccactcttgtatttgctcatgtttgcaggggtgctctgcagtgggtagggagaggcctcctccaatcactggcactgtacccatgtttcttttgttaggtgttctgggccacaggctctctcgggcagaggccatggcaggtagataggtgacaccttttccgaaccagccctgtggagggagtcatgccctactccagtgctggcccacgctggcccacgaatccatgtttgttacccatctcagtgctctgagatgggggctcctcccctacttgagtgccagccatagatctcagcttggtactcctgagacggacatgccatctctgggtctccaggacaccccgcagctcagagtcaggctctggttgctttggaggatccaaagtcctcccaggtcacagggaaagtactcaggtggggcgcagcacccaggctgggcggcagagactgcgctgtgcacatgctcctgtggggcagttaggcagggactctgggagggtctggcaggcgggagaggctgcagaacagacatgccccagtcccatggggaatgcctgctttctcctggcttgtggtcacctggggctagagcctctstgaaggagatggggagtcygagggratgggcacctatgtctgtgctctgctcacaaaagctcctgggctccatgctagctgaagccctgtctctacctgctccctgggaaaatccacctgccagctcacacatccattggagatgttgggtactctgtagcttagatcccagatgtctgtggcaagagtgagctgtccctcagtcccctccctcaccccttctccaggagccatttagggccaggaagtagcccaagcattcaggtaccctacgcagggttcccagcttctccctcttcagcctcagcatctgtgttgcctctccacacacttgcggtgttttctccctagagatcagatctgcccaaattatattatttacttgataatttgggatctcttagtgggagagatggctgtgtctagttagccatcttgtccccctagatcatcaatttcatttttaatcctaaataagtgcctagataaacttcatcaccagaatgtagttgtttcatgtcttgctacrttaaaggtaggcagwgtttgaggtttgttttttctaatgataaatcaatacaaaatatttttaaaattttttttcattccataacgaggatctaagtaaggattttcagtggcaaatgagggaggacaagtgcacggttattatttgatactaccagttccatttggaagttaacaaaactggaatttttaatctctcagaaaaatcttagcttttayaaatgtcctactcaaacatgactagctctcattttgattagcatcatatattaagaacaaatcctatttgcttttcagtcatatttttccagcttaaatcttactataaggggagracttcggagtgaaaatgcatctctggttttaagtagcagcaatcaaaaaagagaggtaagtgcaacatgagttttgaaaacattatgcatttcactctgaattttgtgacataatgttttataattgttgatagtcccttaagcagtgactggtattgctctcggtaagtgacagacactatttgcttcaaattatacttcattagcttcaaatgtgattttagtcttattcatccttgtaagacactgggaaaatcatgatatttacaattcacatgccgcatttgactttatcacttataactatcacggtaaatggatgtttttactttcactttgataacaaatgatgcagttgtaactttcctccttaaaagctgacattataaaatgcagctgatatctgaagagcagccgcaaaaaacaacttctttataaaaagtgcctttatactgtacaggaaaacatgtacattttttaaagttttctttcaaatttcattgagaaatttgaaacaaaaawgtgatggtatttcctaatacaaattcagacttgagtcctcagtaaaaatagaaaggtttgagtttttaactcttgtcctttttataaattaataagccaaggtgayggagtaagaccccatctctaaaaaaataaaataaaataagtacttgttacacatgcaggcacttcagcatgatctccccccttctcatgggagactttaaatatcccatgtggataacagcaccatgtgaatcataaaattcaatttggaagctccctaactttcagatgttctttttaaattgcttatttcaaatttttccaatatcaatgacttctgataagtatacgcttttcaagaaaaaggaaaatacatgcatataatgtttacttatgtcataaagagcgcttagcataagcaatgcaaaatgcaaagttgttccttacatagaatagccaacatttcactaaaacctaaaaaatttgagtatggtttatgttggaaaagtacatatgattcctaaatttatgtgttaaaattttataatgagttttattttccctaaatattagttaaaaattcccctggaaatatttattctacattcatcctaaaggaaaaattatatctatattgataaaattactaaaagtgatcattttgtaattgtgtgatctgaggaaagtcactgatcttatctagattccggtttccrtatctgtaagttcagggaattgttttacatatgtttaaaatctgccttgctgggcttagtggctcatgtctgtcatcccagcctactcgggagactgagatggaaggatcactttagcccaggagtttgagatcagcctgggcaaaatagtgaaaccccatctgtgttttgttttgttttgttttaagaaactgtcataatggtctgatgctgtatatgtctacattcttgccagctctgtcacctacctggagtgatttgagaggttttgattagtatcatgcatatacaaatctctcccctgttagtttctttttctaccctaatcttccctctaggtaaagaaattgagrtgttactgttaaaggcaaatacagggcttgaactattactagccattgatatctaccctaaattaatttttttcaaatcccccagggatgagacacagagcagataggtttcattgaggtttgagtgccaccctgagagagcttgagtagctggaacactaaaagcggtccattttacagctttgcttcagttaaaacctgatttatacatgtggacccagtgataagtcaagtagaagaaacattgtggtataatgaagagcacactgggagtgaatacatatgcaaacattcacttacccatacacttgacatgtatgcattatactttcaatttataaacaaaaaattatgcacactagaaataaaataaggagactttctcaggttcttatgacaacaaactgcgacattccaatctaaactaatgctattgtgataatacagtagtgtactaattaatctttaacacacataatactttggttctccctgagttaaacagaaattcactcctccccttgagcattccaatccattgacatttaaccctttatgtataaatttcagaaggataatattataaataccttttggtaataataaatttgacatagttagagatttagactagatgaagagcattttctaatgtaaatctratgttttctcrttatatagtaacgagattaatgcactggtagagaattgtagcctgcaagaaytcaatgttccaggagttctaataggtgtttattatgttaacaatcttgtttaataattttcagcttgctattcaaatatccaaagatgggctaccgggcagagtgccattatgggtcatcctgctgagtgcttttgccggattgttgctgttaatgctgctcattttagcactgtggaaggtaaacaccaaaattcctttgactctctacttcaatcatcaacagcaaactggagaaataagctctgatmtattcagactatgtaatatagtattattacagcaatgaaacaaacgttgaaatgatgactaagggaaagaaaaaagaaaaatgcgtatttcaaacactgcacacaacttgacccaatttttgtaaaggaaaaaaaacttattttragttagaaatagtcaaaaattcacaaaagtatctttctagagtttagtatgataggggactttcacatgtgtaacaattaaaattttataataagtatgtatttcttttataaacagagaacaatgaaaactgtcttttatagagaaagaaaaaatgaattcctatgtcaatttaaggatatataagcagtagattcaaggttaaaataagccttgttttaatcacatctccatgtgtcttaaatatcaaataattctttaatgtttaaatatatatggcacattttatgtaataaattgtgtgcctgagtggaggataagggatcagctgatgtaggggagatcttaaagtttcacagactcctatttcaaattctgtggtaaatgtgagtaaccacctattttgtgtcaagtaactctggatatttatgtaatgttttgcttaggctgaaatagacatgatttttaaaactcttagcagctgtataattttcacattaagtagaattgagatgacagcttttgggataagttgaatagagaataacatcccatacagagttgaatgttttttcaattaaatatcaaataagcatttattctagcataatatccccctagattttacctattgttttgttaaatagttaaattatgttaaaaatataggttgtggctacatattaattgttctattacctgagcaacataattatttaatcaaatagtttaaatagcaagtttctctcccactgaaataccaactgttcctatcctttcttactctcctatgactcacttcctcttttgaggggcttagtctcagaggagatggtgaacaaagccagatgtaggtcagtggcatttaattcagtaaatagaatccatggcttttctctagcaaagttccccaaacaaaattctccactatagccaatgtccagctcttccttctactttataagggatcagtgttctctctgtaatacctagctttgccacactgtggtacccaaggcctggcttattggtgtcaaggttgtacttgaaatataggaagtggtttcttcatttctatgcacctctaatagagagtgttactgttgatttttttcagcatagtcttctgttctcagcactgcacttacctctatggttttagaacaccgctggcaggagaagaggaaaaccagagctgatatttggataggttctttcaggccttgtacctctgtttcagacaaacaaataggaaatttcagtcacctatttttcagtcagtagtctgaaaaagcataaatgtaaaactaagctcattgtttcatccagataatgatgtgttgatacattctgacagcttcttaggttattattaatattattattattgcaggcccaaaagaagatcatttgacaaactttgggctgtcttacccggtagaaatagttcagccacttcattgggaggcccagcaatcagaactgtgattctaaggtagaagggaagaaactagctcttatcgaatgcttactatgtgcagggagctattttaaacatttctgctttaagcattcccacttaatactcatatcaaccttatgaggtcgtatgaacctcctcttttaagtgargaacataaaatttaagtatatttcccaaagacacatagtgagattcagagtaaggatctgaattctgtgccaaaaccactgactattatcactctgtgttctctcttgcttccattcactctggtgtcctygcaacaatcttttcgaccaagtattttaactacattttacacctgaggacattaaagcaaagggaggtaaagtgactctcccatgattactagctagtaaatgactggattcaaggaatgatctacagagctctttctttttccaatatatcctactgctgcaggctatagggtagggctctttactctggagctccaggagttgggttttgttcaagagagtcatgaactctcttaaacacataatactgtctttggttttggaatgagggtccctggttggattcagactttcggtagttccattatatcaagaaggctaatcccacttccccctactttaaagttctgttggaagctgcctgaagcatgagttcagttgcagtaggttcagaagagctactcttatcccagacatcttttttattctaactagatctggatcagacacctcaggactatcccttcttccttcctttcctgaatcccaccagtttggagttcattggaactcccaagtctgagtctctgtgtaagagacaggccaaaagtttctcttagagcagagattcactttcaaaagacacagtctttatatctttgtcttcatcatacacatggcaaaaattaaagcttgacaaagtgttagtagctgcttaatacacttcatgattgatgggaggaatcttgtaggggacgtaggtttaaataggtggagaaacttgtcctgaactgtggtaccacatgccgggggagatgccagcacaccaggagccatgagagactcagaacattcctctctcctaacttgatgtcataatgatgcctgaagttcctcaactgatgatttatttattaatcytaaagctttattcttcatccaatatacatgttctgggtgggtgtggatggggactggtgtctcaccactttttagtcttttatayattagtatgaatttattcattcagcaattattccatgttatattcattaagcacttacttttctgacagttatcacctcattagagcctttgccatagggttttgaacaagggatcatgaagcaaacacaggaaggaaaaaatgaaagccagtgctgcaaagaaagtgttggggctgaaaacaaactctattggtttcaaatttgggctaggattggcccagtccatcttgaagctataaactattttctcctaatctccactctttgccactcaacttctcttaaaaacccatgttaattggttgggtggagtgcttagataacagaagttattttaaaatagaacatttaatgtgtagaagccaaggagcattgtaaagaagcaaaaagagctgtgagagatcagaagcaaagcagagtgggaaggagaaaaagtcttagaatccaccacctgcttttgtgaaagccttgtctgtttatttttgactcaggacatgcaggcacaagttaagaagcctaatggtttgtgaatctggaacttttatacttggctcatatgaaaaagcctgagacgtgtaggagagctggcatttggggaagaaaaacttattgttttcatgtgtatttgttccgttaccgccttttcttcatctaccaccaactagatgatggcataatagaagacatgagccctgaataaaaattttccaacctaaaagtgcatatttttgagggtttatcccctctaagccctcagttgtttaataattattttataaacacatagttccctggcataatttgccataatttcgtgattaaaatgatgtagaggtgccacacttttaaagaattaactcattgcctttgctcgatctattatagccccctctcaaatttaaaaaatatatacaaatttgaaaaatcacttacctatgacccttaattttctttttttaaaaataagcattttaggttagataattgcaaagatcccttctatcccccatacttarttttgttattctataggatgggaaacaattgcagcacttatarctttttatgatgccccaaattgcaaagcataatgaaatatggctcaccatccaccacgatgtgaaatttttcttatggtcaacaacttcattttttatttccaaatgatatagtgtgttttcaagaggctttttatatcaaatctatataagcagacgtcctgatgcatttaaagttaatacagacaactcagaaatctccctaacgccctagccataatatacctgtcagattccctaccatctctaatgacctcaacttatggtcatcratcattygatggaaatttctctgccacatccctgaaaaaaaagatgatggcaaagaagagacaatgctagctaattgcagtttgtctcccaaaatattttcccagaagcttttaattagttcaatgtgtatactatattttactaggggtcatggtgtatttaaccaatgaaaatattaaaaatgaaacmgcggcccggcgcgatggctcacgcctgtaatcccagcactttgggaggccgaggcaggcagatcatgaggtcaagagatagagaccatcctggccaacatggtgaaaccccgtctctactgaaaatacaaaaattagctgggcatggtggtgcatgcctgtagtcccagctacccaggaggctgaggcaggagaatcacttgaacccgggtggcggaggttgcagtgagcggagatcacgccactgcactccagcctggtgacagagtgagactcgtctcaaaaaaaaaaagaaaagaaaaaaaaaagaaacagcaatttaataaatgtcattttttgacattgaatattaataggtcaatgagaaaatatttcttaattatattagttgtgtgcccagcattgccaatatactattaaatttaattctatccaaaggattaatatttgctacctaaattaaaatagttaattgtgttatgttttgtgttttctcaacagattggattcttcaaaagaccactgaaaaagaaaatggagaaatgaaatattttaygaaagaaaataataacaattattcaataatctatcctcaggtttgcctcaaatatgtgacaagaaatgtataattcatgacatagtcatgtaactatgtaatccatcagggattcattacttggaaaatgacaggtcatgcattatccaaaaacaataccaaaaagacatattttataaaatgacaaaaaatattttacataattactcatttttgttgagtaagcaaaattacaaagtgtttttaaaaaaacctgtacaaatatgtttatgtattaaatcaccatccaaaatatttaaggaatatataaaaagatttttatgatcatagaaacatctattttcaaaacaatataaattaagcttttccccttgattcctgttggatatccatgttcagcatgacagtcagcactcgtaaatgccaagaaaagaattacctgaaaaagatcatttctccctattcaaatgagaatattttccctyggtagaatccatatacaatatggattgaaaattaagtcacsaagaatacatttagcatctttgtgttgggttctatacctaaaaattttccctccctgcccaaggtgattggaaagtactgcaattgrgctaaaattttatctaggatggaaaatcaggatagactcgtttaaaaacaagtatattaaatgggttaaattaagcttttacagaacatgcttaattttgatattgagctctaaatgcaaaacycttttatactgaaaaaacacttaaagyagttttgtgtggcatcacagtgatttgtcatgaaaagccatatatgggggacatgctaaaatggcttctgaatgaaatacgacagcagagaaagatgccactgaaatgctgaaattatctttgctgagcagcttttgaatgctaagggttccagtatgtgacccaaagaargagttgtctcaactccttggtacagggttcattcaaacccccaagctgtgagagtgtgtttatttttaattttttaaaaggtatttaatttccaaccacacttcttatttttttgaaaagacaattttccatttcagtattacattttaccaagaagtcactgctttttaggtgtgttgcatcaatatttaaataaaatcccagaaatgtattttaaagaatttcaggtttgaaaactcaaaccaacagraagatatcacacctttgtatgtgcttctttgttcttgaagtagtcattatggttcattggaatctactgtagcataagctcctaggttgctccatttcttaggaaaatagcaatgaatgaatgtatagtagytgcwtgtgtgaactactgctgtaaagtttgctgacatttctgcaacaacatttctccatctgatttaccagaacctgtaacaagaccagaacatgtattyatccagaaactcctgggctctgctttgttcaaagaggagcaaatccacatagaaattaaatgttataaatttatttttttaaactaatttccaaagaatttagctgaagactcagagtcagcctacctcttgactctccacatcygcatctaagatcctgaaggccaaaggaatgygcctgtgggatgccaaagccatcagtagctggaagaaagaatacctctttctagaggtttggtgtcctcttgctggcctgtcattatttggaaatacgcgcttttggaatttccttcattttcgctatttccaggttcagaaatcatacctaccacttgttctttctttgcccagtaaaactcagggtttctcttattcagagttaccatgttgcacacccccagtgctcagcctgcccagaagcccttctctgatctcagcaagatcttagtagtaaagctaacggatccattgaaattcatactcagcatctgtgactactagacaaagcccatttactgaaccataagtgtgcacttttaaactaaattrttaactgaaagggaaaaaatagaaatgagggcattttgaagtttttagaaaagagaggaagagctgttggccagatcaaagagatacttataagcccggcacaatttttaacataagtcattcctggctattaagtaaaatatttcatgaaccagaagtcctgtttctctaatattataatttgttgaggtttgtgtgtgtgtgtgtgtgcatgtgcagacacatgtacacatataaattgaatacaaaaatagctctataacaccaaaaaacagagtttacagaaaataaacacaaaagctatatctgcaagacaagtttgattcatctagtttcatatagtttcatatagtttcatttttattaatatttaggtttaacttatagttctgcaattatttaaaaaacaagtacagagcgtttgattaaaaaaagtcaacaaatgtttcaaaacagctttgtacaaatgttataaaacatatttaatgattaagaaatgtactagactctatcatttacttttaaaacatttaattagaaaaacaggtgatatttaagactatttataaacttattggcyaaattgccaaaaagtttctttttctctaactttggtattctaaataattgattattgctcccattgtaaactgaaccatgtatgcactctcttttctgaccaaactacaatggtatattggtaaattatttaacaacacactgtccaggagggaaaaaaaaaacagtctctgatttgtatcatttgccaatttccatggtccaaatattctctctccattttcaaactaccaaagtgaccctaatcagcttacaaaattcctggaaatgtatctgccacctcttaccaaccagtgtgagctgacttcagcacaccactgagacagattacacgatagacagatagatagatagatagatagatagatagatagatagatagatagatattgatagagaacatgttgtgtctatatamatatccaatgacacacagtataatcatgttttaaattatgccaaaagtactgattatatcaagcccagtaaacataatgctacacagcacccattctttaattttgatttctaaaattataaccttcctttgatattaataaaatgttatgaacttgcaggagaaggaaggagttgaaagaaggaaaatataaagggtgatccacagtgaaaatcagacctacacaagccacaaaaaaattgtctcattttcccaaggaattcaaagtcctgtgatacacattacaaaagatgacactttgtaaatattttgaacttctatgatccaatttcaacttcattggtccaatttgtcaaactattttcctctgagcactagattcatgggcaatttaatctctgaatattttctgtgtcataagtgtgcttgaaaagaggcttgtagtaaacagatatttttacaaaatttgatgcttctgcaaccataataattttatctataaatgcgtatatacatatatatatatatatwcacatacactcacatgcagatatttacatatatagatattctcttttccttttataaaatcaaagtctaggctcaattggaaaatggaaatatttgcaccaaaagaaaaaagtgccattgttgtgatcaatggagtaaagctggggtatagtagaggctggggaakccctgcccatgttctctccaaggccacagcttgcacaccgtgaatggtggccccactggctccatggagtgtgccttcacgcgggggaatgtccttgtccaacacgctgtaatctactccatgggaactgactgtcctgcttttcacaacattgagaaacaggcccagagcctgtctcatgtgccaggtgcagtcacattattgttaaaataaagtggcttctgacaaatcagttyttcaaaatagcatcctatgtacttttcatttcttccaacaaccctcaggcccccttttgccagttttctcccccaggggrgattttcaagactactggagaaaaatctgttaataaaacatttgctctgagtaccagcttcagtgactcaatcatttatacaggatttcagtgttttgttctgcagcggtgttctaaagggttcacatagtataatggaggagggacaaagcagaatatacttccaagctggaacatctttaagacatttacaaactgttatgggacactatcagcaactacgcctgkggaagctagcaggatttagctcttcaatggccctccaaatgcacccaacaatcgccaacctcacccatggaaatcatctaaaaaatgaaaagaagggccttaaagtcctcacatggatgctgtatttataactaaaatgtacagtttaattctaaatagcaggcttttaaatgcaaacagcttccaggtgagtcctctggctgccaatcagactgctgattctaaaccattctcacacagaatttctgaaaccaacaccaggtattaattgttaactgcagtgaaaggaaaccaaggcacattacaaaaggctaaatgctgctgtttctaagtggaagcactgttgaacaacactcttaggtggaataagaaaattagggttaaactgtaacaytgtaatcggacgaacaaatcagcatctttgatcctcaggttaaaatttaatcttaaatttagaaattcaaagtaacagcctttaaccattaaccttgaggaaaatgtgaagtagcatctggagtctcttaagccccagccctgttgtcccctacagcatctccacccaggaagtccagttcctaactaatgggaatggatccttttcccattataaagggccgatgcttaacccttgaacccactactgttcttatgccccaagatctgcaccttacatcaggcacccgggaatgcttctcattgaaattttaccataccaaaaaatatgtaagggtgactcatcacycctaactttggactccttgctttgagatcggtatttttttctctctctttacatatagcaaaagctttccccagtagctgatgaatttagaactttatacaagactccctagcattttcctcctcccacaggctggagaatttcagtgctatsagactgggcagtaggagccagagccaatttgcaggatctcttttccttctgccttccagttggcttctcttctcagctgcgtggtggggatgatttggggtttcctcagcaaggccattctctgccttgtgcccatagcagggccttgggtggtgacatgttatctttgttggtgagcagacactcagagatcctttaattatctgacacaccagggaaatcttggcaatcaactaaggacctgtgacactcataactatgwttacatttggctttagcatatttcaggtaatatctttatgaaaaaaagatgaagtatggaattgtaggaactcttttgcaatagactgagatccaatgtttaaatctttttatttcagtttgatctgtgcctttagattggggacaaaattttaaaaacaaatcttccaaatgacaccacaatgaaagccagttgtggtcttgaaaaatctctctattgcattacttatcctcacccttgttttttaagaggtagagagagattactgggaagcagtkagccaacataattgtcctttcctctacagaatagctgtgcagaaggggaccaccacacttaggaccagtgccaggtgacaatctttcygtcatgctgctgcagcattttgcaccttgagagacaggaaaaaaaatgggggtgagggagtggaagatgatgaaactatttctcttttatgtctacatccttactcctcaaaatactttaagctcactcagaccccatataccctgcccacaatactaacacatgtactttgcataagtaaattgttgattaaataagagcaaaactatattcttatgtgtagattaaccaaggctaatttcctggagtttaatacactttggattcaagtaaaaacaatcacttaatgcagcaacatctcagaccctcttcactctagaaccrttttatacaagagaactcaacatttactgttttatttctgatattgcctgccattactcaggatgcaagagatgctctgcattccttattaggaaaaattggcctgtaaggagaatggtatactgygtattactactgtgagactgtaaaattgttaatggacagtgtaaagaattgtattcattttattagcaagaaaaatattgcatacaagaactactgccctgaaatatccatcactccaatgaactgttctgcctgatctaacataaagttatatttcattgctcatttttttttgcctcactaaaatgactaacttaagggaatgtgcatttctacaagactttaattggataaactcattagaagaaaatgtttcgattgcattcaggaacaaagaagcataacctttgttgactcttgtaatttattatatgcttcatttaaacccattttgtaaagaaatcaggtaacagtcatttaayctgatataattagaaatagctgagagagtaaaaaagcattttgaatgtcctatgtatggcatatcctgtacaccaattgaaggtcagagctttggtatttttgtataattctgtcttatctggtgcatcagctgtgtattttacgtcaaggtaaatgagcatcctgttttatatgttaaattttaaaaatgackttttcaaagaagaatgtgattgctgtgatttttaagtgtgtatattttttccaaaattaatgtgacttcttctgaagctccgaccttttttttttttttttgatgctttggcaggttttcactctaatgctctaaaaggaaaaagcaaaaagtaaattaagtctgtctgtggtgtttcctgtacaagatttagcaatgtgattagtttttttgtgaacttgagacaaaaaccacaggatctataatactatatatcttcttctaatgagatgttttaataataaatagtctgcagtataaacatagattataccacataggtgatataaaaaaaatcaagaaatttaaacgtagttattttctttattcaatttatactttattatataaaattatttaacatattagggctagaagaaaatacaggaagaagttttagtaaaaataacacatggtcatcttatttaaaatttcaccctcaaactatgctgtggggtgagtgagaagctattgttacagaagacacagactgaattatgaaggggttatttgtcaggtcatctacctaagttttggcagagcacattttcactgccctatcttttctctcttactgtaaagtaagtgctttttctctctcttcaccccttatccaggaagagaatacagtggagttactaaggaagaatctggatatattcactggaaaataaatggtatacctcaagatttattatttgtacatccagagaatatcacaacatttacttccttaccttcatttactttgattataaaaataatgtgatccgcataggcagatgtcaagtgtaatttcaccaaacagaagtgatcatgaattaagaagactgaagattatgtctatttattctttataacagcaatattattttaattgcttaaaaatatgtgaatattaattgttaagaaaacatttatggtaaaagggggatgtatacacatgtagataatttgaaaaccacaagaaataattttaaaatagccatcataccagtaccagaaattatatgctaaaaatcataaagaatatagtaccctgtacttttaaaaactataatattatatttcttaatttttctctagtaaaaaaaggatgatggtcatcaaatactttcccttgctttgaagttgacaataaggaagaaaattacccactcgcctccttctccttctgagccaataactgctatacacatacacatacacatatggcacactagaattctccatagtctgcatggagaataattacttctttacctacttcttcaagcaaaagtgggatggggcaaagagcaaagagtgatgggggaaagatgggtaagataatgtcactaagaatgatagcatatttggccttgtttattatgcaaaccaactatattattttattaataatcccagagaaagaaagaatttttgccagaaacaaaagacctggcatcattacaagcattagcaaaaaaaagacagtaaataaggaacagaggaacacatgagacaggagacatatagaaaacaaacagcaatatggcaaatataactctggccatatcaataattacattaaaggtaaatgatctaaacacccaaatcaaaaagcagagattttcagactgataaaagaataaagttgatctacatgccctctaaaagagaaagactttagcttgaaaggtgcaagtgggttgaaagaaaaatgatggaataaaaatacactacgcaaatagtaaccataagagagctggagtggctatattatatcagacaaaataaactttaagatgtgtctagttccaggcataggaagattctaatcttgtgaaggagacagggacccatggaaatctgctaagcatgtagatattctagatttttgcttggattgactttgatgtcctgtagattttcaaggaccattgacacctgaaataaaactcggatgaaggaagaatccatggagtcaccccactttgaaatttgtcttaagttcatgtgtagggggatccctaacctacacagattctggttgccatggtctaattgctaccccagtggcaggaataatagaacaggcatcatagtccataggcacctaggcttccaagcagttcacagattttggtcatgtgccaggtctctagttagtacttcactggcaagtgctggcttgaattaataaaagcagcattgaaatatctgtgggttttgtctttagcttccacttcactcagctatttttttgtttttgtagtatctttcaactgattgtgtggcatgaattcatttagataccacaactcagaatggcattccaaaggcaagagtggaaatgtctcaacttggtaaataaaaatagcaaccagattcagccatcagacggtaattagtggagctggaagctagccattccaaggactaactatccttgataaaacgcccaaggctctttagctttgcatgctcaatctctccttttctgttttcttccttcctttactcagatttttctattctatttcactcaagtaccatctgttattccttttcacacacttttcagacccttcttttattcctgcccattctgcatacctcatcgttaaaaggcgggtaattctacaaagattccaattagtgtattgtttgacggctgatcaggttttcccccttttaagatgaaccactgaataaatggtgtaaagaatgtagtcttgtgttgccaacatcttgtcagaattttttttgaagtttgagttcactattgtccacttgagttgccattaagcataatgtatatctctgtgtgaacatgtctgagcccatatgtgagcaaacacgtgaatgaagattgtatttttagatggaaagtcatttgaattctgaaagtggcaggacatgtaaggcagtaatacagggaaagtaggtagttttgaatgaaactgatggtgactggtgaagtctcccaattttctatggggaggggaagaaaggtaagagactaacatttgttgtctgcctcccacatgccaggcattgagctaggcaattttccaacatcaagccttttaatcctatcagcaacactaaatggtattattattattattcctattatacagatgatgtaattgagacccaaaggacctaaggagctacttcaaggctataaagctagtaagtagtgatgtagaaataaaaaccaagatctatctgagtccgaagctgcttccccaaggacaggaacttgagaggaagtcactggaagagaaatgaaaacacagaggtagaggagaacacacatctattttggtagtacttggcacatagtaactttcagtaaatatttgtttattgctgaatggatgcaaaaattgatcaactatattagtcagagatctccagagacatagagctaataggagatatatacatatatatgtgtatataggagagatatctatcttacacacacacacacacacacacacacacacacacacacacacacacacacatatatatatatatatatatatatggagagagagagattataaggaactgcttcacatggctatggaggctgagaagtcccatggtctacggtctgtaaactagagacccgggaaagctgatggtatagttccagtccaagtctgaaggtccaagactaggagaactgatgatgtaagtggtggaagaaagctggtggtgtagttctagtccaagtccaaaggcctgaaagtcagaagtgccagtggtataagtcccagtccaagtgtaggagaagactgatatcccaattcaaactgtcaggcagagagagcaaattctctcttaccctgccttttgttccattcaggcctccaacagattggatgaaggctaaaaacactggccatctgctttcctcagtctaccaattcaaatgctaatctcactcagaaacaccctcacaaatataaccagaataatgtttaaccaaatatctgggcaccctatgtcccagtcacattgacacataaaattaatcatcacaagtccacctctgtcaacttgtcacccatacacatctccttaagccatacttaacctcaaaataaaggcaataacaaggtcataatttcaccaaacatgatacaattatcctgcataccactaaaaatgcactaaccccttccccagaaaaggaggcaaagtctttgaaattcactcttctccttgatgtctagtaactgaaatactatgattgaaaattaacaatacttaactatgatataaagtcaatacatctgcagttacatgacaaaagaatcagagagagtgaaaatcaaagatattttcttaatacgtacaaatataattatatttaaaacatattcacattctaaacaaaataaggaggactattcataacaattacagtcctcttttttttgtaactggtcacttgtagctgatacttacagctaccttcttccactagccactctatgttccttttcccttcagcaagctccttatttggtcatggttcttcacctggtagaatgacccaaatcttcattcctgaagagtctgagccattagtagtccttcctggattgggctgttgtagctttccattgattataatcacaaggtaaggtaatactcagtgacacactaagggatctcttggaattcaagcatgttctttcttacctcaattgtggagtagcagttgaatttctcttctgtagcgaggatcagccacctcacccagtataatattataactcacttctttgcctattgattcagagtcatgagaagctcaaaggggccaggtggcaatcttaatttccagttcaatggaatcatttttgtgtctcctggtgggagcattcttcccttaggaactgagatccctaggccaccagagcataaggttatgagaacagaaagcaaaaattttgttagtgggtccctgcgggtaatagtgagtggagtcactcctatttccacctttgattcctggactcatgaatcctagttattggagaaacagcaccatatactggacagtgattcagagtatattcagccttgtagagaatcttgtccatgccctctgatgtactgccacctagctggtgctatagctgagtcttcagaaggacattccactgtttcatcagaccagctgcttcagtatggtggagaacatggtaagactagtgaagtctatgagcctgggcccactgctgcacttactttgcagcaaagtgagtttgtcagtcagaagcaatgccatggggaataccatgatggtgaataacgttttatagttatatttttccagctcacttacatctctttggcaaggaaatcatgaacatacaaaatgatcactaatcatagacttgaacccttggaggcagttgaaaaatcacccagtactggaaacttctttacaacatcccaaacagtgaaacctggtctatgcttgggcactttcaaccgtaaggtcctcagtatcccagctgtagcttctgttctgcttttgtgaagcactagttatttgaaagtatatctttcatttcaaattctaatatttgctatgcatcaacaaaagtctctgtatttatgtaagtgttctttaacctattaagtataacttagggcaatgagttccataaacttactacctatcgtgcaaagtaagattttatttaatttttccatttccttattaatttaagatctaaaatcgcctctccagttaatgtctctcaatgtatttaccctctactaactgtcagaactctcaaaccagtgttttcattcatccaaaacataaagaagcagtattagtagactgtaatattaggataaaatatagcaatattagaattattactatatagccgggcgcggtggctcacacctataatcccagcactttgagagggtgaggcaggtg

SEQ ID NO: 17647 - DNA, 16933 bp, Homo sapiens
ggacttggcagtgggggtctagaatcccaccctatccccaccactcatcatcgtgaccctgggagaggtgcttggcccctccagtccccagcaacccaccctcccataatggaaacagaagagtcacccagagcctcctgctgctggggagaggaagagaaaggagggtggggcagggctggcctgggatttgggggacagtggccatcctcagggtggaccctccctttcccagcatcttcctcagctggagccgctgggcaacagcccaatgggcctggagagagctggcttcccaccgggcctgggatcggacctgcagggctgtgctgggcctgtggcrtcagcggctgctgcagtcacggctggtggagcggtgggcccaggagcggggctggcggctggcacgagatgccctatgccactggcactcctgttggcagggtgagtggagacttggtcgggggcactgcgggtgagggcagggccagggtctgtctgagacccagactgcagccctggccaacaacttgactgtaaccgcatgggagaacttgaggcagaggctaagctacatctggactcctgacccatagaaactgtgagataacaaacatctgtggtttaaaactaataagtacttgggtaatttgttacacagccatagctaacaaatgcagttgatcagagaggtccgctgagctgtgacactgacctagctgggttcaaagaaaacaggctgaccaactcttacacgttgtgctatgaatgagcaaatgaatagacctcagctgtgaaatttccgagagggacagtgactctgcagagtgcctcaccaccccccataccctcccatcccctagcaaattctggtgatgagacccccacagggcacacccaggagtcaggtggcagagcagaacctgggggcttggactctgtagtcttgagtttgaatccctgctcttccataccctgactgtgtgaaacttaaacaacctagttaacctccctgagtctcagcttacacatctgtaaaatggggataatgtagtccctatgtcatcacctttatcttcatccttatcctcacctggcctctaggagtcactggtcggagccctgagttgggagagaagtgggcagagtcatggtgcccttaggggccagcagagttagtcagggagggtcccaggaggaggtgaggagggctcagcgggcagagcagtggcgagagaagttgaggcgtgggaaggggtcagcaaaatagggcagtgggaaggactggatttgcagaggctggctgagggtgcagtgtgctagaagccctgaggaatgtggccagtgaagggaggagggatggtcccaaggcaggcttgctctctgggtcttggcctctgggcaaaaagagctgttgcatggcccaaccagtctttttttttttttttttttttttttgagacgatctcgctgtgttgcccaggcatgcagtggtgcgatcttagctcactgcaacctccaccccctgggttcaagcaattctcctgcctcagctcccctcgtagctgggattacaggcgcctgccaccacacctggctaatttttgtatttttagtggagatggggtttcaccatgttggccaggctggtctcgaactcctgacctcaagtgatcaacccgcctcggccttccaaagtgctgggattacaagcgtgagccaccgcacccagccccaaccagtctttttataacctgatatcagaagtgacatcccattgcttctgccaaattctgtctgttaaaagcaaattagtaaacccagcctgtattcaaggcggggcattgcccaggacacgaacacaggatgctgtcttggaggctgcccactacaccgacatatcgcattaatgagctggcaggcagggctgtggtggttctagaaagtcatgtcctgtccgctggagacagctgcttatgcagcccaatcattccccggcaggaacactgagccagtgtttccagaacttctagtttttacagaaaaattgaaaattagatttttgggccgggcgcagtggctcacgcctgtaatcccagcaatttgggaggcccggactggcggatcacgaggtcaggagatcgagaccatcttggctaacatggtgaaaccccgtctctactaaaaatacacaaaattagccaggcgtggtagtgtgcgcctgtagtcccagctactcgggaggctgaggcaggagaatggcatgaatccaggaggcagaggttgcagtgagctgagatcgggccactgcactccagcctgggcgacggagtaagactccgtctcaaaaaaaaaaaaaaatagaaaattagatttttacctgaattctccagatttgaaaatactgtggcaaaattaacaaacaaaaacaaacccaacaactctatgagctgggctggcctggtcaccagcaggacacccataatagaggctttttaacccagacagtcagggtggcctcctgtgttcccacctggtagggggcgaagggctggctgcgtagaggcccatggggagaggctggggtgagcacccagtggctcttcagcatctctctggccccagggcagcagttcctgcatgaaaagtgccagacatgggtgcaggtccacctccagggcctgcagaaggtggtgttccggagctggcagcaggcagcagctcatcagagatgcacagtgacccggccagagcagctgctactgcagaggtgggtgggcctgggggtgggagggtgttggtcctccccacgcaaggaatagcaaggagagcacccagggggtgggaagctcagacggtggcccagataggaggcctgtggcctgggaaaaaaggggcatgaagggagatcctagcctggaaacacagggccatgaccactgacaccttattacctattttgggagtggtggcaaaccccacccctaacctgtggccccaacaagccccgggagtccagctcctggccaggtcagttctttggttttagaggatatgattaagatgggagaaatcagctgggaacagtggatcatacctataatcccagcactttgggaggccgaggaaggtggatcacttgagatcaggagttcgagaccagcctggccaacatggtgaaaccccatctctactaaaaatatgaaaaattagacgggcatggtggcaggtgcctgtagtcccagctacttgggctcaggcaggagaatcacttgaatccgggaggcggaggttgcagtgagccgagattgcaccactgcactccagcctgggcgacagtgcgagactccatctcaaaaaaaaaaaaaaaaaggaggagaaatccactcctcggaaatctaccataacgcccattgtgaggagttacagcaaggagaattctgctgtacactgtcgctaagagaagagagtgaaatcttcatttaagtaaagatgttctggtggaacatgtatacagttcatgaatgcatattgtaaaaccaagcggaggacacagaatggctcctcccacagttcagtacaaatttgcgaatgttcagtgtccccgtggggcagtgaactgttggctacagaatggctgacgtctgtgcttttgcatctgagggtgtagatggttattttgtttgtttgtttgttttttgagacagagtttcgctcttgttgcccaggttggagtgcaatggcgcgatctcggcttaccacaacctccgcctcccgggttcaagtgattctcctgcctcagcctcccgagtagctgggattacaggcatgtggcaccacacctggctaattttgtatttttagtagagacggggtttctccatgttggtcaggctggtctcgaactcccgacctcaggtgatccgcccgcctctgcctcccaaaatgctgggattacaggtgtgagccactgtgcctggccgtagatggttttttttcttggcttctcactgagtgagagatggtgttcctctccctcaccaaccacctgggcatgtgatgggaggcagggcatggctgatgtgggacttgaacccatactgctggttcccatccccctcgcagggcagcccctgccctctgaggctgaggttgcaagatggaaagccagtgctttcacctgttactggtcgtttactgttttgtgggagatttgcaagtgtaactttgaataaatgtgacttttgactctgagaacgagacaagccctcccatgcatctgtttttgttttgtttttttgagatggagtttcactcttgtcacccaggctggagtgcacttgcgcgatctcggcttactgcaacctctgcctcctgggttcaggcaattcttctgcctcagactcccaagtagctgggattacaggtgcccactaccaggcctggctaatttttgtatttttaatagagacggggtttcaccacgttggtcaggctggtctcaaactgacttcaggtgatccactcaccttggcttcccaaagtgctgggattacaagcatgagccaccacacctggcccaatgtgtctgttttgcagctacttccaggcctggtgtgaggttgtaagagacacgggggtgctccgggcccagcatcaagcctttcaggatggcctgaggagaagagcactgggggctgtgtttgccacatggcgggaagcccaggaagtggcagccggggcacaggagcagcgtgtggcccaggcctcccttgcccgctggagaagctgcgggcagcaaggccaggaagatgggcagcagaagaaggcccgggccccacaggccttcccagcatggccagtggccccgggcatgcaccatgaggcccagcagcaggcaggagagagcgctggggcccaggcagcccagtgctggacttggtgctgggctctgtgggtgcatgagtcctgtcggggccaggtcagccgagcccatgcttcctggaagccgcgagcctggtgagtgctgtggtctaagtgcagccccactctgtgcttccagctcaggcctcaagcctgtttttggcaggggtagagcgtaattcatggctgggtggcagggcaaaggctcaagagggtggttgggggtgacagggagaggccgccctggccatctagtcctgggccacatcctggcaccgcctcttgctgtgtgtcccctccttggggaagtctctaatggtcatgccttgcagtcaccagcacagccagccactcagcaagcgccataaacgcgctcttgccagggaaggggaggcaaagtggcactggcaggactgtcccctctctgcccctaaacaggatgcttgtccccgtctgtgattttctccttccaggtcgctctccatcctgtttacccagattctccctccagaaaagggagtgtgggaggtgggtgggccccagcctggggctgggcccagaaggccccctcccgcagggcactgggggggctccctgcagagagtcctggccttgatggccctggctgcagactccttcctctcccgcagggtcctagaggcctcggtgcagtcggcggtgcgcggcggtgtccagcgagccatcctcacccagctccggccggctgagctcaggcgcttcctgcggacagtgcagctcagggtgcggctgggactgccaggggccggcaaggtacgccccaagccccagactgacctcacgctctggccccggatggccagcagggggagcctgctgctggacgccccagccccttggaaacaggtgaagggagcctaggcagggcgggaggtccaaaaatgaccctcggaccaccggccttagaatcagcttgattcagcccgtggtggcagcatggctggatgcctccccaggggcccagcaacctcgtatgcaccacctctccccagttctcagtcagcctctgacaagcaactctgaatccatcagcaaagatgaacctggcacctctcgagtgccaggccactgcaggtccggccgcaaagaccagcatgttgggtcacagcctgttagggagacattgaaatgcatgctttctcacggtgcagttgaggatcagaataggtacacgaggacagtagcatttttttgtcaagtttttttgtttatttttgagacagagtctggctcaattgcccaggctgaagcagaggagtgatctcagctcactgcaacctctgcctcccgggttcaagtgattctcccgcctcagcttcctgagtagctgggactacaagtgcacgccaccacgcctggctaatttttgtatttttagtagagacggggtttcaccatattgcccaagctggtctcgaactcctgaactcaagtgatcctcccacctcgacttcccaaagtgctgggattacaggtgtgagccaccgcgccaggccaagttttttttttttcttattggaaaagtgaaatatgcttattacagaaacctcagaaaatataaagtagaaaaataccaaaatttctttcataattctctctacccaarggcatcggtcagtccctctccagaccagaagcagttagttctgacaccaacaartggtgataagaggttgayagcctagcaagggggaagaagccaccaccaaaccaaacacaaaaaatgacactgcacagcagtctggggacatgtccttgaaggacacagccccaaagatactggcaggtgaggtagtgtccctaagatcaacaggcatcatcatgaatcctatttcagaatgccacaaagaatacattttagagaagattctaagagaaaaagctaaggtgattttttttttcagtcgttttttgttctcagacagtgtctcactctgtcgcccaggccagagtgcagtggtgcgatcacagctcactgcagcctcaacctccagggctcaaacgatcctcccacctcagccacctgagtagctgagactacaggcgtgtgccaccacacccggctaattttttttttttttttgtagaaatgggatctcactatgttgccagggcttgtctcaaactcctgggctcaagcgatctayctgccttggcctcccaaagcattgggcaggcccattacgccatgagccaccacacctgctggtttttgttttttaaatggaattgaaaggaactagccttggctagttgcagaattcacacatatggggctatggcaacagcagattctggagtctcagggtcttttctttctagataagttacagggcaattgcttttcagagtacttttacatttctattccattcttgtcagtaaagacaaggatcccataagctgatggagaaactgaggcctctagaaactaaacgctgggaatggcacccagggtgctgaattccagggtctcctcttttctgccacaggcacacatgccccagcagcccctttggagagccccctctctatagggtactagccgggggctcagactctggagtcagacggcttccgagggatgaggcctcagacaagtaactcagctttgaaatgttttcagtggggagagaaatagccccctcccagggctgtgctccgggaactgactgagggctaactattatgggcccaccccattgttggaatgtcttcagccacatgggggaatgggtggaagaagaggccgggatgtgtcctgccagctagagcagcgaagaaatcccagcggggccccaggaagtccaagcccatggggttcaggtgctcctctctggctaytccttcagacccrcagctgctggacacaggccacagagctggtgcctcccgcgccatcactgcagtgcagcctgggtggacggaggaagccaaggggaacggcctgggctcagagtaaggagaccttgccccgggggacaaacggtgtctgaagtgcaggggtgaagcggtctccagtcctcaggggcctggaaatcagctccttgggacacggtcttatgtgtattgaccattctccccatccattccctcttcggaatgtttcagctgttctgagaaaacactttgcattcctgccccgcccctgtgatttctctttgggyggcaggcagccgkgagaggctggaggcctggggagatgggggcagggcacaaggctaagctcagcaccttcctccaccctcctcactgtactcaactcctargcgggcactaagagcagctgccttcctggacccaccttaamctcttgtgactcaactcccctttccagggtgcagggaacattccctctgccctgccttccagctctggccacagtggcctggacagagtagctgggtcccaggcctgcccctgtggacgagggaccagggaccaagagcgcactccagccctgagcccagagcctscaaagcccaaagcaaggcccataaacggaggctacggtaagaggagctgtgtgtgcagtttggtgggtccgagggatgggggcaagggctgaggggcttgcctgagccatggctacagctgggccctctctggccagtgctcgttcctgcaggatcctggaaaagcaggcccaggcccatggctctgccctccttctggccctgaagggtcacgatgctcttggccatcaggaggaagtacctgcagcgccggtgcctcgaggcactgcttcacgggctgcggggttcccagcaggccaggtgcctggcagtggcatggcagcactgggtggatgcccaaggggcagagcagctggtgcggaccctggtgagtgggtgcacccctctccacactgaccatctcccatttcacctcatacttaacccaaacccctctcaaaagtatggcccttggacctactgactccaaaaccttgggggacaggcccaggaatctgcattcttaatactcctcagatgacacccccttgccatagccctttcactctggtgcagcagtgtcgggggagaaaggcagaagggctggggactgcgggggagcgtgagcacaagaggccttctctgccaactgtccccaaagctcagggagtggcacctgagatgggcctggcagacgtggtggcagcggatcctgcgactgcgagtggctcagcagttacagcagcaggaagatgggtgggtcctttcccaggtactgccctcttccctgcattccactcagccagccttccagaagtctgtgccacagccrcgcaccgtggagctttccctgcttgccagccccggggccccttcgttttcaggggagggggtcagttccattacagaacacacaggctggatgctggagcccttgctttgatttgtggccccagctcaggccaggcccacccggtccatcagtttgcgaagaaggtgtggcatgaggcatggctgccactcacactagcccatggagggcctgggtcctgagcgccccctccctcatttgctctgctctgagtacagcttcccagctcaccatcagatctattctgagcttgtgcatttggcctaggcaagactggctggctgcttggggcagagggaggggccctggggacaaaaggagctgggtacaggggttgctctagcaggcacagcacagaccccggagaaagcccacaacaatagcatttcctctcctccctggttccaggcctttaagaagtggcaccaacgcctggcagccaggagcccaaggagaggagctgccagtagcccaagaccctggagcaagccaggccccaagggccccgagagtggacaggaagccgccrgagcaccgcggggttgggggcytggggcagagcatggggcccagctgcagctgtgacttgttctcatagaataaaaaacagaactgaacttagccttcccagggaaggaaccatgccccacacatccagggagtgatgacagaggggacagcttgaagagctctgaaggacaataaaacccactcctcagtcctagctgctgctttcagtctctcctagcggctgcccctctgccccagccagtgaggccaggaagggagtaaagaggacatcccacaattgcgtccacccccttggccatcaggctgctcttccactacacgaaacagcccatctgcacctgccagtcactgcccccaggccctggggcttgcaggtgactcgtggggagccaggccaggcagataacctctgggacaggacgaggggatgaggaaggcagctggcaggacaagggcctacctgaaaaatacaccaggaagctgggctgctgcacaggcccaggcagatctggggcccctgtgctggcaaatctcatcttagcctctgacagggaacggggcagcatcaggcctccacagccaggcaaaaggggaaggccacgagccccaccaagcacaagggttcagactgccttcaacccttaaggggcactttttctctcaaggctcagaatagacaactgtgccaaaaagcagcatggtaggtgtcagcccaatgcccatccagggggctggtgccatggacggctaagtgggcaggcagggcagtggtgtgccccttcagtcacaagtaggtggggcccagctgcccacctctaggaggtggaagggtacagcactttgccacatctcttctacgatgccaccagtgcctgatgcccttgcgtgttttgcctgtactgcacgggctccaagkgtaagttcactgggagtcccaggctggctctggaggctgccttggttcgagggcttagttggcaacaaccactctcctcgccttctcaggaggtgccacccactgtggtcctctgcaggacgcaagtgctccccaccaaaagagcacagactcctggctagagcagagagtactaggttcccatgtggggccgactcaggtccaggaagagcctggaagcctcactccagtctagctgccattgtcaggtgggggagtggaggccggggtgggagagacacgaaggagagtggagttcccaagagaagcagcactgtggaggaggaaggcgggacaggagtggctccaacgcagggcgtcaggacgcagggtcatggagcctccgtttctctcgcattctgggtgggcctgttgagaagctccaatgtgtcttccaccacctgccagaggcagttgtccagtgggaagtcattgtccaccaggttgaccaggaagtagttgtcgtggatgtactggatgatggtgcgggacggggactcctcctcatacagctttccccacygctcaatccacagggcaaaggcctygtcctacacacacatacccccgcacacacgcacacatgcacacacacacagaggcaagattaacagggctctccaagggctctgctcaacaggacatttcccggaatagaacaaggcccactgccagtatcacttcccacccctgcccagaaataaacaccctgcgtcagcagtgacatgggtgagtcagagctgggtgtgccctgaaggctgggtccagtgtggccttcagcacacgcttgggacttggtcccaatccctcccsacggttttccaggtgggcggggcaagcttgcccccggctcctttacctwccagaacatgaagctgacgggatccactacggtgggctggatgatctctcrcycagggaagatgccccaagtgacagcattcggctgcagttcaggggcattggtgatgttttcaccctgaggggatgtggggtgggggtaagacctgggccaagaacaactggagtcccactgcctggacagccttgactcaatgaggctgtctgggctcaataccctctgcctgcgcctccactcccggcctccactctccctgcgcctccactcccctctccctgtgcctccgctcctggcctcctctgcctgcatctgtgaatgatatctctccccacacaagcctgaacctagaggcgtcctggccacttcccctctcctccttgagcaccccctgctcactctctgatccattccctcttgtctagcccacctccaggagtgtgtttggcttgggtcactccaggggtctcttcactggcctccccggctctagccgtccccaatctctctcatccgtatgactatccactgtgatttgcctaaaataaagcaggaaccaagccaccccactgctggagaaaggcttcccttgcattgagggaaaactcaaattccagcaggacaaccatgatctctgcgggcctggcccctgcttaacactcccgcctcctcctgctcatgttcccggtttccccagatggtgcagctcactgcctctgcctgtcctctgccctgtcccaggaatacccttctctcctgttggccaactcctctttgtcctcagtgattcccacagatgaccctctgagaagccttccctggcctcccaggtgagatatccctcctctggacccgacagcatcctctcctgaacttgattttcccacttacactggctggtggtcacacattgatctgcctccctcactctaggctgggagctccttaagagcagggccccagttctgcctgtatctctctgtcttgcacaatgcctagcccaggctaggtgctgggtgtttgctcaacgaagggcctggtactctgtgggaaccctggggcctggcctaccttcacattgacaaggtggtaattaacccggagctcgtacttcttcagcacttgcagaagtgcttccgctgtctcgcgggaagtgaaaaactctaagtaggcctgtgggagagacaggtgcctgtcaccaaccccagccctgccagacgccctttcgcagacacctaaggtatcaggactactggcagccatgtgggcggaataatgaactgtggcgttggcacgtccataagcaaagggtgaggggagtggggacgtgagtttctcagtctggacaggtctgagggctatcagccacccctctcccaatcagtcagggaagactccacgaagaagccatttctgaacagcagcaactggtttgacaggccgagtcatgggagagaggccccacacattccatcctccccagtgcaagctgacaatgacattgacatctcctctagaaccagtgcctatcagggattaagctgggtttactcaaactcatttgctagaatgctgataatacgggaggctgggcacagtgagccccacgtgaggaaagtgggttcagggaagttgagcacgttggctactctgacagtaaacagtagagctggtccttaaactcaggtctttctgctccagggcccgtgggccttagatcagaacataatgttaactccagcagccctgggagaaaggtgtcaactcaggatagtaacagcagctgcctttcagggagtgcttcctgctcttaccatgtgccaagcacgttacatgctttgttaggtttcatgcccagaacacaagctacatcccattttacagacgagaaaaccaggctcagagaggtcgagtgacctgcctccataggtctgatttctatcttttttttttttttttttgagatggagtcttgctctgttgcccaggctggagtgcagtggcatgatctcagctcactgcaacctccgtctcccgggttcaagcgattctcctgcctcagcctcccaagtagctgcaactacaggtgcccgccaccacacccggctaattgttgtatttttagtagagatggggtttcatcatgtttgtcaggctggtctcgaactcctgaccttgtgatctgcccaccttggcctcctaaagtgctgggattacaggcatgagccaccaagcccagccaatcttttttttttttttttgagacagggtctcactttgtgggccaggctggagtgcagaggcacaaatatggcttactggagcctcaacctctcggactcaagcgatcctctcaccccagccccctaagtacctgggactacaggtgtacaccaccatgcctcggtcatttttgtattttttgtagagaatgggtttcaccatgttgcccaggctggtctcgaactcctgggctcaagtgatccacccgccttggcctcccaaagtgctggccgggttccgtgcccagccaggtctatctgacttaaagcatgagctcccatccgctccaatccatgctcattcaaaatttaagagcccaggagaggcaggctgctctgccctaagctctggggaacccacgggtgccggtcaagagaggggggcaccccgtgcctccctaccacaccttctggaagacatagcccccgctggggccccagcccacgatggggtcggaggayggcttcccgttgatgttgggctgtgagttgatggtgaggatgccctggcggttcacccgcagcagctcctccttcagcaggctggtctcagccgccaggggctcatcgttccagggcaggcaagtcacctgggagagacggtgagctggctggggcgaccatcaggtttggcaccctgagtccctctcacggcccccaacaaagacccagcctgtctttgcctccctaagcccttccaggtggaggtctcccaacttacccttctccctttgccatgtccacagcatggaggggagggcacaggatggggaagtcacagccccgcagcctggcctgcagctggggtcaggccaggggcaggggatgaaccagggtccccactccagcatcactcactttgtgaccattccggtttggttctcccgagaggtaaagaacraagacttcaaagacacttkcttcactggtcagctcmtccccccacatcttcagcagctcctccttgggggacttgctcttcaggtagaagaggtagtagtccttcagctccccaaaggcaggggaagaggaattgcccctggcagaggggtgcccagaggtcagggcacactcctgacagagggcagtgccaccacatgcccaggaggccattcctgtaaattctgcccctgactcctcccaggtcaaccacaagcatgcaaacttcttctgccctcccgctcccaagaacaaagatatatttgcaaggaaggtctgcaggccctcaccagcggycgttagggaactcgtcccactcctgggtacggtagatstaactctttggtctggaggcccagaagatgggacgtacatcttcctctcrgcrcttggggtgggcrctgagagcccagggtaggggacgcctgggtgaggatggggacagagaattgagacaagggattggctagagggagccggaagcaggggagcacccctgaggctgagttcttccatctgatgccctctgagactggagccttcgatgtgcccagctagccatggcacagacatccatctgtaccaccgtggggagccagcactgcagccggggctgctcttggaccctcctctggggatctctgggccactgccctcacctggggtcctcagtccacatccccaggcgcttcagcacctctgtggtagccatctcgcrgytgrgggtgtagaagtggaggcctggcaccaagccactggccagaagctcctggcacaggctcacggccagctcgatgccatagttgcggatggcagcatcgttgtctttgattggctcaatcacgtccttgatctcctgtggcacctccagcttggacagcttcacaagctgccgaagggagtggtagccctgtccaagacatgaggggctgtggcggctgctggccagcccgtctcccaccctaaatacttctcccccttccatcatccatgccaaccacagtgtcaggcagagggacccacgaaagtccgatcatattctaggagcacacctgggcttggcctgccgttttctcctcttttttctgtttttagagactgagtctcactgctctcaaacgccagggctcaagccatcctcctgcctcagcttctcaagtagccgggactacaggcacgtgccactatgcccagctttcccactttttacagagtagagcagctgccctaagcattccagccttgggttgagccagccttttagccctagatgtgtctgttggtaacatggtgtcatctaacccagctgttcccatgctgcactgatcatccgaatcacctgccaagctcaagaagtaaaacacacattccaaggacctccctcagatttactgagtgagaacctccaggggtgggacctggagatccactttttgaaaaagcttatcaagtggttctgatgacagccacctttgggaaacactgatttaagcaggatttgtaatgagaattagaatcccttttggtgatgcttgttggccaaagtacaacaaacccctcaacagacactgttgctgggttttggggggaaaattagaggtaaccaaaatggggtggccaagcaacgctgtgcaagttctggacctgagaggagatctgggaagaactcagcgaactcagcactccacccagagcccccagcctgtgcgaggacggtgcggtgagagtggggtggagggagcttatgggctctcctgggcccctcacctggatgggaaagatcccggggacgatggggcaagtgatgcccatgtcggtgcatgccttcacaaagcggaaraatgtgtcagcctcaaagaaaagctgcrtgrtgatgaaatcgrctcccgcagacaccttctccttcaagtgcttcaggtcagcctcaaagctccctgcttcggggtggcctttggggtaacctgccaatagggatgacagtcaggagaggctggcctccacctgttcaaggcgagggatgaagagaccacagggactgggcagagagagtcctctgctttgggggctctgatcttgcac

SEQ ID NO: 17648 - DNA, 15922 bp, Homo sapiens
ttgacctgtacaggcccctggctaagagtcaccccagtgggactgacacttctggttagaagcttcacctctttcccccactccagctttcaactctagacagctttctgactgcttctggagtggcagagcatgggataattgattcctgctgagggccttttctaccagtgttagggtgtagcccggaggtctcggtccccatgacccgcaattccattcctagcctccgggaccctgctcagcaagtgcggaaaacagcggggctggtgatgacccacctgatcctcaaggacatggtgaaggtgaaggggcaggtcagygagatggcggtgctgctcatcgaccccgagcctcagattgctgccctggccaagaacttcttcaatgagctctcccacaaggtgagaggcagagaggcactgagggctggctgcagagggaatctgtaggtcacctcatctccttaacatggctctctctgtcttacagggcaaygcaatctatratctccttccagatatcatcagccgcctgtcagaccccgagctgggggtggaggaagagcctttccacaccatcatgaagtattgctccccgggccctggggcacattttccacatagcacgggcttaggaatcagacacacctgtatttgaattccacctcggctactctttagctgtacagccttcggcaataacttagcctctctttgtgcctatttcctcttcttttgaggctgatgatacttaacccttagttcttgaaaatattaaatacgataaagttcctaacatggtggcagacatacagtagcactcactccctagcagctgctcctgttaatttccattcacagtgaaaattcctgagccgggggcggggtggggtccctctctgctgaatgggacagggcaaggggagtggtgaggcagacaggggccgtggcagagaacatcagagaagacgagtgctgggggagggtccagggttggtcttagtggatggcagagctggccctgggccatcgaacatcctcatcttcccttcctgcagacagctcctctcctacatcaccaaggacaagcagacagagagcctggtggaaaagctgtgtcagcggttccgcacatccckgtatgctgccctccctgagggttctttgtgctgagcggggccctgcaggggagaaaggcccatccctcaccccttcaatgcccccactgtggcatccctgggactggggaggctgatggggaaggttgagcctttactagctggatctcccagttcctcacaaagcccttcctatctgcagaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtrggcaagctgcgacgtggggccaagcckgagggcaaggtgagcagcacaggacacttcaatgcctgttgggttctgggctggctaagacatctgccggccctgggcagcatacggctcttgcagtcaccttcccgtcctccttatccccagctgggttgcaaccaaattgccagagtgacctaagaccagatctttgtctccagttctttttttattactccaaaaacacaaccaaagcagcatctcatccaattcttgtttgtttgtttttaatagtttttatttttcagagcagttttaggttcaaagcaaaattgagcagaaagtacagggagttcccttctaccccttgcccctacacatcacagccttccccaccttcaacatcctgcaccagggtggcacatttgttacagctgaacctacacttacacatcatctcctaaagtcatggtttaccttggagttcactgcacgtaatgacatgtacccaccattgcagtatcatacagaagagtttcactgccttacaaatcccctgcactccacctatttatccctctctccccacaacccctgatctttttactgttgccatcactttgtcttttccagaatgtatcattggaatgatccggtatggagccttctcaccttggcttcttagtaatgtgcgtttaaggcctccatgtcttccatggccttgtttctttttaatcagaagtaactgttttcaggcctgctctgaatctccttttctccctccaggctataatagatgaatttgagcagaagcttcgggcctgtcataccagaggtttggatggaatcaaggagcttgagattggccaagcaggtagccagagagcgccatcagccaagaaaccatccastggtacgtaaggcagcctgtgcgggcgagaccagactgggccctcccctcctgcagtgatttgtttcttcttcttttttaaatcacgttttcctgccttttctaggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaaggtatgatgctcccgcctgttcccggccgagaaggcacacagctagggtgcagagggctggtttccataggacctgctgcgggggcctgagtgtagatgctctgccccactgccgcagaagggcctctcctgtacagcttggattttatttcttctgtgcggtgtgggattgtctcacttgttctctgatatctattttttcaccatctttgtgactcagctttttcttattcctttaattctttgcatagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctctttttttaaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatacttttagacattttttcctaagcttgtctttgtttcatctttcacattagcccagtttcatgcagcagagagagggttatcagtgcagagagagatgagtgagcccagagtcctagggcctgtcccgggatggcagatgagcttcctgccccgtcactgccacctttcccctctcaacctctggaccctgcacagtgaccagacagcctctctggggagaattatgcagtgcctaggctccagatcagtgcttctgaaccgggggcaattttgtctgccagaggacatctgacaacacctggggcctgttttgttgtcatagcctataggggaagaatgctaccagcatttgtgggaagaggccagggatgtggctcaacatcctgcagtgcacaggatggcccctcaacaaagaatcacacggcccacaatgtcaatagcgtcacagttgagaaaacctgctctagaccaagggttgctttctgccgtgtgcctcaccccacccccactcgtgttccctaatcccatctccaaaggttggcagcagaccggcccaggctcgtggaagttcagatcatgatcccctccagctctgcaggagacaagacctgtctcccagcattcctcattgttcccgggtctgcagagggcgtgagctatgctgcaggcgggctgccccctgaagcctgcgcacccctctccagctcctcaagtcttctctgctgagtcaccttcgaaccggaggctgtgagctggctgtcgtgaccacactggtgcctctgctgtcatgacaacagcacactacgtcagtagtgctccctgggcactgagctccctctttgcggggagaagacagtaatgaaaaatgacaagcatgaggcagaggggaagatcacgcttgggtggtgcaggagcatggaggtgctcttaatgctctcaatgagaaagggttaacggtcctggttgcaggaatagctgagtcagaggtggggcttcctccactcccccaccccacccctttcaccattagggaccttcttgccttgctcttgctactctgctctgggtggtcattgtgaaaagcccgcaccaaccatgccagtggcagccagacgaggacacagcctggctctgggtcccagcaggaaaggcaatcccagaaaggcagggtcagggactggagtcctgtgggtgctttttaagcaaagattatcaccaggcaggctaaacttagcaaccggcttttagctagaagggcagggggctggtgtcaggttatgctgggccagcaaagaggcccgggatccccctcccatgcacctgctgatgggccaaggccaccccaccccacccccttccttacaagtgttcagcaccctcccatcccacactcacaaacctggccctctgccctcctaccagaagaatggatcccctgtgggagggggcaggggacctgttcccaccgtgtgcccaagacctcttttcccactttttccctcttcttgactcaccctgccctcaatatcccccggcgcagccagtgaaagggagtccctggctcctggctcgcctgcacgtcccagggcggggagggacttccgccctcacgtcccgctcttcgccccaggctggatggaatgaaaggcacactgtctctctccctaggcagcacagcccacaggtttccaggagtgcctttgtgggaggcctctgggcccccaccagccatcctgtcctccgcctggggccccagcccggagagagccgctggtgcacacagggccgggattgtctgccctaattatcaggtccaggctacagggctgcaggacatcgtgaccttccgtgcagaaacctccccctccccctcaagccgcctcccgagcctccttcctctccaggcccccagtgcccagtgcccagtgcccagcccaggcctcggtcccagagatgccaggagccaggagatggggagggggaagtgggggctgggaaggaaccacgggcccccgcccgaggcccatgggcccctcctaggcctttgcctgagcagtccggtgtcactaccgcagagcctcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccaggtgaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctccctccgcgcagccgagccacatcgctsagacaccatggggaaggtgaaggtcggagtcaacgggtgagttcgcgggtggctggggggccctgggctgcgaccgcccccgaaccgcgtctacgagccttgcgggctccgggtctttgcagtcgtatgggggcagggtagctgttccccgcaaggagagctcaaggtcagcgctcggacctggcggagccccgcacccaggctgtggcgccctgtgcagctccgcccttgcggcgccatctgcccggagcctccttcccctagtccccagaaacaggaggtccctactcccgcccgagatcccgacccggacccctaggtgggggacgctttctttcctttcgcgctctgcggggtcacgtgtcgcagaggagcccctcccccacggcctccggcaccgcaggccccgggatgctagtgcgcagcgggtgcatccctgtccggatgctgcgcctgcggtagagcggccgccatgttgcaaccgggaaggaaatgaatgggcagccgttaggaaagcctgccggtgactaaccctgcgctcctgcctcgatgggtggagtcgcgtgtggcggggaagtcaggtggagcgaggctagctggcccgatttctcctccgggtgatgcttttcctagattattctctggtaaatcaaagaagtgggtttatggaggtcctcttgtgtcccctccccgcagaggtgtggtggctgtggcatggtgccaagccgggagaagctgagtcatgggtagttggaaaaggacatttccaccgcaaaatggcccctctggtggtggccccttcctgcagcgccggctcacctcacggccccgcccttcccctgccagcctagcgttgacccgaccccaaaggccaggctgtaaatgtcaccgggaggattgggtgtctgggcgcctcggggaacctgcccttctccccattccgtcttccggaaaccagatctcccaccgcaccctggtctgaggttaaatatagctgctgacctttctgtagctgggggcctgggctggggctctctcccatcccttctccccacacacatgcacttacctgtgctcccactcctgatttctggaaaagagctaggaaggacaggcaacttggcaaatcaaagccctgggactagggggttaaaatacagcttcccctcttcccacccgccccagtctctgtcccttttgtaggagggacttagagaaggggtgggcttgccctgtccagttaatttctgacctttactcctgccctttgagtttgatgatgctgagtgtacaagcgttttctccctaaagggtgcagctgagctaggcagcagcaagcattcctggggtggcatagtggggtggtgaataccatgtacaaagcttgtgcccagactgtgggtggcagtgccccacatggccgcttctcctggaagggcttcgtatgactgggggtgttgggcagccctggagccttcagttgcagccatgccttaagccaggccagcctggcagggaagctcaagggagataaaattcaacctcttgggccctcctgggggtaaggagatgcygcattcgccctcttaatggggaggtggcctagggctgctcacatattctggaggagcctcccctcctcatgccttcttgcctcttgtctcttagatttggtcgtattgggcgcctggtcaccagggctgcttttaactctggtaaagtggatattgttgccatcaatgaccccttcattgacctcaactacatggtgagtgctacatggtgagccccaaagctggtgtgggaggagccacctggctgatgggcagccccttcataccctcacgtattcccccaggtttacatgttccaatatgattccacccatggcaaattccatggcaccgtcaaggctgagaacgggaagcttgtcatcaatggaaatcccatcaccatcttccaggagtgagtggaagacagaatggaagaaatgtgctttggggaggcaactaggatggtgtggctcccttgggtatatggtaaccttgtgtccctcaatatggtcctgtccccatctcccccccacccccataggcgagatccctccaaaatcaagtggggcgatgctggcgctgagtacgtcgtggagtccactggcgtcttcaccaccatggagaaggctggggtgagtgcaggagggcccgcgggaggggaagctgactcagccctgcaaaggcaggasccgggttcataactgtctgcttctctgctgtaggctcatttgcaggggggagccaaaagggtcatcatctctgccccctctgctgaygcccccatgttcgtcatgggtgtgaaccatgagaagtatgacaacagcctcaagatcatcaggtgaggaaggcagggcccgtggagaagcggccagcctggcaccctatggacacgctcccctgacttgcgccccgctccctctttctttgcagcaatgcctcctgcaccaccaactgcttagcacccctggccaaggtcatccatgacaactttggtatcgtggaaggactcatggtatgagagctggggaatgggactgaggctcccacctttctcatccaagactggctcctccctgccggggctgcgtgcaaccctggggttgggggttctggggactggctttcccataatttcctttcaaggtggggagggaggtagaggggtgatgtggggagtacgctgcagggcctcactccttttgcagaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaamcctgccaaatatgatgacatcaagaaggtggtgaagcaggcgtcggagggccccctcaagggcrtcytgggctacactgagcaccaggtggtctcctctkacttcaacagcgacacccactcctccaycttygacgctggggctggcattgccctcaacgaccactttgtcaagctcatttcctggtatgtggctggggccagagactggctcttaaaaagtgcagggtctggcgccctctggtggctggctcagaaaaagggccctgacaactcttttcatcttctaggtatgacaacgaatttggctacagcaacagggtgrtggacctcatggcccacatggcctccaaggagtaagacccctggaccaccagccccagcaagagcacaagaggaagagagagaccctcactgctggggagtccctgccacactcagtcccccaccacactgaatctcccctcctcacagttkccatgtagaccccttgaagaggggaggggcctagggagccgcaccttgtcatgtaccatcaataaagtaccctgtgctcaaccagttacttgtcctgtcttattctagggtctggggcagaggggagggaagctgggcttgtgtcaaggtgagacattcttgctggggagggacctggtatgttctcctcagactgagggtagggcctccaaacagccttgcttgcttcgagaaccatttgcttcccgctcagacgtcttgagtgctacaggaagctggcaccactacttcagagaacaaggccttttcctctcctcgctccagtcctaggctatctgctgttggccaaacatggaagaagctattctgtgggcagccccagggaggctgacaggtggaggaagtcagggctcgcactgggctctgacgctgactggttagtggagctcagcctggagctgagctgcagcgggcaattccagcttggcctccgcagctgtgaggtcttgagcacgtgctctattgctttctgtgccctcgtgtcttatctgaggacatcgtggccagcccctaaggtcttcaagcaggattcatctaggtaaaccaagtacctaaaaccatgcccaaggcggtaaggactatataatgtttaaaaatcggtaaaaatgcccacctcgcatagttttgaggaagatgaactgagatgtgtcagggtgacttatttccatcatcgtccttaggggaacttgggtaggggcaaggcgtgtagctgggacctaggtccagacccctggctctgccactgaacggctcagttgctttgggcagttactcccgggcctcactttgcacgtgtgcttacctagtggagacaaaagtacatacctcggtagagcgcgcacgcctgtaaccccagcactttgggaggccaaggtgggtgtatcacctgaggtcaggagtttgagaccagcctggccaacatggtgaaactccgtctctactaaaattacaaaaatcagccaggcttcatggcacatgcctatagtcccagctacaggcatgctgaagcaggagaatcgcttgcaccccggaggcagaggctgcagtgagctgagaccacaccactgcactccagcctaggcaacagagtatgagactccatctcaaaaaaaaaaaaagtacctacctcagagttcaaactagtgaatattaggaagtgcttgagacagtgacaccaaagtgcacaataaatactcgccagtttcattattattaaagaatccatttgaatgtcagctcaacacagcctcctataccgaggcattgtgaaccgcatctccccagcttctccaggcttttccaagaatcagggacactgtagcctgttggtctcagtgtatgacagacacggaggaagcacatctttagctgatacttaaacagagaccctgagcgcacatacacccgcgcacacatgcatggagcttcaccttctctgtcattctgcagtgaccaggagagcaagagctcccacctcccttcaaaacactgtgcccatcccgggcactaaggcctctttaaagcacggcacctccacgagggagggccacagccacatacactccacctggcaggtggacagcgtgagcatgtggaccatagcagggacaaggtgccccggccagccccaacgccctctgccgctgacagggacagaagccctctccagctgcgtgtgctgcagaggccatgcgtagcctccagctgcattctattccactccagtgcctgggccagttagcaccagtgtggaagacagtgagctggctccggacaacagggatggaggaaaggtcccacattcacattcctgatacgtggacaaggtgaggggccgcaatcgctctggcagcattttaaagatggggaagtagcagacacccacgcgtgaaggcaggagagccccaactgtggtggaaatggccccagaatggtagggccaagcctagctccagacaccccagagccctggagaagccaagactgagggagaaagcctgagggaggagcgccccagtccccagggaccggcctggtgcagagctgcagctgatgttcccctctgtgcagccccaccctctgcctcgctgagctccctgctgcgagggcctcgggtgcaagggggaggcaggtctctatctcatggagctgtcagatgagacatcgcgatcggagtcctcagcctcgcttggcggcggcggcgggtcgctaagcgggaccgcagtgaaagcaggagactttctagaaaaaaacaccagttgtcaaccttggggcaggcaggaatcctgaagacggacggcactcctcctcctgctgcctcaccctctggcagcccgtgagaagtaccggaagcgagggcggggccgcgggatggcgagggagcggcagggactgaactctctccaaacccaccctgacagggaaatgggccccgcctgtgtcttgggaactcagaggctgaggtcaggcatgatggctcacgcctgtaattccagcactttgggaggcagaggcgggtggatcacgacgtcaggagttcaaggcaagcctggccaacatggtgaaaccccatctctactaaaaatgcaaaaattagccaggtgtggtggcgggcgccttggaggctgaggcaagataatcacttgaacctgggaggcggaggttgtagtgagccaaaaaaaaaaaaaaaaagaaatagctgaagtcacagtaggagagaagctgctgagcctccagcaccctgactctagggccttggctttatgtctatctgcagtatttttgtgatttttaaaaattcactttcttgttgcggtgtaacttacacagggtcaaatgcacaaatcatggccctgactttagataaaaatctgcccccacaacccttctgttccttgccagtttttaaactgcctctaaccaggggaaccaccagagctggtggccttgggaggtttcagccctcccgtcatgaatggacatagctcatccaactgccaagggagagagctgtgggtctgggccagccccaccaggtaactcccaaagggcagccccacagcaagatgtgacccagtcattgcctgagggtctctggggctgtgttccaacctttctccccgctgtgtccccctggaaggccccatgcccaggggaggcgcctaccggtctccagactgggtgatgagccggcggcaggtctccatctgcacgtccaggccgcgcttcatgctgcacatctccatgtactcgtgcaggtgccggttcatgtcgttcttggccgtggccaactccagctgtggtggggcaggcagggccatcggggttaacaggtggcgttcacagcgcctctgttgcccccgccaggaggccaacacgccaagagcagtggctgggccgggggcccaggcagccattactgaaggctcagattttaaaataaaccagaccaaggcagaaggcagcgaatacaccattgtttcctctgcttttcctggaaatctttgcctatggaggaatgcaaaggtactgctgcaggctgtgttcttttaagactgataagagtggtgaggaaagtcagtgtgggcgggatggagcagatccacaggctcccagggccacacaggttcctatggggcccggctcacccctcatcccctgtactgcgctggtcctgggctgtcccctcactgcactgtgagctcccgtaagggttagcgacaggttttcctcatcctggcagacccagacctcgaagggaattaactctctctgtgacccgtggcatacaagcctggctaactgctgaaaggggcccaatcctcttaccattctctccttatcactttattttctcacctaaaagccattttcagacactaaaaggaagactcccatattggaggtgccattgattctgagacctgtcctgatttcagaaatgtcacacgtggaaaacacggggctcagaatcaaagaaatccggtctccctccccgggcccattctgcagcccacactctgaggcaggcggagaggcagggcccaggcagcacaaactcagtgccagggacagtcgactgcctctctttgttttgggtacaaagggcaggggccgcaaggggaagcaaaatgaaacttcctggagatgacgttcgtgactgcctgagtgaagagaacggggaggataccagctgccataatgtggattggacagagagggtgggaacttagagaaagaaggaaacaggttacagggccagacagcagagatggtcaggacagtgacatttggggtgagatggcggctggctgggtgagaagccctagtggggacagcttccctggcaggcttggatccacagctggggccccacagtagtgggaggagcaggacacggtgactgttcaacccagggggaaaatacagtgccaccagcccttgttcagatcagctgcctacaccccaatttctccaccttggaagaaccggagtgcagggagctgggttctggaaccatcactcagggagactgggaagaaggaaatgaaccaaatatattctactgaaatacaaggctagtactgccaccagtagtctctgcatatgtctatgtccccacttaattcacaaatttacagcaggaacaaggtcaggaggtgaacgtgcatgtcaggagatgtccttgacaagccaccttgaaaactgcaggctcgctgtgtgaacagacttgggggtgggacgggaggagacagagagaggtgaggagcggtggggaagaactgcctcccgcccaccactctgggccttggctttaccttgctccatcttagtgaccctgagagatcaaaggtcacaaagataaaggcaccttgggtactcctgaggtcagcaagtcctcctaacggttcccctaatgcagaagtccccaaaccccaggccacggaccagtacctgtctgtggcctgttaggaaccaggccaaatagcaggaggtgagcagtgggcaagtgagtgaagcttcatctgtatttacagctgctccccatcactggcattacagcctgagctccacctcctgtcagatccgcggcggcattagattctcacaggatcctgaaccctaccttacgtgaactgtgcatgcgagggatctaggctgtgtgctccttatgagaatctaatgcctgatgatctgtcactatctcccatcacccccagatgggaccgtctagttgcggaaaacaagttcatggctcccactgattctacattatggtgagatgtataattatttcattatatattataatgtaataataatagaaataaagtgcacaggccgggtgcggtggctcatgcctgtaatcccagcactttgggaggccgaggtggtggatcacctgaggtcgggagttcgagaccagcttgaccaacatggagaaaccccatctctactaaaaatacaaaattagccaggcgtggtggcacatgcccgtaatcccagctacttgggaggctgaggcaggagaattgcttgagcccgggaggcggaggctgcagtgagccaagattgcgccattgcactccagcctgggcaacaagagcaaaactctgtctctaaaaataataataataatttttaaaaatagtaataaagtacacaataaatgtaatgtttgaatcatctcaaaatcatttcccccgggtcagtggaaaaactgtcttccacaaaccagtccctggtaccaaaaaggttggggactgctgcctaaagtcattgcactgggagagaggaggagtcagatgatttgaaaatacttttttttttttttttcctgagatggaatcttgctctgtcacccaggctgtggtgcagtggcacaatctcagctcactgcagcctccacctcccagattccagcaattctcctgcctcagcctcccaagtagctgggattacaggtgcccaccacaatgcctggctactttttgtatttttagtagagacggggtttcacatgttggy

SEQ ID NO: 17649 - DNA, 47777 bp, Homo sapiens
  misc_feature (1)...(47777): n = A,T,C or G, or insertion/deletion polymorphism (see Tables 1-2)
actttttctagctatctgttattgatttcaagtttaattccataagatctaatagtatattttgtgtgatttctattctttcaaatttgttagcatgagttttatggcccagaatgtggtctattttaattaatgtttcacaagaacttgagaatgggtattctgctgctgttagatgacatattctataaatgccagttagatcaaattaattgatggtgctggtcatctcaactatatccttactgattctctccctgctggctcaatctgtcaattactgataaacagatattgaaaactccaactgtaatgatggatttgtctatttctccttgcagttctattaatttttgcatcatatatttagacactttggagttgggtgcatatacactaaggactgttatgctttcttggaaagccgactttcttatcattatataattgtcttttaccccagataattttctttgttccgaaatctgcttgcctgaaattaatacagctactccagctttcttttgattaatgttagaatgtcatatatttctccatttttcttcttttttttttgaaactggatctgcctctgttgcccagcctggagtgcagtggcacaatcatagctcactacagccttgaactcctgggctcaagtgatcctcccacctcaatctcctgagtaactaggactacaggcacctgccactacacccagctaaaatttttttgttttttgtttttttggttttactatgttggtcaggttggcatttttaaaaatgtaatctatcagtgtctctatatttaaagtgggtttctggtagacaatatatagttggcccttgatttatttttaaatccactctattagtctctgtcttttaattggtacacttagaccattcacttaaatatactattgatagttagattaatatctcccatatttgtaactgttttctattcaatgcacttgttctttttatgtttattgttgttgctgttattgtttttcttccttctctttttctgccttctctgttgttgttgtttttttgttttttttttttcttttgagacggagtctggctctgtccccaggctggagtgcagtggcacgatcttggctcactacaagctctgcctcctgggttcacaccattctcctgcctcagcctcctgagtagctggcactacaggcacctgccaccacgcctggctaattttttgtatgtttagtggagacagggtttcaccatggtagccaggatggtcttgatctcctgacctcgtgatccgccccctcggcctcccaaagtgctgggattacaggtgtgagccaccatgcccagcccttctctggttttaattgaatattttatatgattccattctcccctcacttagcacattaattgtattagtcaggattctctagagggacagaactaataggacagatgtatatatgaaagggagtttattgggagaattgattcacatgatcacaaggtgaagtcccacgatcagccatctgcaagttgaggagccggaaagccagtccaagtcccaaaagctcaaagtagggaagccaacagtgcagccttcagtctgtggccaaaggcctgagagcccctggcagatcactggagtgaagtccaagagtctaaaagccgaagaacttggaatttgatgtttgagggcaggaaacatccagcatgggagaaagatggaggccagaagacttagccagtctagcctttcccccttcttctgcctgtttttatcctggccatgctggcagctgattagatggtgcccacccagattgagggtgggtctgcctttcccagtccactgactcaaatgttaatctcctttgacaacaccctcacagacacacccaggaacaatactttgcatctttcaattcaatcaagttgaaactcactattaaccatcacattaattatacttctttttaacaaatctttagtgactgccctagagtttgcaatatacattataactaatctaagtccattttcaaataacaatacactaattcatgggtagtacacaagtatcttagaaaagagtatccccaatttctccctctcaacccttataacattgttattatacatttcacttattcataagctataatcaaccaatatgttgctgctattattatttggacaattattctcaacctgataaagaacatctacagaatccctacagctactcacagaactcaggaaagcactttacttactattaccggtttatataaaagatacaattcaggaacagccaagtggaagagatacctaggacaaggtatgggagaaaggggcactgagcttccatgccgtctctaagtgtaccaacctcccagaactttaatgtgttaaccaacccagaaactcttcaaactctgttggttgttcaggggttatttatggaggttacatcatgtaggcatgattgatcattaactcagtctctagtccctctctccttcctggaggttggggtggagggggtagggccaaaagttccaggctttattgattattgggcttggtctttttggtgaccagcctccatctaaaagctatccaggggctcaccaagagtagcctcattgctgggcgcggtggctcacgcctgtaatcccagcactttgggaggccgaggcgggcagatcatgaggtcaggagattgagaccatcctggctaacatggtgaaaccccgtctctacaaaaatacaaaaaaaaaaaaaaaaaaattagctgggtgtggtggcgggtgcctgtagtcccagctacttgggaggctgaggcaggagaatggtgtgaacccgggaggtggagcttgcagtgagccgagatcgcgcagctgcacttcagcctgggaaaaagagcgagactcggtctcaaaacaaaaacaaaaacaaaaacagtagcctcgttataacgcctatcacccctattactcaggaaattgcaggggatttaggagctctaggcaggaaccagaccatatatttttctatgaaaaaacaaaacccttagcatagcgatcatcatgattttaaattcctagtctgatttgcaaattctctgccatctccgagtcttatttctaagcttgctttgtctcttccaattgtgcttggtgttgtctgcctttcagcatgccttgtaattcgttgttaaaaactagatataacatatcaggtcatgggagctgagataaatggccctttaggataaggtgttaggtttatctggctaagagttaggctgtgttaaatgtttgctgtagttgtaggtgtcagaggcttcagttttatttagtgtcctcatttttgtctcctccattgtctttgggttttcctagaaatgccttcttaaatggagttgtaatccaccgttattatactacagagtcctgttgatgtggtggtaagatactgtggaggcaaaacattctacaatcttatgattaattcccagagttttctttaatgggcctgagtctctgggctatgaccctccgagaagtttcttaacttttgcttttttcctccagtcatgatagacaggaaggctagagggggctgagttgtctaattgcccttctgctaggtcagtttaggctccagtaatgtaattgccctgaggacaggtttttgttacagaacactctgggcatatctcaaaatgtttacttttcccctcccaccggccagtcaggaatttttctgtggtctttaccatgagaacttggtagagcttcttggagtaaacctttaacaatttggggagcatccctctaagactgagtacccaacagtgtttaattctcaagctagtccacactcagtctccagcaattagtcaattacaatttaagttttgctatgatttcagaggcttctggtccctgtaaactgtgattctttgcatttgtctgtctttcagtttttgcagtttgccctgtgactcaattcactgatactgaaacaagaagagttgttaatcttcaatttgttcagcttttctcttgttgtggggagtggagtgacagctttcaagctcttcacaccttggcatagactgcatttgcttttgttttgttttgttttttgtttgtttgcttgttttgagacggagtctcgctctgtcgcccaggctggagtgcggtagcgcaatcttggctcacggcaagctccacctcctgggttaacgccattctctcgcctcagcctcctgagtagctggggctacaggcgcccgccaccacacctggctaatttttttttttttttttttttttttttggtatttttagtagagacggggtttcaccgtgttagccaggactgcatttgttttttaaaaaatctttttcctaattatataagtaaggatgtttactgtagaatgtttggaaaggaaacaaaataaaaatcacctactatcatccaatctgcaataagtcatagttaaggttttgacatagttttatttttaatatatatgtttatataaaagagtgcatgcagcacatggagtttggtattggatttctcccattttcagaggctatttctgcaaattctctaaaactgtggctgaaaatattttcaatgttgaatgtcttttataagaaataggatcctagataagttcccttcagatcgtatggggctggtgggaattctgccaagggtcacataagaggcaggaccgtgacatcctctttatgatcacccttgtgcctagccttaaaggagtatcagcaaatgttggttgacttcatagattaaaaggctcatttttcccatctacaaaaagtatgaaacatcctcctcctccctttcctaggaggccagaaagctgaacgagagattaaatactcagttaaaacaatttaggtggttagtgtatcttttccctctccttcaaaaagatattaacatttccattttagtagctgtaatgtttagaatatacatacattttacttgaaagctgcctcatagtctattttggttttggattttcttttttttttcgtttttcttgagacagagtttcgctcttgtctcccaggctggagtgcaatggtgcaatctcaactcactgcaacctccacctcccaggttcaagcaattctcctgcctcaggctcccaagtaactgggattacaggcgcccgccaccacgcccagctaatttttgtatttttagtacagacagggtttcaccatgttggtcaggctgggtcttgaagtcctgacctcagatggtccatctgccttggcctcccaaagtgctgagataacaggtgtgagccaccgctcccggcctcatagtctattttagaagttgacaggctataaataacaagcagacaaattaatgaagaacatctgtctttctgcctatcccgaaacacgttgatcagtggggggtcgagggaagggtaggagtatggagaagagacccgcggagaagaggggagaatctacaacggataatgttgtagatatttacaacatttactcaatggtaggtatttttatcctcgttttactagttggagaattatatcatgcaggtttatacaattaacaagtgggggagccaggagagaacccattcactctttagttcattcattcattcagtcagtcaacacatctttgggtgtcttctaaatgccaggcactattctaacccctaaggatacttcagtaaacaaaacagtcccaaattcttcccctatggagctttctcggcgaaggcgggattggttaggagctgacaatcggcagcagacgattgtaaatgaccggaccttttttctattctcctgcccagcccccggcccggcctccgcctccggccctgctccagccccgccagcggcccaggacccgcccctggctccggccccgcccctggctccgcccccgcccccgcgccggcggcggcgcggcgcccgcgcttccgtatcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaaggtaacgcagcgtggcggggtcgcgggagcggagcgcgtggccagctgactggagggaaaacgccgcctccctgcagcggttcccggaatcccctccggttccctctcgctctccccgactcctcctcctcctcctgccctccctctgcgtcttgagtatgcggctagtgcgcccttcctctctcccggggccgcacctgcgaccccaggacccctcccgggccctgtcctgcgccctccacgcgtcgcccctgctgggagtccgctttcgttgcacccctccgcgtcccaccccaccccaccaaggatgcccaggataccgggcatttgccactgcaagatgtgagtcgttgctaagtttgagggtcacattcctccaggtccaccccgccttgcaaaaccggctcaccagcygggtgctcaggttcgggatctccagcccgcccccttgaggtcccctgggattagcccccctcgacctgcgtcagggtcacagactgcagccggggctggagcggcctacacccctccggatccgctgcgtggaggcaggagggggaaggggcgaggggacgtggccgcggagacagaagggtgcaccctcccagggtcggagaggggagatactgggaagatactccgcgaatatggagaggcgatcggcacttgcatttcaaccctgagcaaatcaatccgttacacgcagtagcgagttgactccatcagccsgtttatttggttagcgatggttatattgactctgagtattcccacctcctttcttttaacatttttttttttatttccttgttttgtttagcaagaagtcttagaaacgaatatagcatgcttgggcgttgattcagtggtgagaagtgccggagctggctcagggagaggtggagtttcccatgtgtgctcactggcccaggggctaagtcccactgcttgccaaggtttctcagtatcctgtccacccaccccctatccacctgtgcaggcttgagggggtgagggggtagcagatactctatcaaaatctaccctaaggaaaatattcgataaacactcctagcaattagggcatagctgataaggcttgatctgtttgtcgcagaaaatgacttgaacttgtaagttctattgttcataaagttgttttccacaattttagataatcaaaaatgtacatgactcatttttcttacctattatttcctctaaagtttctcatgtatttattgaaaagttaaagaaaatctgattttggttcacataatttgacaatggtgatttgtctaaaagtcatttcaaaaagtagtatgaaaaggatcataaccctagaggtactgtcatagamgtgaaacatttattaaaatatatattccatggctcacacttgcacactcaaagccacattggactcattttttctgctacctttataaaccttcaaactgttcaagagtcaatggtatgtatcatcttccgttatcaatcatcatgttttgttttgtttggtttggtttggtttggtttggtttttgacaaagtctcgctctgtcgcgcaggctggagtgcagtggcactgtcttggctcactgcaacctccccctcctgggttcaagcgattcttctgcctcagcctcttgagtagctgagattacaggcgtgtgctactacgcctggctaattgtatttttagtagagatgggatttccactatgttacccagcctggtctggaacttctgacctcaaatgatccacctgctttggactcccaaagtgctagtattacaggctcaatcatcatgttttatcaaagctaaaacccaaactaaaatgccattgcttataagatgcactttcattttatgtaatgaagtaagaaaaaacactgtcaatcatgctatgccatgccaccagaatgaaagcattctgatttcagaaattctcaaatgttaaaagaaaatgggcattttataatttgtgaaatattagtgagttagagcagagcttgacggcactggccctragggtccttcttcttcctttggaagaatgaaactgggggctatgcaattcagggaagaataaaggaaaaacaggtaattggcagaggaggttggctgacttagaggtatggaaaagacaaaacaaaggagggaaaaagagaggtatgtatgatggggaggagttcagagccactgaaaaytttctctggccctaacaggaaaacgagttaccccacaagccagggttttatcatctggtacgtggagatatccatcagcattgtcattggttttcatttgtttgtttttaattctcaagtttaaaaaaaaatttaaaatttaaatgtgtctcaaccaccagaaactatagtgagatttctctgtaataaataggaaagaaggagactgatccagtccttgttaaaaaaaaaaaaaagaggaaactgaatcacaacatactttgcttttttcttttctcacaaaggaacagtgggccctttatgctgggtgaaggtgagtgagatgggggaaggttcactgggcaccaaccttctgggctagagaaattgcccaggctttacagaacaagctggaatcagataaagttgtggaaaggaagtcgaggtttcactctgccatatcagtaggaggtactaaagccaaactagtagcagcaaagtgaacagaaatggtaagggggaaaaataggaaaggaaagaacaacgtggattgcaagacgtcttactaaaaacaaagaattacacttggaacagaagaaattcattaccattgccttacactgtgcaacaacttgataaaaatataaatccaataaaacaaactcaaagatgagaaaattgtaaactggagatgaaaagggagattgcagacctaaaggaaaattgaagaccgtaaaaacatagtgacagaataaataagtcaggagaaagaacagaagcaatactgctgaaaataaaagtattttaatagaagraagcccagtaaggaagcccagtaaattcaactgaaaagggacaaagattaagaagaaagaagctattatgaaagacaaaatacaatcaagaattgggaccactgaagtcccagatgtagagaagtcaacaaatgggacagaaaattcaaataaaaataagtccaaagaaagcttattgagatgaagaaaaaatggtctgtaggccaaaggaacatgccatgttccagaaaatgtcatgtgggaatayggaagcactacgatatcttaaactatttaaattcaaagaaaaagatttaggaatctaagaagaaaaagtaaaggagggaaaaacaaaatcaagctcgcctcagacttcagtgcagcactaaatgccagactatgatggttgtgaggaaacagttccaagggaaagaaacttttccgaggggcatattttttttccggaagaacaaagggaattcagcacccatgaaccgtttttggaaaaacaaaaacttgctgagtaataaaatccaggaaatagcaaattaagagataaatcaaaataaagaacttaagagtagagaaaggtaaaaagacttggtgagtatttattctatttaaatatagaagtaatacatctatagaaattgtgggtaagatagaatgcgattgttattaatctagacaaaaatatacagccaaaaaaaaaagaagtcagagaggaagatggaaggaaacatgagaataccaatattctcttctttcaaagaatggaatagtaaatatggtataaaattaaaagatgctatgtgaatatataatactgcaacttttaatatctttcataagttttatttaaaaccttagagggatatcataggaaattatactttcttatggacaaaaaaatttaaattttaacaactcctttgactttattttagtcttttcccaagtaacattaaacagaaacactgtgtgtgtgtgtgtgtgtgtgtgtgtgtgtgtgtgtgtgtgtgtttatgcatagaaagatctgtgggattatgttcgcctaatattaatgatagtaatagtttttacagaagaaaaaagaaagatgtttgaaaaataagctagaatcamatatgccaagatgttaacaattgttgatgctggatggtaggaataaggatgagtgttactttcttatttgtactttttcatatttttctaatttccagaaaaagatatgtaattgtttttgtctaacatttctgaatccacttcattcattattcattgcctccttgacaatgtgcatcagtctatgtcaaacagaaggaaagacacagccatactttaccaggagactatgaggcagcgagttcctggagggttgtttgtctgtctaggaggagttggaattcaaagaatcacttcactcaatccatccattttatctgggccttgaaaattggcagggtttgtctggtctcagggtgaatagcaggtagagctcttctttcagaatggagaaggccacagtgtcacagggtgaacctgtgacaaaattggggttcagcctgggaagccacatgagttgttggcttcgcacaggatggaattaaagagcaagctgacagaattaagtgaaagcaagtttattaagaaagtcaaggaatgaaagggtggctactccataggcagagcagcagcatgggctgctccactaagtatacttatggttatttcttgatcatatgctaaacaagtggtggattattcataagttgtctgcaaaaggggtgggagttctggaactgagggttcctcacttttttcgatgatatagggtaacttctgcatrttgccatggcatttgtaaactgtggtggcactggtgggagtttcctttagcatgctaatatattgtaattagcatatrataagcagtgaggacagttttgtcaccatcttggttttggcaggctttggccagcttctttactgcgtcctgtcttatcagcagggtctttgtgacctcctgttttatcacataactaagaatgcctaaccccctgggaatgcagcccagcaggtctcagcctcattttacccagctgctactcaagatggagtcactctggttccaacacctctgacaagagcagggggtgacctgtcacctggggctcagcaggacaataactctaggaaaaactggaaaggctgatagccttgaatttaacctaaggagcttggtgcattgtcaggcaacagtgagctacagactgagctcactacataattcacagggcccacccagagccaaataaaaatgcctgagaaagtaccactaaaggtactaaaatataaagccttttcttccacagtctctctctctcaacacgtaatgtttttttgtttgctatttaatatcattctaagtaaaaaaataggccgggcatggtggctaacgcctgtaatcccagcactttgggaggccaagtcaggtggatcatgaggtcaggagatcgagaccatcctggctaacactgtgaaaccccgtctctactaaaaatacaaaaaattagctgggtgtggtggcgggcgcctgtagtcccagctactcrggaggctgaggcaggagaatggagtgaactcggaaggcggagcttgcagtgagccaaagtttgcgccactgcactccagcctgggggacagagtgagactctgtctcaaaaaataaaataaaataaaaaataaaaataaaaacttgaattattagcatgaatattgcagttctttatattatgcaaaaccagatttaaataagagcatttaattcatatatggaattgccaagttataccattagtactttacagcacatcttgggaggttcccttgaactagccagaagaagcaaactgaagccagacagaggaagattgcaaagaggaagagagggtctccaccaggcacagagccacccaagggagccctccctcaggctcagggataccgagggagccagagcagattcacacaggtccctggggcccctctgccctggtgactctaggatgcatgtacttgcacctgacttctaggcatccccctcctgctagctwcccctcgatccagcctggggcaggctctgtggaagtcaagccttgcatctccctytcccaagcacctaccatcctaacccacagtgtagtggccacgtccaagggtctttacgtctctgcctcagatatgctaggtacctgggtcaagagtgacccagagactcatccctgccagacccaacctccagccagtcaccctctgactccagtccatggggcgaggctggagtgctggccctgacctctccagcatctgcaccaggagggcttcagcggaatgtggtcccagttgatgccccatgccaacagtagcagcagcagttgttagscatagagattgaagccagacagggcctgggattcctctgctgggagcctaaactgcaggagatggggaaggatccaagtgtgagctggggctcctagcacaaaactcacattgaaagatamaatggttaagaatttcaggatagccacaggagaacctcaagccaagtgtaggatccttctagctgcagggcctgggggtactgagactagccctgttgacaggagccatgctttaggaagactgatctatttgtagtcagcaagagttttaaggagctccattaacaatttaggcacgatgccaagatgggatattatattttccaagcaagaagaatctggtaatcaggcatatggttccaagtgaagtataagtcaccagaaagcaaggaaggaagccatcccctggcccagagggggagaatgggrtgtgtgtgtgtgtgtgtgtgtgtgtgtgtgttttctcggctgctgaagagactgagtgttcctgcagatatataacaaagatgaagatgtgccaccgttggagacaaatggggaccagagrccacatgtcagaggtcaggtcaggtgttcaaatataaaggggttgccctggctgggcatggtggctcacatccataatccaagccctttgkggggctgaggccggaggatcacttgrgcccaagagttcaagaccagcctggacaacatagcaaagccccatctctaaaaaaaaaaatacaaaaattagccaggtgtagtggcaaatgcctgtagtcccagctacttgggaggctgaggtgggagaatcrcttgagcccaggaggcagaggttgcagtgagccgagatcacaccactgcactccagcctgggtgacagagtgagaccctgtctcaaaaaataaagaagttgcccttctacaatctggatgtggtggtatctaggggaatgttcacaactaggcaacgcctctgctgtggattgattatgggagatgacatcacacatcaagatatctcagcagatgtttctcaatgggtacagtattatgggattagttccaggcagtcgtgcttggatatctcatgggtggtggagtctgtagcaaggctggaaattttgacttggaatcacttggatttctctaagagaataccccaggttggatgtgttactgtggcagcagagaagacttaaaaattacattgtttttagcttgaacttcgtcttgtgaagtcctaattagggaagaggagtcaggctgggggtctaggggaaagcaaagagataaagcagataagccataggtctaccttgcttcatggtccaggacatacaaacaaaaagaagaagcagataagctataggtctgcctttctttatggcccaggacatacgaccctcctgcacacataactcacaatcttcctgcgtatcatcaaatgcttcaacttatcatcaaacatctcggctgaccgaaaaatgcaagttagctccctgctaccttggcgttgtcagtcctccacatagcactcttcagctyaaattgcattttataaaatccccagcaagcctttgtctcctggcagtcaactcgtctcttactgacctgcccattgctcccttgcaatgtattttcctactttctctaataaatctgcctttcttgacctaaactgtcatggtaaattcttcttamtcctatgtcaccagccacagacagtcgccacaagccatgacaagtctgcgatttcatggtctttttttattttgatgatatttccccagtgtttgggggacagaagaatgcccacaatctataggtcttagtcacatggatggggacagaatatctgagagagagagaaggaacaagatctactggggctccttaaaattcttcttgaagaactcctttctcaccttggagtagggaagactttctgatkatgactcaaaatttagaagctaagaaagaaaatacctttaaatctgaaaacataaaactcaaaaacttctgggtgtttttttgggggggttgttttttttaaacagcacaagcaactcaaagggcaagtgacaaactggggagagaagaaaaagatgtgactcatatcacagtttcccttctacttaaaaaaaaaaaaaactgcaaaccagtaagaaaatagcaacagctcaacagaaaaattgccaaaggcacgaacagttaatgagaaggagatgcaaatcgctcttaaacctatgaaaagatgaaggtgttccatcacaaagagtaagagaaatacaaattaatattaatgtgaaagacaacttttcatttatgaatttgagaaaaatccaagaacttgatgatatacctctaagaagcaaygktagggaaacgaaaattctcacacattgcaggtggttatgtaaattggtatagccccgcgggtggtcagtgtgacagtttctatccaaattacagatgcatagtttcattgccaggtctcttctgtctgcttcttcagacccaccctcccctctccccactgtttagttggcccaggaccctgtctggtaaggatacaactccaggccccttgccctatggcttcyggttgtgttcagccratggggagccscaaataagagaaggaagggacaccgtgagtgatatttatccctcagcttcctgcctgcactgtcctcttggtctggctgtgtccagtggtctcatgtcatagctgctcatacaggagtttctccttacaaattgcartgttggcttctcttccccctccggcccagagtgattacagccatcaatgttgtgagctacaggttctataccctcccttctgcaggcccagaatggtaacagccctcaatgttgtgagctgcaggttctgtactctccctcctggggcccagagtggtcacagccctcaatgttgtgagctacaggttctatactctcctttctgcaggcccagagtggtgacagccctcaatgttgtgagctacagctctcaatgttgtgagctacaggttctataccctccrttctgcagacccagaatgttacagccctcaatgttgtgatctgcaggttctgtactctccctcctggggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctggagtctcccttctgggccccagagtggtcacaggcctcaatgttgtgagctgcagattctatactctcccttctggtttgcctacagccctctcacacatttgtaaatatagtcctgcaacccctaatgatgtcttgggcaaagatggaccttttatatgacgatagccccataagattataccatatttctactgtaccttttctgtgtctaaatatgttcagatacacaaatgccactgtgttgcaactgcttacagtattcagcacagtaccatgctgcacagatttatagcctaggaacaatagtctataccatataacctagatgtgtagttggctatgctatctaggtttgtctaagtatactctgatgttcatacaacaaaatagcctaacaatgaatttctcagaacacagcactgttcacagttgcaaagatatggaatcaacctaagtatccatcaacaaatgattggataaagaaaatgtggctaggtgtggtgctcacatctgtaatcccagcactttgggaggccaaggcgagaatccaggagtttgagatcagcctgggcaacatagtgagaccctatctctacaaaaaaaaggtttttttaattagccggtgtgtgatgacacatacctgtagtctcagctacttagggggacaggtgggaggattgcttgagcctgggaggttgaggctgcagtgagccatgattgcaccactggcactccaggctaggcaacacagcaagacccgtctcaaaaaaaaaaaaaagttacatatatatacacacagtatattcagccataaaaaagaatgaaatcgtgtttttgcagcaacatggatggaactggaggccattatcttaagagaaacaactcagaaacagtcaataccacatgttcttataagtgggagctattaataaaaaatgtgcacacattgacatatatataatgtggaatgatagtcattactgactgagaagggtggattgggtgtggggagttaaggaatgagaaattacttaatgggtataatgtatactattcaggtgatggatacactaaaagcccaaatttcaccactatgcaatatatctatctaacaaaactgcacttgtaccccttaaatttatttttttaaaaagcgtgtatcctaatttgaatgagctgtttcttgccagaaccctaactgatatgtcctttgtctagcaattctacttctggaaattttcccacacttaaactggcacatgtgcaaaatgaaagagatttccttgcagaagagactggaaataattcaaatgtctatagtaggggtactaattatataaataatggtgtgtctatagagtagaactgtatccagctatttaaaaaacaaggatagaaagatcttccaaacatatttttaagtggaaaaagcagggtggaacagggactatacatgctatctcttgtctaaaagatggggaaattaggaatatgtatttgtttttgcttatgcatgaarrtactctgaaggattcacaaaagaaaaaaaagttttctaaagggagcaagacttttcacaattttttttttgaatgcttaaaattgttgaacmcaacgactgttgcctgttcaaaagttaaatttaaaattcctcccagactaggtaggggattgggcccagaagctgagaccaggctcacttgaataaatggggtaaatgactaggaattttactattccttacaggtctctcattatcttgtctttgctcccatttttatatttgcagtttaattagacacttcagaattttgatcacctaatgttgatttcagatgtaaaagtcaagagaagactctaaaaatagcaaagatgcttttgagccagaatgcctycatcntcagatcacttaatttggttctcatgggtaagtgctgctttttatcttagytcttatagaagcaagctgtgatgccatcctcactgagagcactggcaggaagtcgcaaactcatttccctgactagaggacccagtaccaccctgcctagtgtcaggagttaagtggaaagcaaataggaaacctacactagtagtttagattcaatgtagattcctgtcctgttgttaattttaggaaaacaaatgagtgacttaaggcaataataatcaggactatcctcgccataatttgaagagtaatttctcctaacacgctttcttcctccccaatctttgataaatgtcttttacctctaaagttgattaattagcaacatgcttattcatattctgtgaatatttctaggatggacaattgcctctgaggacattccctcagccagcccaagtacttaaacaaaaacaaggaaattctttgatgttaaagatctcgtgtgtgtccgggcgcggtggctcgcgcctgtaatccctgcactttgggaggccgaggcaggtggatcatgaggtcaggagatcgagaccatcctggctaacatggtgaaaccccgtctctactaaaaaatacaaaaaattaggcgggcgtggtggcgggcgcctgtagtcccagctacttgggaggctgaggcaggagaatggcatgaacctgggaggcggagcttgcagtgagccgagatcgagccgctgcactccagcctgacagagcaagactctgtctcaaaaaaaaaaaaaaaaaaaatctcgtgtgcgtgtgtgtgtgtgtgwgtgtgtgtgtgtgtgtgtgtgtgtgtgtgttttgaggcatagtttcactctgttgcccaggctggagtgcagggtgtgagctcagctcactgcagcctccacctcctgggttcaagcgattctcctgcctyagcctcccaagtagacgggattacaggcacccgccaccatgcccggctaatttttgtatttttagtagagacaaggtttcaccatgttggccatgctggtctcacattgctgacctcaagtgatccaccgccttggcctcccagaatgctggggttacaggtatgagccactgtgtccagccattttttttttttttagacagagtctccctctgtcacccaggctggaatgcagtgagcgatctcacctcactgcagcctccgcctcctgggttcgmgctattctcctgccttagcctcccaagtagttgggactgcaggtgtgcaccaccacacccagctaattttttgtatttttagtagagacagggttttgccgtgttggccaggctgatctcgaatcctgaccttgtgtgatccacccacctcggcctcccaaagtgctgggattacagacgtgagccacgacgcccggccccagatatatttttaagtggaaaaagcagggcagaacagggaccrtacatattgttgttagtgtcagctcccaaatggatcttattttatctcagatcacagtccttgcaccatgtgctgctggcaccaatgtagagtaaaaaccatctatgtgggcatttttttggcacaagaaaaatctcaatctgataccaataaatgtgtgttaaagaatgtcagacttagagtaatcattgcaagttgagcccagataaaactattgcctctctaatgtgttttcttccttctagtgtatatcagcctcgtgtttggtatttcatatgattcgcctggtaagagatgttttttggcttcactaaattttgtataagagtgaaagtgttggggcaaccattcagaggtataaaatgtgggagatttgatttctgattgtacatctgttgcctgttttattgggattctttctctgyaaaaggagctaaaatgagctaactctggttttttgagagatacaaaactagtctaagaaatgaacactagagatcatttttaaacttctttaaagaatattcaaactcttaataatctcactaataaaagaatgaggagacacagactgtgccaaataaaaaatggcccagaaatatttactctttaatttacattcttccaccctgatgattccagacaaaggacaataatttttttttaactaaacttcttcctacgtatataaatctgtccacaaaacttcactaagtattaaatatgtgtccaaccttgtgctaagtgttggttgggggtgaagagttggcagttgagaaacaaaggcctgagtcctaaccacaggaaacttcrgtgatctttaaaaatttaaccgtataaggcagaatttggcaagtctggctttaatgtctcatttatcactgccacttcccacctacatgacattgtataattcaactcagtttcacagtctgtaaaatgaatcttttcatagtgcctacttcagcattgttgtggggcttaaatgcttagaaagggccagtctgggctcatgttatactcccctgctctctgtgatccagggaataagtgagctggggaatccagaggaaggaaaatttgcagcgggctgagctacttaaggaggacttcatggaggagctgggagcagagttgagagaacggcttggggagggagaatgggtaggggagagtgaaaggaagtgcatmatgtgggctgggatggcctgggttattttggtccagtgaaccatggagggacagtccaagggcatcggagaagcccttctgtccagactctccttacacagtgcacagtccctgtttcccatgcttgcctgccctgacaatatgttgctcgttaattgacttactaatttatttcccatgtcctgtagacttcctgttttcaagacaccagggctctctggagaggttatctgccagaggtgtgggttctagatcccaagaaatgactgaacagtggccagaatacaacygtgggttccaaatttcaatgccctttttcttcttctctttagattacacagatgaatcttgcactttcaagatatcattgcgaaatttccggtccatcttatcatgggaattaaaaaaccactccattgtaccaactcactatacattgctgtatacaatcatgaggttggtttgatatttcattttctcttggtaaacatattattgttctgttatatggggagaggtgatcttttctctctstctgtctctccctctcccttttcctatctacctctccttctctctgcgtttcttattcagagccttaaaaagccaaagacaaaacaccatcacacatccatttttaattcagttgaatactttaataatccaaatctattttgacaaagcttgtatgtgtcatcaaagccaatttctacaggtcagaacctcacatacaaaataattcttgtgtatgggttaggcaatgatttctctaattcagtcagtctgaatgtttaaaagtcctgttrtctgaggacaggaatccaaaggtctattgaccatattgatggtttatgttcacttttctttactctggtgggacaccagaaagctgcctggcctagtctgggacaggcctgggtccatagtctggtttggtcactaaccagcttgacacttggcacggacctcagcccctaagctaatgcctctgctgaggggttgctgcaaggattcgtgacataatggwtggagtcctgcttgtcttttgtcttcccacacctaccaatcgcccttagaagtcattgctttgatccagcagccccttggagtgtccttttgwtggttatttatttggcctagagctgctgctgctactgcttattgaytgagccagtgggagacctcttgtgagtttctcttcggtgcctgctaaaaagtttttctctgcattgagtggtcacatgtatcatccaactaactgaagcttggtagatgagatatctgcattgtccctgaaatagcccaggtctgacttaggactggatcatctagtcttagccagagagggagggggtctcaggraaggcattcataattgtcccatagaggragggagatctgaggcttccaccatgagggcccaagtttcattcattcatttactcatccggcaattttttttttttttttgagacggagtctcactgtgtcaccaaggctggagtgcactggtacgatcttggctcactgcaagctccacctcccgggttcacgccattctcctgcctcagcctcccaagtagctgggactacaggcgcccgccaccacgcccagctaattttttgtatttttagtagagacggggtttcaccatgttagccaggatggtctcaatctcctgacctcgtgatccgcccgccttggcctcccaaagtgctgggattacagacgtgagccactgcacccggctcctccggcaagttttactgagcacctactacatgccagggggtccaactgtgaaccaaagtccctgccctcctggagcagacattatgtaaatggagacatcagtaaacaaaggtataatgtgacaggtgtgggtaaatgctacaatcaagaaaagagagggattgaaagtgcaggggtggggagggcataagatgttccattttcaataagatggttggggaagatcacttaatacaatgatatttgggcagagccctaaaggaaacaatgaagtaaggcgcccaaaaatagactctcattacatcaatgctaacaatttcctttttccatttttttctttccaaagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacagtgagttttatctctgtttctccacttcgtccccatcatcaagatctttattatttgctattccatgaaataggaggtctacaaaggtgttttagacctggggctgggctcacctcttggccctgccacttcctagctctgtaaccgtggactgctttgcttctctgagccttggttttctaaatctgaaaagtggaatgataatttgtactttgcagatttgccccgtgcctgtataaggcagtaggarctgctgttttcggttttgcagcctgacaggaagtctggagccaggttcaggtgggctggatctagcgctctcatctctctggcccaggattttctttctttctttctttctttctttttttttttttttgagatggagtttcactctgtcacctaggctagagtgcagtggtgcgatcttcgctcactgcaacctccaccttccaggttcaagcgattctcccacctcagcctccagagtagctgggattacaagcacacaccaccatacctggctcattttttgtacttttagtagaaatgtttcaccatgttggccaggctagtctcgaactcctgacctcaagtgatccacccgcctcagcctgccaaggtgctgaggttacaagcatgagccaccacacctggccccagtgttttcttaatacagcaactccaccccctcattataacccaatgttcttttgtgtgtgaacaccaagtgtgcatgcacctagtacccaaagctcagaggagaagactagaccccaagaacaggcctaccccttctttctttccctgtgactcaagtcagttccctaacacactgtgttaacagccccagctgtgttactttttcaatttcccactttacaacgagtttccaagagaaccatctggtctcagctycctgttgtaggctatgcgggtgtgcacgtgctcatacatgattagcaaagtggtaaggataactgaatccccctgtggcaaacaattcggataygacatttgctggatttgtgtgcatgtttacgtatgtgtataaacagacatctgtgtgtacacacagaaaagaaagaaaatcagaatttatagttcatggtatttgggttgttaaagaatgcatattaaagtaacagtgagatatgtttcatggctcaaatgataaatatgaaaaatacataaatatccaggtttagagggamtacaaagagtgtgctttggcatggtccatctgaagtaattgrcagcatgtattaaaaaccttaacatgtgcttactctaatccagaattctttagtaatttgtcccaaagaaattattaaggccaggcacagtggctcacrcctgtaatcccagcactttgggaggcctagaccagtgtatcacttgagctcaggagttcaagaccagcccgagcaacatggggaaaccctatgtctacattaaaaaagaaagagagaaagaaagaaagttaggggggagggagggagggggggagagagagagagagaaagagaaaagaaagaaagaaattattaaggacaaatgcaaaaatttagttccaagaatatcccatgatacattaagtctttartaaaaatcagagacaatttaaatgttcaaaacagtgaatcagttaaatcatgatacagtcacttagtggaatagcattagcaatgaaaaattatgatgtaaatcaggacttggcagattttctatacagggccagagaagaaccactttagactttgtgggccacatatggtctctgtgacatattcctgtctgtttttgttttttgcacagtgtcttttgaaccaccagagtttgagattgttggttttaccaaccacattaatgtgatggtgaaatttccatctattgttgaggaagaattacagtttgatttatctctcgtcattgaagaacagtcagagggaattgttaagaaggtaagtggcttctcctgttaggatcaaaacagttctgagtgggcaatcaatgcacttgactgtctcttttgaaaggaaatttgcagwtgaacaattaaagctaaaacgtcaggcttcagtatggtccgacttagggaagaagtcactatggttcattcactattgatctaaacctgcagcacagtgttctttaaaagaataagccacggctgggcctggtggctcacgcctataatcccagcactttgggaggccgaggcgggcagatcatctaaggtcaggagtttgagaccagcctggccaatatggtgaaaccccatctctactaaaaatacaaacattagctggatgtggtggcaggcatctgtaatcctagctactccggaggctgaggcaggataatcgcttgaacctaggaggcagaggttgcagtgagccgagatcgcaccattgtgttccagcctgggtgacagagcaagactccrtctcaaaaaaaaaaaaaaaaaaaaagagtaagccacatgcacaacatcaaggaacacacaggagagagggtgtgggagggagatgcagagtacagccaaatttcagtgaaccctggagagatttatttgaaaaggagagtttagctgagccacccgtgaaaagcatctgtcgctgcctctctggccctcacacacagtaaggaagtggcttatctggcaggttctgtcctctcctaatttctgcaaaggacctgactctcagtaacctcagggttatctggtatcagacagccctgcatcttcmatttttgttgtccctagccctccaaatgctggaataagtggaaatggacaaattgctctcaccggtgtagcagcagcttatgtctgtagagccctttgccaagtataaaacccttgcaagtgagaccagcctgagagataatcagggtagatgcatttcaggcggagggcacaggaagttcaaaggctctgaggctggagtgggcccggtgtatttcagcaacagcgaggagaggtggctgaactggagtgaccaggcaggagatgaagaggaggtgaggtcagagggtaaatgtggctggacctggtaggagtttgtgggtctgggtcttctgagtgtgatggaagcctgtggaacccaaggcttaacagagcatcctggctgggctgttaaaaatagaccacaggggcaaagatgggagttaggagaccaactaagacacaatccagggtggcagtcacttaagaggcagtaacaaattatatgattattatcatttttcttttaatatcgacatggattataatcagtactctaggaaaaggagcaaaaatgggtgaaaaataagtttatgtggcctaaggactrtgtggagtgtcattaaatctgtttcaatcatgtctcgtttgtgttcaccccataagcaactaactctatgttttagattatgattcctaaaataagagactgttgcttattaggatattgactactctataagaggaaaaactgtagttaataggcatcttcttcataaggaaaattagcctttaaatccagaaaaaaaaataagctactagtataatctaagcaacagatggtggtggcttggaccttgatagtagaggggtaatgagtagtgagaggccatcaaattctgcatatattttgggttttgtttgtttgtttttgagatggagttttgctcttgttgcccaggctggactgaaatggcatgatcttggctcactgcaacctccgcctcccgggttcaagccattctcctgcctcagcctccctagtagctgggattacaggcacccgccagcacacccagataattttttgtatttttagtagagacagggtttcactgtgttggccaggctggtgttgaactcctgacctcaggcgatccacccacctcagcctcccaaagtgttgggattacaagcatgagccaccatgcccagctcataattctgcatatattttgcatgtggagcaagactaacttccccattaactatggaagatgatgaatgaagcaggtgagggttagatagggttagagggtttgggacatgttaaattccaggtgtccgtaaggaatctaggaggagacgtggggaaggagctggatgtgccagtctgttgtccaggagagaacccgcagctagagagagagcctgggagtcactggcttcttggtgcatgttgaatgccctaagaccagatgaggtcacctgggaatagacactcagagagaaaacaagacatccagtgacagagcccaggaacattccaaaatttggagatctggcaaatgaggaagaaacagcaaaatcgactgagaaagagcaaccagcatggtagggagagaagcaggtgagagtgatgtcccggtagctgagagaagaactttccagaaggtgaaagtggtctactgagtccagtgctgtaaatgggacaattgaagaggactgactattggatttagcaacattgtgtccttgataaaagtagttttaatagagttaggggcaaagagctggttggagtagattcaagaaagagtgggaggagaaaaattggagacagtgaagagagctcattcttccaaggaatttttccaaacagggaaggagattgtgtgctggccactggaggggaagcttttagtttgttgggtcgtaagtttgtttgtttactaactcctcctcccaaacagaaatttacagaaaaacatcattactgaaggctgtatttgagctgctaggaatcctcatttattaaactgctagtaagaatgtattttaaaaactgtaaaacatgatacaaaagttattattcatgaaagagccttcatatcatcttttaaattctgaagtgaaatgcaactacaggaaagaagaggcaaggtgtttaaagggagatggctgggcacagtggcttacgcctgtaatcccagcactttggaaggccaaggcaggcagatcgcttgcggtcaggagttcaagaccagcgtggccaacatggtgaaaccccatstctactaaaaatacaaaaattagccaggcatggtggcgggcatctgtaatcccagctactcaggagactgaggcaagagaatctcttgaacccaggaggtggaggttgcagtgagccaagatcatgccactgcactccagcctgggcaacagagtgagaccccatccatctatctatctatctatctatctatctatctatctatatctgtctattgataaagggagaagatgagaaactagacatcagtcagttttgtcacagacaagctctgtgaccttggagaagttacttagccacactgagctacagttttctcatccgttgaatggaggtaatgcctattttgcagactgttttgaaagtcaaaagggttaatgtttatgaaggcactttctcaagtgtaaagtagacacacactgtccatgagagaagataatcttgtaaaaatgacgtcacagagacttttattcctctttgaagacttttatctcatttgtaaaatgaaggcgctagactagatgtcatggttataaaatatgtgtgtgtgcaggtgtatattaaaagtgcatgtaggtgtagttttctgataaattacttgctccagatgacttataaatcctttttcttaccaagcctgtgataaatctaaccctgtttgagatttgaagacaaatcccaaaagagattaaggcctrcctctaaatgaaattctcagtcttactgattttttgcttatgtttacagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcaggtatgttcatttttttaaattcatgttttgagtattcatgcttttactctgagggcaagcctatttaaagaaaagaatctgaaaagaattcatggagcactaaaggtctttcttccagtaaacacctcacagagatgttttctgttggttcgtgtgtatgatctggtagagtcacttttatattgtcataccaaaaaacaatcagatactactcgatgagatcagaaatcttgaaatggaaacgcttttgtttcagggagtcaggattaaattcagcrctgtgtgccctttgtgtggccattgctgaagccaaatgccagaagaggtggagttgcttgagacagtggtatacagtggcattaaggggtgaaaaggtggaagcagcgaggttgggtgcagttcatggatgtgatctggcatcagctctcgctcatagatgaaaggaacccttgccmgggtgtacgagaaaatcactgatgaaggctgaacacctttctgttacacagacatcagaacaataaacagtgtgatcccaaaccttcttcccctttggagtgagaacaatcaagcctcggaactccctgctgattgttttctcaggaagtagccaagtttccacctgttttaccaaaagtgagaagctatgcaagtctccctcaaagaagcccttctaaatgtcccaaccgcagtgttaggggaaagaggtcccaatccataccccaagagagggttcttggatcttgcgcaagmaagaattcagagcgagtccgtaaagtgaaagcaagtttattaggaaagtaaaggagtaaagaatgactactctatagacagagcagccccgagggctgctggttgcccatttktatgattatttcttgatgatatgctaaacaaggggtggattattcatgcctcccctttttagaccatgtagggtaacttcctcacattgccatggcatttgtaaactcatggtgctggtgagagtrtggcagtgaggacgaccatcttggttttggtgggttttggccggctttactgccatctgttttatcagcaaggtctttaccaacggtatcttgtgccaaccccctatctcatcctgtaagttacaatgcctagactgtctgggaatgcagcccagtaggtcccagccccattttacccagctcaagatggagttgctctggctcaaatgcctctgacaccaatggaagtatctttaatgttctgatttaccagaataaaaataaggtaggatctataaagaaattactttagttgtaaaccaaaataaaattctaagccccccaaccaactgaatggatccctcctctcagccaagggccgagtaaagtaaagtaaacctgaaacactagttcaggccatgatgggagtgagtggtccagacgtgcctcacgggaccttcctacctttggaattcaggcacagctggccagcactaatattaaaacagaaaccttaagactgacaaaaagatgctttgtagcactaatamcagcatgatggatagcaggccctaaaagaaaccaaagtgttttaccccaaaatacatttctttgacatattttgaaatggccctgcaaagctgtctcttgcagggaaaatctgctttctataaagaacccccttcccagtccaggtgttcttcctgatccaagagagaattcactaagagtctggcacttttttaagtcyrgtaagaaacatttacagtctgttctctctgaagcctgctaccagaggcttcatctgcgtaataggaaccgtggcctccgcaaccctttgtcttaacccagatgcttccttttattaattccaagtttttaatcagaaaatctttgaatctacctatgacctggaagcccccccacttcgaattgtcccacctttccagattgaaccagtgtacatcttacatgcattgattgatgccttatgtctccctaaaatgtataaaaccaagctgcaccctgaccaagggttctcgggatctcctggggctgtgtcatgggccattggtcactcatatttgactcagactgaatctcttcaagtatgttactgactttggctcttttcattgacaaagtgatatggtcacttgtgaatgaagtgagccacggaacgttgcctggcacataacggtgctctgtgttggcttcactacagggcaatatgatttgattctctagtgttcctcaagaccagatgatgcacaggctggttctaaaggaaaaaacatgtcaaacacctttagcgtaagttatttttatgtcagcaaatacaggcaaacttaaaactgcatatagattctgactatagctctttcaaaaatataaatccaaaataaatgtgcatgtctttgttctaacaccagctatctgacactaactagttgtccaatgattccattcatttctgatactaccccaggttagcacagaccccacaggttaaaggctcagtcccacaaaactgcctgcccccacttcagatgccagccacaagtcatgggtgacaaggttccctgcacttccacctgacttggctacaaattcaggagttcccatgacctccctttaggtttgataatttgctaaaatgactcacagaastcaggaaagtgttatggcttatgattaccattttattataaaggaattgatggacagccattgaagaggtgcacaggacaaggtctgaaagggtcccaagtgcaggagcttctgtccctggggagtcaggtgtaccaccctctctgtacattcatctgttcatgaatttggggactccccaacccttggtgttcacagtttgtattgggtttcattatgtatgtgtgattgattaaattactggctgcaggattgaactsagtctccagcccactcccctccttggatagaggtcaaatgggggagctggaagttccaaccgtctgatcatgtggttagtttttctagggaccagccctcatcctgaagctatccacaccctgccccatcacctcacaagcataaactcatatgtggcccctaaaagaggcttgttaacaaaagacactcctaacgttcaggaaattccacaggtttttgaagctctgctccaggaactagggacaaagactggatatatatgtatattttattatatcattgattttacatacaaacgaaactcttatagacaataaaaactgaaattagtgacctggcagacagatggtggtttattgaaactcagtccccagttccaaggtgaatgtgttgctgatgagaaggcacaagctccttggaggttgatgaattctgtgatgactcactttctcccctgactcttttccatttcacctactaagatgttcatgtaacaacatcctctcaggtcattccatttttacttggcgtgaatgcgtcatgttgcacatcaagtcagccctcattctttgattattacccgagataggtcaagtaccgctctctttaattatccaaatactgtacctgatgtcaaattcttgtttgaaactcaggaagcaaataggttcagataacgtggcctctgtcactatctgcttgccatctgacgtgccctcaaccagccaaactcagaaaccagacaggtttggatggtgaggggtcttggaaggatagcctgagaccagcattaacataggctcagcagtaagcactgtgacccaatcctagggcagactgatatggggggattttagcccagacatctggagaaacaccttccccttgtcaagccttaaaactaatggtttgtctcttttattaatattaaggccctaaggaaaagctctattcattcatttgacaaatgtttattgggggcctgttatgagccagattcttttctggatattgaggatttagcagtgaacaaaacagattaaaaacttctcaccttgtggagcttacattgcagtaggagacagaataacaagatcaacatgtaaaatagacagtatgttaagtaagtaccatggaaaaaaattatgcgggaaaggaggtgagggggatgtcaggttgaggagagcaggttgctgtttttaataggatagtgtcttgatttgcatttgctagaagcagagcctgggatgtgaattcatattcaagtgtgatttattggtgggggcatcttaggagaaggggaaagagggaacaggtaggtacagggagagagaaattaagcaggcatgtggctctcagctgagcctgatcccaaggggttctcggaagcgtgaactgtatcctcaagtcagcagccagtcagttactggtggtgatctatggcatggcctccagatgaggcagcccccttttgggcaagggcagttccttatgtgtccggagttggttcctgccaatgggttcgtggtctcgctgacttcaagaatggagccgcagaccttcctggtgagcgttaacagctcttaaagatggcacagacccaaagagtgagcagtagcatggtttattgtgaagagcgaaaggacaaagctttcacaccctggaaggggacctgagcgggttgccactgctggctggaggtggccagcttttattcccttattgtcccttcccgtgttcgtttctgtcctatcagagtgcccttttttcagtcctcctcgtgattggctacttttaggatcctgctgattggtgcattttacagagcgctgattggtgcgttttagagtgctgattggtgcgttttacagaatgctgacttgtgcattttacaatcctcttgtgagacaggaaagtccctgattggtgcgttttacaatcctcttgtaagacaagaaagttccctaagtcctcactccacccaggaagtccagctggcctcacctttcacttagagaaggatcagctcwgagagatatcagcagacacgtgcggcagcagtagtgggtgtgcactgactggaaaaggggacatgggcaggccacccacagcatccaccacagatggccacagatggccttcctgagaaggtagcatttgaataaagacccaagggagatgtggtaagcagaataatggcccccaaagatgtctacatcctaatcccagatatgtgaacaggctaacctctatgccaaaggggcttgtgggtgtgatgaaattgaagatcttggccaggcgcagtggctcatgcctgtaattccagcactttggggggccgagccaggtgaatcacctgaggtcaggagttcgagttcagcctagccaacgtggtaaaaccccatctctactaaaaatacaaaaattagccaggcgtggtggcatgcgtctggagtcccagctacttgggaggctgaggcaggagaatctcttgaacccgggaggtgggggttgcagtgagccaagatggtaccactgtactccagcctgagctacagagcaagactgtgtctcaacaaaaagagaagcaggagactcagaggcagagaaggagctctcacagcagcagcagaggtcgcagagtgaggatgaaggagggggccatgagcaaaggaatgcaagtggcctctagaagctgggaaaggcaaagaaatgggttttcccctagagcctccataaggagttcagtcctgccaacatcttgatattttttatcccagtgaaacccattttggatttctgatctccagaactattaatataatatatttatattgttttatgacactaactttgcatcatttgttacggtggcaatgggaaacaaacacaaggtgagggagtgagtcacgcaaacctatcaggggaaggagttccatatgcggggttcagcaagtgccaagtgcccgaggcaggatatgcctggcacggcacggcaggagtgaactgaacaagggaagaatagtaacagttctggtcagaaaagatggaggagcctgaatgacatagaacttagaagccgttgcaagagatggggaccctcagagggttgtgagcaggttgctctccgtgatctgacgtgggatgtaaagggaacatccatccacatgccttgaagtgggagccaggtgacccctgggctgattactgcagtcacccaggggagaggcggtcttacttgttccagagaggtaagtacgggaggaactataagagactgatgttagtcatcgccagtcttttcataaagttctttatcttttccattaaagatcattgtgatcagatattaccaaccccgttgctcagttcagccctctgcttgtgaggtttcttattttttgcttaaaatatctccacagtgaatccagagacagacaggtttgtccaaggccaaatttttaagacacgacctggtctctccttcccaagatgggttgatctggtccatctttcatgaagaagatagttaacagcagtaacattcaatcacagcttctcctttctgagtcagaacattgatgggattcatctcttttcaaatatgaatatttaaaaatagcatgcatgtataattgtcatgaccccaagtgagatttctattttttagattatcatcaagctgaaaacaaacaaaaattctaagttctcctaaagaattctcagactcatgagaataccccaaattgaggaatattatcctagcatattaactacaatttacacaatttggtttggacatagagtgcattgtagctgttatatgcaagttggatgggtacatgagtcacaatctctgtattatgccattccttcaccagtgaaatcactttggtttacagtacccctttcaagaatgtaaacgctatacatgtcagaattttgtatcctaaaggcgtgcctctgtggctagatctgattctggaactgtcattgatatgacaatccaatccttcacactcttgatggaggtgagagtggattcttgaaccctgtgctatctaacagtgtttttactgaactatcaagggtttttactgaacttctttctattcattccttaaccttctggaagacttagagtacataatccatttgatttccttttttctcccctctatctatttttgcctgaggctatagttygaggattaatactaatgaagacctttctggaagtgcaagagagccttagtgatataactactgatttttcagtcyggtcgcacttcaggaaaataactatggtcagtcaaaaagctgaaattttccaaaaggaattttgatgagaaactaaggggaactgttaatagagcaaggcaggttctgcagagccctgacttgtggccccagcgtggctaaagtccagcctcagaatgacccagttggttgttttcaagcaaactttccttccccacttcttcctgcccgcagcgcatgctaaccagtgtggctaccgaacgtttgagatgtgtttcatgtgactgagagaccgagctcttaattctgtttaattttaatcatttaaattcagccagctgcagccagtggctactccactgtacagtgcagttatagaacataaactgaaggaaattttacttttaaaagctaagtctattttattgtttaaaaaatgcacacttagataattctccagtctctggtatttctcaatataaaactgttttttcaaacctttggtttcttgatcatcttgtaacaccaggccaatgtacatttatttccatctgcaattgtttattgcattttttgaaataaagtcatttaatttttcatcaacagaatcagcagaatctgccaaaataggaggaataattactgtgtttttgatagcattggtcttgacaagcaccatagtgacactgaaatggattggttatatatgcttaagaaatagcctccccaaagtcttggtaggtagtttttttgttttgttttgttttttctatctttgttttttattttaacttaagaatttgtatttatataaatattttcacagaagaaaatctcattttctataaacaccaaaatgctttctcactctgagttcttttccatatctataaatgtatattttgcagggtttttgttttgtttttgtttttattatacttttaagttttagggtacatgtgcacagtgtgcaggttagttacatatatatacatgtgcagttgtaagtgtatctgtgcatctgtgcattttatgttttctttcctttttttttttttttttttttgagacagtctcactctgtcacccaggctggagtacagtggcgtgatctcagctgactgtaacctctgcctcctaggctcaagcaattctcgtgcctcagcctctcaagtagctgggactacaggcgtgtgctaccacacctggctaatttttgcatttttagtagagatggggttttgctakgttggccaggctggtcttgaactcctgacttcaagtgatccacctgccttggcctcccaaagttctgggattacaggtgtgagccactgcactcagcaatgttttgttttgttttgtttttatacttcatcacataatttataatgatcaggtagaatttcattattattaacataccatttttcatttaaccatttctcagctaaagggcatttggatttcttttccttttcttttctttggtgatgatgaatagtacaataaacatttttatatggatcgtctttttgttttggattatgtcagtggaacatatacacaaagtggatttatcctataaaaagatttaaaaaggactaggcacagtggctcacgcctgtaatctcagcactttgggaggctgaggcgggtggatcatttgagcccaggagtttgagaccagcctgggcaatataaggaaaccttgtcttagagaaaataaaaataaattagccaggcatgctggcacatgcctgtggtctcagctactcaggaggatgtggtgagaggattgcttgagcccaggaggtggaggctgcagtgagctgtgattgcgccactgcactccagcctcggttacagagtgagaccctagctctaaaaatatataaatatcttaaaaatataaagaagcagccaaaggagaggaagttaagaggagtaagtcagaacatagtctatgtggccagcagcctgcctggtttgaaaggcagctgctcccactcactagtcacaaaccttgagcaagtttcttaacttctgcacctcattttctcatctgtaaagtgggcataagaatagtaagcctggccaggcgcggtggccacgcctataaacccagcacttcgggaggccaaggcaggtagatcacgaggtcgggagttcaagaccagcctggccaacatggtgaaaccccttctctactaaaaatacaaaaatttgccgggcatagtggcgggcgcctgtaatcccagctactcaggaggctgaggcagagaattgcttgaacctgggaggtggaggttgcagtgagccaagaccgcactactgcactccagcctgggcaacagagcgagactcccgtctcaaaaaaaaaaaaaaaaaaaaatagtaagcatacctcatagagcagttgcaagggaaaggtaaattatatataaagcaccaagagtcatgcccagcatatagtaagcatggtgtaactgttagctgttattattgctgtcatcatcatcaactgcatcatcattcaatctcattaagtttattttttatttttttagaggcaaggtctcgctaagggctggaatgcagtggctattcacaggtgcagtcataatgcactrcagtctgaaactcctgagctcaaacagtcgtcctgcctaagcttccccagtagctgggattacaagcgtgcatccctgtgccccagtgattaagttttattatgtagaaaataaagagcaaacagtacagctgatayggactctctctctctttttttttttttttaagaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttttgagacagagtctcgttctgtcgcccaagctggagcgcaatggtgtgatcttggctcactgcaacatccscctcccaggttcaagtgattctcctgcctcagcctccctcgcaagtagctgggattacaggcgcctgccaccatgcctagcaaatttttgtatttttagtrgagacaggattttaccatgttggccaggctggtctcaaactcctgacctcaagtgatctgccctcctcagcctcgtaaagtgctgggattacaggggtgagccgctgtgcctggctggccctgtgatatttctgtgaaataaattgggccagggtgggagcagrgaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctrcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttgggatgcctaaacaggcgtatcgcttgaggccagtaattcgagaccagcctgggcaacatggcaaatctgtctctacaaaacaaaattagaaaaattaactgggcgtagtggcatgtgcctgttgtcccagctacttgggaggctgaggtgggagaatggcttgagcccaggaagcggaggttgcagtgagccaagatcatgtcactgcrcttcagcctgggtgacagaaccagaccctgtctttaaaaagggagttggtggggagaggttctagaatgtcatgtagcaaccagtttaaggactgggactcagggatccaactsccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaacttggtgtggtcttgagttgtcttccattggagagcgtacgtgtgccacagattggtgcacytgccggcatctctaggattgcaccaactccctctagctcttcttggtggcctgcaggggcctagggcgcattcacttccctctgcttgactttacgtggtgttctagcgtcagacatcaggcgatgccgtgcattacccaagacactggacagctccggatcttcccgtctaaccactaatcaagttaaaaagaggaaattaacgctttcttagtagtctctgaaagaaactagttatttgcgtaaagatgacttggttttgtgttgtttatccctggggagaagggtaaagaagaccctcaaactggatttgctgctgaagtgcttttaactcacctgtgcggagagcggacttcaagagagggcgtgccggtgctccggacaaaacctggggaatactgaaagccaccaccaccaccgtcattccagcatgcagatctcagtcctgggttggtgttgtagggcatttatttatttgacttgacggcgcctttcaaagcttgcgaggatcccttcctcttcctcgtgtgcatctgccaagcctgtgccccgcgcctcgcgggtggacccgggctggtgggcggggcctgcagcggggtgggagcccggtcgcccggcccctccccaccccgccccgcccatctccgctggttcccggaagccgccgcggacaagctctcccgggcgcgggcgggggtcgtgtgcttggaggaagccgcggaacccccagcgtccgtccatggcgtggagccttgggagctggctgggtggctgcctgctggtgtcaggtgaggggtccgcggggagggggcgcgcttgggaaccgggaggccccgcgagatgccgcccctgatcccatccctgggcgccctgcaagtgacttaagagccttcggggcctcgggagagaagatgcaaacgccacggccggctgctgagacgcaactaggctgctgctgccgtcgattctgtaacaggagaaagccccatccgcgcccggattacagaccgtctgggccctaaactcagggggagactcccggcgtcttttgattccctgtcctcctgcagctctctgctggcgggcgtctaaataaagtagcttccccaaaagacccaagatcccaccgtggctgtcatctgacccttctggagactatcagttcaagtggaggcccccaccagtccccgagtgccctgacagccctccctgaccccaagtctgccccctcagtgccagccctccctacagatgtgcctcccatcacccgctgcacctcccctccttscggttcaggcccgagcaccctgaaatctggattctgtcccccagcgccccagctccatggcttctaaacctaaatccattgaaaccttttctgtcctctaaattgactgcctaggttccaataacaccatggtcacctccttcctttctcatgaactcttccctggccttccgggatacccctccggtttcccgccctgtcaggcwgtctctgcttgggaccctcctgctctgtcaggtttctatgtagctaattgtgatgcccaaggccttttctctccttccctggcactgttcctttgggggatttcagccaaaccctggcattaaacacgggctataggcccatgactcgcacatttatatctctcttggtaccagttgggtgatgggtggtggtttattatagtcttctacttttctacttgcatgtaggtttcaaattttcttttctttctttcttcttccgtttttttttttgtttgtttgtttttttgtttttttgtttttttttgagacagggttttgctctgttgctgtggcccaggctggagtgcagtggcttgatcttgcctcactgccacctccgcctcccgggttcaagcgattttcctccctcagcctcccgagtagctggaattacaggtgtgtgccactacgcctggctaatttttgtatttttattggagatggggtttcgccatgttggccaggctggtctcgaactcctgacctcaggtgattcaccttcctcagcctcccaaagagctgggattacaggcgcgagccaccatgcctggccaggtttcgaattttctattaaaaggtttgaaaataatttctgtctctagcccacatctcttcttggtgtgacctctgggctcattcatctggctgtctccctgacattcctacttcagcctctctccagcatctccaacctaatgcagctcaaatgggactcgtgagttccccagctgagctccaatcggggcaccagctgcttaagcccaaaatggacattgacctcagcttttatgcatcaaatgtatcaggaagtctccagtttgtttttacgtctggaaatatatctgaaatccatgtgcccaccctaccccctcatagctttctgccaccagacaaatccaaggctcctttgtctgtccccattttactcctgcccctccagaaatttctcctcacggctgttcaaagaaaatctagactcctcagcacagccaacctgtctctccctccctcacccacgtggcctttgaagacatggagccatagaggagaaccaagtgctggatgtgggctttttcatgggcatctgttttgaggagaaaagttgtaaatgtttttgtcttattttcatagcattgggaatggtaccacctcccgaaaatgtcagaatgaattctgttaatttcaagaacattctacagtgggagtcacctgcttttgccraagggaacctgactttcacagctcagtacctaaggtgggtctggcctcactattggcaggaacgcaccggaggagccagccctgggctggtcactgggttgggccacaggaggaagggagtctgactacggtcaccgtgtgactgtgacaaccctcagggagcctccctgccagccttttgctgtctgggaaattctcgtggccaccttttctcttttaggttttctagttgtgatggttgacgatttgactgttaatcacagggctgctggcagatacagacattttatcatgcgtatgtagatataatcagccatagtggtaacctcatgctgtgcccatcccagcttgtttgtcacagttgatatattttaaaagaaaaataccactgctgtcatctctaggtatgagtagtattgctggaagtcagcaatgttgagtggatgctacccaagaaactgagatatgcaaagcggtcaggaagccccttgctaccatatatcacctgttcccctccaatggattataacatcatgccccagtgccatgcgcgatgcacataatttgcataatgagtgctcagtttctccgtggttccatcctgaaattaaaagtaagacagctactgactgttaaaaaccccattctcggacaacagcaggggctgtgaaggaagagtgagtgtcaccctagacggtcatctcagtggtgatctgaacgccctctacctctcctgcctgtcagtgtttccctacgcctggtgaaggaagtcagtgccagcactcccttggcagcctgccaccatacgccacatgctggactgcaggtgacacacctttaggccaggcgcaaacagcagcaggaggcccaaggctgacaagccaacacacctgctttctgtgtgactcagaaacatacgaagatagacaagtccttcagtgaggcaggaggaaatttcttcccagatccagctgtcatttcacaaaaatccccaaggcctgctacatcagagaagaagtagaaaggtgaataagatagtcctcgtctgtgcattgctggcttttgttttttaacttttagttcaaaataattccagactaacagaacatttcaaaattttaagtagaatacaaagaatttccaaatagcctacaatcagattcaccaatttttttttttttttttttttttatgagacggagtctcgctctgtcacccaggctggagtgcagtggcgcgatctcggctcactgcaacctctgcctctcgggttcacgccattctcctgcctcagcctcccgagtagatgggagtacaggctcccaccaccatgcccagctaattttttgtatttttagtagagacggggtttcaccgtgttagccaggatggtcactatctcctgacctcatgatccacccacctcggcttcccgaagtgctgggattacaggcgtgagccaccacgcccggcccaggttcaccaatttttaatgttggtcacattctctcccttcctctctctctctcatgccctttgtgctgtaatatttcactgtgtatttcacaagaacaaggataatctcttacatcacatagtacagtgagaagctcaggaacttttacattcataaaatacttgtatctaatttacagtccatagtccagtactgtcagctgtcccaaggattgaaggagggcatactctataattaatttttttcctgatgtgcattttctagtactgattggctttatcatttgctttctgtgctgtctctactcagtctgaatagccacggagattttactgtggaaaattaaatttcttctctgtctgtctgtctccctgtagtttttcttgttctgtgctgtgcttttgggtttgtttgtttgtttttcttttttttttttttgagacggagtctcgctctgttgcccaggctggagtgcagtagcgcgatctcatctcactgcaacctccgcctcccgggttcacgccattctcctgcctcagcctcccgagtagctgggactacaggcgcccgccaccacgcccggctaattttttttagtagagacactgtttcaccgtgttacccaggatggtcttgatctcctgacctcgtgatccacccgccttggcttcccaaagtgctgggattacaggcgtgagccaccgcgcccagcctttttttttttttttctttgagacagggtctcactctgtcaccaaggctggagtgcagtggtacgacctctgctcactgcagcctccacctcctgggttcaagcgattctcctgcctcagcctcctgagtagctgggactacaagcacatgccaccgtgcccaactgatttttgtacttctagcagagatggggtttcaccatgttggccgagctggtcttgaactcctggcctcaagtgatccacctgcctcagtctcccaaagagctgggattacaggcgtgagctaccacacccagcccatgccatgcctttttgccattatagtcgaggcacttggctttgcatgtttatcttttatgttagcgatcccaatgacttcatgaagtgacttcatgagggtatccacacctgggttccaggtctcccccgcgtggaactacagagtgagtatggcatgtgctggagaaaacaaaatatgtgctggccgtgtccttggggaagatatttgatccctaaagatgtgattgcctcatgtggctctacaaaagagttgtttagagtttagcatgagcaattgcacagcacaaactctctgttgtttgcgtgcattggggcagggcgtccagagccgggggcacttcagaggatgtactggtgattttaatataaaaacatccaaaacaattagatgtaaatatgaggaatgggtcatattacctatttaatgcggggagaagtatttgtacatgcaataaaaataacctagtgaaggccaggcgcggtggctcatgcccgtaatcccagcactttgggaggccgaggtgggtggatcacctgagatcaggagttcgagaccagccttaccaacatggcaaaaccccatctttactaaaaatacaaaattagccgggtatggtggtgcatacctgtagtcccagctactcagaaggctgaggcaggagaatcacttgaacccaggaggcagagattgcagcaa

SEQ ID NO: 17650 - DNA, 274869 bp, Homo sapiens
  misc_feature (1)...(274869): n = A,T,C or G, or insertion/deletion polymorphism (see Tables 1-2)
aaggtgacatccatgctaagagcaaaaagatgcatacaaagactccaggcaaaggaaacagtaagagaacaggacacctttggggaactaaatgaagttaagtgtggttgaagcactaagagcaagaggggtagaagtgaaagatggggctggagagagaaaaaatagccagtcctggagatgtttgccttctattttaaggcatttgagggtaaagcagagttatcacaaaattcaaagcaagagagtgacatgatcagctaggtggagggagaggggagggttgttctttgataggtataaaatttcaatcatgcagggctgagaggggattctggggacctgttgtacaacaatgtggatgttgtggacaatattgaactgcacacttggaaattggtgggagggtcagtcttacgtcttatgtgtattttttccactattaagaaaaagagtagcatgataatatttttaatttagactgatcacagcagctgaagaaaggaggcaaactacagctaagagattcagtgtctactgaaatcatctaggtgagggaggatggtggtcaaaatacgaaaacaggagtgcagcagtggagtgaaacagaagaaagttgagaactattttgttggtattcagtaagtcttgtttattgagaatgtggaatgaggtgagtgcatacatactgaatgtttcccacgtgtgatgcattgtaccaagtgctttgcatgaattacctttgatctacataaaatttggcaaaattttacttttccaccatattgtgaaagttcaaaacggttacataacttgttcaaggtcacagagataaaacatcgtaagtccaaagattttgataaagtatttttctgaaattttgtctaattttcttcagttcttcacttcagggggaaaggatttgttttataccaaaaaatgcctttgtataccataacaaaacaatatttatcactatggttgtgttttactgttttacttatttattttttaaataccagtttgaccaactacattgatttcacaaccccacaagtcagttggaacccacagtgtggaaaaaaactgatctaggaggatttcatacatttcatacatttagtatatgtggatgccactttcaagtattaattcatgagatttactgtgtatgcccctttttccattccctcattcaatttttctgtcaatcgcttcaagaaaggagtagcagagacaaactattctttccatctttccagtttttatttttccaaaaatgtatcccaaaagaaaacttaaaggttttagaggtacaagaagttacaaggaacaaggaaaaacagaagaaggcaggaaaagtcagatatgctcaaaaaacaaggattctcactagactagaaagcagttctctgcaactggtggggttgggtgaagagtctgtgcatcctaaataatggctttttggtatatcctggagaaggcacagcatcctaaagtagaaggacaatgtgctatgtcaagtaaatgggatcatgggcagacctgtacaaaggttcacctgtctacttgttgaacaaaagcaatgcagaatgctgctggacccacaggataggaccacatgggtaggaccaacaaaagcctaagtggtgacctttgtgaatgaacagtcaaagaccagaagacaagcacatgcatgagggcatcccccacacacatctggcactgcattagcacctagaactatagcatcttcctgggattaggagggtacaggtgaaagtcccaagaaggatgtgggttaaatgtctcaccaactgtgcagaaacagaaatacattgattctgaaagggaaagagatattttttatgctaaattaatgaattaagattaatatatgcaatgatatcaatgcgactatataaatgtatttgcattataatgtctaaaaagtgctagcttagtcaacataaacatcaatagcccacatggagaaaacagtaatagagtgaaatatttttaaaaataagtctgtgatattaaaatagccatcagatagatttttttaagaggataagggaaaattatctgctttatttcccaatgggtctgctcattttttgccccaagacttcatataggtaccaaattaaaatgcatagccaaaagaagatttagtgacacgactgcactagctggaaacccactttttctttgctttcattactgcttttcattaccttatgttactaatcatttctctcatggtgtgtgtgagtgtgtgtgtgtgtgtgtgtgtgtatgtgttctttttattttaggacttcagtaagtaaagtcttaattactgatgtcatagttagctcatcctctagttaaaccagcatcaagagaatcatcttttaagaagaaaatatttaagtctatctcccttgcagttttcttcttctgactgcctgatggatgagctatgcctttcttgtctcagaattgttttcccactgatgagacactcttctccttccaggcaccagaatctaatttaaactagttcctgtgaagatccaaaatgtctacaaacattttttcctgtatttttcaaggcagagaaaatataagataaaagtaacatagacatcttctgtattctattgtgtattgtactgcattccagatgaaatgtgagtgcaaagtttttaattcatagaacttttcaaagatgatccctatgtatctaagacattgacatttcctggagtgctgtcaaagcagctgatacttttgatatttcctaagagtaattcttccaggcaaggcaggcatgtaatattcctttaaggattttctactttggaagctgctttgtcacaaacaccctccttccctttggaaacaggatctctctggtttcatgtccccttcctgaactgagtccatcttttcttttacatgtgaatattttatatgtcttcagtaagtgtcagagtttctatgcgtacttagcaaaggttatggctcttaaaaaatttaaattcatatattaatataatcaacctaggaagtcaaaggtacatcaagggagaaaacaaatttccttttcttaaacatatctactgtaaatgtggccaatggtatgtagcaacatcactaaacaaataagttattttccagtgaaacaataggatatttcccccaccaccacaactacctaaatgaaataaattacaccaagttaagtattttcgttaaactcaattgtgaaagtctggtttttttctataaattatagaaatagtgtctaagttttgaacagaaacagaattagtaggccctccattcaaacaataaagagttctactaccttcatctgcgattcaggctcatcctaacagatttctcaaagtctaaatgtctcagaagtttcttatttactttgcctttgaaaactcaaaaaagtgacatttttatttctatcagttactgactgcttatgacagcatttttattgagcatgtggatgtcagattcctgcaatacaactttaagcattggatttaaccacgagatcctgggcaaggtacttagccacatgaagcctcggtactcagtatcctagtcagtaagatggaaataataaaatagagaaggacctaattcacataattactagaatgattaaatgggacatttgtaaaaaatcttaagaaagagctgacacctagtaggtgctaaatcgtggctaacattattattatcttattatctctatgtaaattatagttgctagaagttgggggatatgggcccaaggaaaatcagtttttcgcttcagggagctcactgtttcatggggaggagtgacagatacatacgccaatggctagtccctgtataagggaccataccaaaagtacccataacagactattaaacagagaaggaagtcattagttctcaatggggatatcaggaaagttctcatgcagagacaacattgctcaaactttgaaggatgaggtaagcaagtatattcagggaggaatacaggggaagaggaggaagttgtgtgcaaaaagacactgaattgttaaaacgctgtcctcagatcacagtagagaccctgccttaataaatatgcagaggataaatgaaagcattatgaaagatctatcatagcttcaaaagaatgtgtggacttctcttgattttttccctttcactctctttctttctttctttcttcttctttctttctttgacggagtttcactcttgtcgcccacgctggagtgcaatggcgtgatctcggttcactgcaacctctgcctcccgagttgaggtgattctcttacctcagcctcccgagtagctgggattacaggcatgcgccaccacacctagctagtttttgtatttttaggagatagggggtttcaccatgttggccaggatggtctcattctcttgacctcgtgatccgccggcctcggcctcccgaagtgctgggattacaggcgtgagccaccgcccccagccgacttctcttgttttaagtggctcttaatcatttggtggtttgcatattccaaaaagcttctaaatatttgtgttgaaccaatgctttcattcaaaaacagaatgcttcttgggctgaatggcactatgtcatcccaacaagaagaacatcggaatctaattgtgtcatccatgttcttattttaaaacaatctacggtaacacccttccagccatgaagcgttcagtcagttgaacagatgtgatgtgttctccctgatgcattagcttcaacctctgagttcatgaaattgagtttctttctgtagcatgctgtgttcattcatcagcctgagtcattttatctgattgggtccaatctccccctccttggcccgcctccttttgctgctgaataaatcatcctgggagctgtccaggttggagaaagattttcataggaaagttccaactgcatccagcccctcatttattcaggytgagtccttagggccccaaggagaaagaagtgagaaaataaagtgatgtcttccattgccaagtttgctaatatggtcattagcacagatgccttcgggcaatgcccgcagagagaggacacagctacccacacattctggcatagggtctataggacagccttcccagctgtgctccgtctgggttcccatctcaagttaagagactcattacccacccgagttccagtagggtgaggctgatgagtccaagaaattcaggaaggaagaagcaagaagcatttctttgacaggaatgtaattgcaggggttatttcattaagggctagataactgtaacacagagttgtttgaggtacttttacccttaacttccaggcccatgggataggccaactattctgggagatctttaatgttaacagattaattcatctacaagcagagttaaaaatagaatcagccgtctatctatttaaagttgagcgtttcattttggctttcttgggggatggtagaatacaacttaaaaggattgaaattaaagaagtcttttccagggagtgaacgaaattctagaaatctactggttagggattggggggaatattagaggattcttttctcttccttctggaattctgtgtgcaaggcaggtggcccgttttgggtttaacccgaagccgaaatgcgtggggagaaaaacaggaattaaaaagcaaagaattaaaccccgcgtttctgggacacggccgacagaaataaccctggagacagtgtatgtggttgggggtgggggtatcgaaattatttttccttaggacaggcaggagggaagggagcttctcttcttgctcaggagggactgagggggcggcaaggcaaggcggtcatttgggctttcatgggacgccacggggagccgcgaacgcgcccagggcctgacgtcattggccatcagctgactgtgctctgggcccgggctccactggctgcagccgcagtcttggtggaggaggtggggaccaccaccgctcctccacctgcatccggctgcgggactgcggcggccgcgtttgccctgcagaccctgcaccccgggacgcggctcatctgtcattagcaccggcactaagctcccaccgctcagcgacttggtccgccgcaagctccgccgcaggctttgtccgctagcgctcggctgagtctgggcgggcgggaaacctgggctagggcgaggcggggcccctggacatgcctttctccacgtccgcctcctcgaccctattgtaagcggagaaacttagtgtgcgaggcaggcaggggacgtccccattttgatgtcccgtaccctccacccccttcggatcgaggtagtaaagaggctcctgtaggaaactgactgcctctatgattgcggcctcttgggggattttgcgtttagcccgaaagttggctttgccaaaagacgcacgggtaggaagggcgaaaaggaaaccctgtattyygtcgcgctgggctctccgagtccgtgcgcaaagcggcctacgagtcctggctccgcacctgcagaggacaagagccaatgcctaaaaaagaacagcggaggaaccggctggcgcggccagctggaacgctggatcgcagtgcgcccagggaaggccgggggcgcccgccggccctagccctcagtggtcctctcccacgccggcccgcgcgtgcctctgcctacaagacctggggcgtcctggccagatctggatggcaggtccctccgccacccccggcccggttccgggggcgtggcttgrcgcgggggcgggtttaagtcaccgcgggtgtctgaccactctgacaggtctccaaatttctcccagtcgcctggcgcccgcggtgcgtttcagagctccagggtggcacgcggcggcgcttccctagatccagaggcgtctctgtcgacttccacgcggcctcgggcctcccttctcctccaaaccttcgcctcatccgccaagcttcggttctcagcctcagatatccgcaccggcggcttctcttcgttctcggagctcttggctttggagccctcaccactttttccttcccccgcctctcctgatcctcctagctccgagccaaatggactccaaagaacgaaataaaggggatgagaactgtgtgctgcgacccttcgaaagcacagctgaaagcgttgacstcgtcttatagctcaggctgggaccctggrgcgagagtccccacaccccctccgggagggatgcttctggccagagccagcgctgcgctgtcagtccttgctcccgaactaggaaagagcctaggagggagcctcagcataccccttcctccaaattaactatttggtgaattgttagcgccgaggctaccacctctccaaccctgtcgcggggcgccccgccacctcaccgtgaccccctcctcctccttctttgcccccgcccccagctccgcccctgctccccatcccggcgcaatggagttctccgaagggcgatgattccagccacatctgctaacttcgcacccatcgctgccgccggtcaccgccggccaggccccctgcagccgcggagcagtgggcgtccaaagcccagtgcagcagccaggacccgcccgacgcgcagcagaagcacggcgcccaggcgcttaggcrtctcttggagagcaaaggctgcgccaaaacgctgagcctagaatcaaccaaggagcctgagcccaggaaggggctgcgtggctcacagcgctgcggctcctgaggacaaatagccactgccgctgcgtacccaagctgcgccggytggcgggagagcagcacgcaaggacgccgaggtccgccgcgatcttccaggtgccctttgcccctgggcacagtatgacccgacctacagggagccctagcgcagggctcctgcaacggggcagcctaggataaaaaggatccttgccaagctcctaccaggccgcctttgagtctttaggaacccctcctccggctgcctccccaaggttctgggcctccttccctgcggcccagagccatggagctctccgatgtgcgctgccttacaggcagcgaggaactctacaccatccacccgacgcccccggccggcgacggcaggagcgcctcccggccgcagcggctgctgtggcagacggcggtgcgacacatcacggagcagcgcttcattcacgggcaccggggaggcagcggcagcgggagtggaggctcgggcaaagcctcggaccctgcgggcggcggccccaaccaccacrcgccgcagctgtcaggcgactcggcgctgcccctctactcgctgggcccgggagagcgagcgcacagcacctgcggcaccaaagtcttcccggaacgcagcgggagcggcagtgccagcggcagcggaggcgggggcgacctgggcttcctgcaccttgactgtgcccctagcaactcggatttctttcttaatgggggctatagctaccgaggggtcattttccccaccctgcgcaactccttcaaatctcgggatttggaacgcctctaccagcgctatttcttgggccaaaggcgcaaatcggaagtggtgatgaacgtgctggacgtgctgaccaaactcactctcttggtcctacacttgagcctggcctcggcccccatggacccgctcaagggcatcctgctgggcttcttcaccggcattgaggtagtgatctgcgccctggtggtggtcaggaaggacaccacctcccacacgtacctgcagtacagcggcgtggtcacctgggtggccatgaccacccagatcctggcagcaggcctcggctacgggctcctgggcgacggcataggctacgtgctcttcacgctcttcgccacctacagtatgctgccgctgccgctcacctgggccatcctggccggcctgggcacctcgctgctgcaggtcatcctccaagtggtcataccccggctggcggtcatttccatcaaccaggtaactcctgcctgccttgcatttgtttcccctctaacttccccgggttattgatcatatagcttccagagagccagggttgcctcactctctttaagtctccgccttcagtctggcacagtgccttgtacctaggaggtcttgagtgttagcggaatgcaatctcttcttaaagtggaactaaatgacctctaaaagtttctaccaactctacccttctactctgattctatgagtaattctactctgacatcagctaagaaagtctgctttctgctcctcattcccctccctcagggtctgcagtctccggagcaggagacagaaggggaggagaagcatccagatttagaaggtgacccattccttaacatctctcctcaggagagtcgcagcagggtgttgtagcaggctctgggcttcagagttgggtttttccgtatctctaagccacaaaccctcagttctcaaaggaacatacatttgttaaacacatactgattgtcagtgctgagtactgtacgtgttatgtcatccaatccttcaaacaatcctatgacacatggttttctcgggaattttttattgccttggtgaccaaacatgatatcttctctcatgacacgatgcgaccccagtgctttgaataaaccaacctcagtaattgggggtggcaaagaatgcaagttttgattaattggaaaagggcattttgatgtagatgctttaaatattatatttaggtggaatcttgttctttaggtatctttccctcctttctcctccttttttttctattcttccccttaaatatggatatgcttatgtgaacaaagttcacattgtctatggatgagaaagtagacaatgtttctattgtttaaatttactagaaccaatagctaattaatggcatggcactgtctttgcaaaatgtatggtaggtaacaggagagtgactttgggggtttctcaaaaatgagggaaacatgtcaagtgaagtgttttcaaayagatggctggtgtgagatgcatggtcagggggctgctttgtatgggcctgctctgtcgttagcctctgtatcatttttgctgtattagaagcttaaaactcctcttccttatggtcgaatttgaatagatgatgcttagaataaacaggcacgaccccactgaaaattgttcatgatgtttagattgccagcactgttagagtgcttcacccatcactggcctcctggacttctggtcaatgtgggatcctgtctcttctccaatggttctatattcctttgctcaggtgacttatctggttggctgcttttacagtgctttctgaagtctctctgggtaaagcaaagagtttataaattacatgcctgtgattatcaagcatgaaatggagagatgagagactctgagtaagggttgattgactgaactttttcttattaaagacaataatgagtgttttatcacagtcrccatgaaccttcatatctacatataacaaataagtctcaatctgggaagtggaagtcaaattctttggtattaactatttctcaatcctgtttacatgaagatctacatgccagtacatctaaatctactttcttccaagctctctcattctcttttttatttttctttgttgtatacatagacattagcagatcttttcttccctgtcttcctccccttcctccttctttttccttctctttgccttctctttttttcatctaactcactatgagttgttttcacgataaagcatagctatctgatcatgtataagaaattccatgtattataacccactacttttcacgcaatagcctttctcagtacacacaactagaaaacttaataagtaagtttggaatagtatttaraataacacatcctaagtggcaaattatgagtgttttcaaagttctaagtatagatatatttttcttgccaagtgaatccagaaagtaaattttggctccatatttgttttatattctactcaaatactaccagatgggagaagattaaaaataacccccaaatgtcttcccaccctcatctcatcataaacaattctccactgtgaaatccaaggtcctgatgcatgtaaactaagctcattcaattttttgtttgggtaagaattacagataaactacgatttcataggttgagtcaccttttaccaaaactctaaaagaacaaccagagcgctctcccctcacttcagtgctgaaagggcttttaaaggtcctttggcgccctctattggcttaagagtctttcctagatcgcgcagatggacgaagtagagaataaatcgctttttataagaatctgtgatttttgaataggtactatttagttttccatgtctggtaacacataaggaatgctcaaaacctgctaaacacttcttatagcaactcgagtaaaatcctaacttcttaccacagcatgcttgattctctgagctagttgcttcttctctctccaaccatatttccctctcttctcttctcttgtattctcttcattaggctccaaatatgctattcatttttgccatattccaagctcttcctaattctgggtcttttcacctgctacctagagcaacttttcccaagtctttataagactggcacattctcattgttccagactctcaaatgctactttctctagtaaacgacttgtttcattttctccagagcacatctgctatctgaaattatcttatttgtttatatctactatgtttctccccacaccctcacaagaatgtaaacaccataagggcaaggatgttgtctatcataaatagcattttatcctcggcctgtagaaaaatgccagacatatagcaggtactcaacaaacagtcactgaatgaagaagacaattcatcatataggaaatattataaaatatccaagtgccctgatgttgtgttggtgaaagctttctatacacacacacacatacacatcatatgtgtgtaacgcagtcttacacgtaaacatcttctaaagaaatcaaaaacaataataatcctttactttgcacagtattttacatgtaactaagcacccttatgtgcatcatcatatctaatgatgaaaaatagatggtatcatccttcattttcatttcagagaaaaaaatgacagaatcctagaaactttacagtgataccctgaggatcaggaacctggcaagtggaggacagaattcaaaccctgactctgatgccaattattcttcagaaaccctttagtgattatccttctaaacatgtaagcatttgaaactattaaagactgaggagtacttcttttactacttaagagagttaaataaacatttaacgaagaagccaaagggaaattatgagagaaaaatgagtgaattgctgggcataggctcattgtagctagctcatcattctgcttagctagatacaaatctgtcaactaaaagccataaacactggaatagcatctttctccacattaatcttcattctctttaggaggatagctaatgtttaacttagcattttcaggatttaggaaacgaaaatgggagtatagagttagcacaccttggcagctgtttcacttcactgaaaatgtcatttttgaaaggaacaaatgagccaatgattgccttcctttaatctaagctatgagaatctgctttccctctttctaccctgaaggaaatgacatctgtgacttgacagggtagcaaccacactgaaaatctctgcagacaccctatatgaagagacaaagccctgtgtttattgaatcaccatttgctttccactgtggatacaaaatggaacctaaaaggggccactcaggaaattccctgccatcagcaaagagatggtttatgttttctctactcaattaacacactacaaacattgacttcccacccaacaaagagattattgtctagagcagacataatcacccatatgttttctgcatctggagtggcatcggaaagaccgagaaactttcagaaggctcaaaacccagtttgaagggttccttttatttcactctgacttagctcagctataggtagcactagggctacaatcgtttctttcttatgaaaccgcacccaatccaagttaaataagcctcaaaccaatgataggaataccttgtccagattttcctaagacactggtttattttttccacatcataaaccaattgtttgyatcaccaattcgatttatccaccaggaaattcattacaaaatgatgttatatgtataaataaaggattgatgataagattatatttgctaggttctttcacaaggtagagaaattctaaatgctattgctatagttagcattttactctattttaattgctggtgacaataatatgagctatcttacatttgaaactcatctcattctcatactttagctcattagtgataagatggtggaaatcatttagttactggaaaactgagaggcagcaatatttaaccagaaagatcgctgcattatggttccctcttggggattctaaaatattacagctagtggctaattagttttctgtgcctcttggtgagatagataagcggacttgtcagagtggagatgatttctccaagataactgtacaatcaaaggcagtcagatatgcaaatccaggttacttagtgctcaaggtcatgctgtcagatttaaattcctcatgcaacattttctttcctacctttcaacatcctatcaaacaggagagactagagccagaaaaatgctaaagaatgattgttaaacttgacttacaatgagggacatttagcctaacatttggcctttaagaaatcctttaggggaaatttttttttctttgtgctggataagatagtggtgtatagtatgagtaagttgggttcaggaggggagctgactttctatgtgacttaaatacacatttctgaccacttaaatgaaggactgacttcacagtaaagataaaataaatataataaaattaccaacttctctcccatcatttatacagtttaaacataagatattatatgttctttgtctaagtctaaggttctttgtagctatctcaaatcaaataaagggaatcctgtgactacttaatgtacaacaaatggcatgtaatataaatcattccaatttggtagttggtatcaaggtacgtactcatttgagagacataaatatccattaaatgagtatgactggaatccaatttaatgcacctcactagttatggtgtgcatttcttaaaaccccaaatatctccatttctgtacatttttctttaggaaattcatataggctttaaaaaaataatgtcggctttccagcatgtctgagaaaaatgcctttcaaaagccgatttgagtgtcaaccttcccaagagattcctctgaacaccgagaaatggaaatattattctctcttacttgtaaaagatacccagagagtctcctttttctttctttctatttttcttttctttctttcttcttcatgtgtatgtgtgtgtgtgtgcttttgtgtatgtgtgttggtggagaatgggctttacaaaggatatcttaatgactgctgaaatgaccaattaaatcccttcagctctggcctgtagacatctttgccctggagttgcaaataggcttgttgtctctgtatttagagarttgtaaaatgattgtgtagtgtgtgctttgcaagattgaattatgaatttgttttccttcatatctggtaatatcacctgactgttatcagcaggtcagagcataattagattagaactgggaagattgggaggactttgcttctagagcagctgctacaatgtcatgctaagtaggacaaatgcattagtcatatttacactttgatgattgatgacattttaagagctcatcagaaatgagtgaaaccaagcaaaaaaatgaaatatttttaaaaagagtttattccatattcagtgctgctagcaacatttaatcagaggacactactacaatcatgctgatgtgacattttactgttgtctaaatatttcttaagatgctaatttattcatttcacaagtgtgtctatttaagttgattctacatgtgtttatttccaaaacataggagacacttgcaacattcatcttaaacctttcctctcagcaccaaataggtacaatattgattctctgggagaccagtagactcagaatatgcagctggacaacatagcagttcacttgacttatcacttctgaagtgtgttcttggttttctctttggggcagaattaaagtaacagaacatgaagattagtggcagtattgaaggttgcaaaatttctgtgatacataggtttgaacctcagttggcaaaagagtgagttatataaagaattttcttcccaggatttttgtggggacttagtcgaggaatgctgcttcagccagccacaacagagcagggaaagctagtataatcttccctgcacttccccaggaaatgtaattggatttacacactcaaattatatcatgtgagttttgtttatgaaggactattttaagaagtcaggtcacttaagcagtgcttcggaagccagrttttctccctgcaagattttttacagtcagccctgtgggggagaggaagaatgcagaatagattaattaacyatggagatgccagacattccacaggaggcccaggcacattctggtaggcataaaagccacctaccagcaaatgccactatgccactaccttctcgataaaggaacagagcttatctgacaaggtgttgtcagataaacctatgtttgcttgtttctttgatctctatgcactggactctgaatgtgcatgtgtagaatttgatatctgaatttcatttaactagatcatatattttaatatatgaaatactttgtactttatagctactggggttttctatccctttcactctgtttcctgctttatatatccaagctcaagtgctactaattgcaaaatgtctttgaagcacaaacttcccccaaattagggaatgataaagttatacatggtgaagacataagccggatatgaaagtaaatcacattaatgtcttggggtttcttgttaaatgagtaatgtttttacaactgccgtttcyatctacagtgccagtgtaaaaatttcacataaaaacaaaaaactataaccacttcattttgtaaacaacacatcctcattctatgtcagctgatttttcagttgactggagtaaaccgtttcagaatcttttcttcatttgtgtgtatgtatgtgtgtgtgattacacgctgaatgcacaagattgcttataaaatagaaactactaagggttagagaatgcattatcaaagtacatgtatttctttgactcagaatatagggagaagaaataagagcacaaaaaaaaaatctaacagaacccatcttatgctgctataacaaaacctgagactgtgtaatttattttaaaaaaaaatcagaaatttatttggcttctggttttggagaccaggaattccaagactgagggaccatatctggtgaaggttttttgttgcaatgtaagatggcagaaggtatcacatgggcataaaagagcaagagattgaactcaaggcctcaaacacttttaaaatcaacattaatcctttcatgaaggtaaagccctcaggatctaaacacctctcattaggccccactgtaacrtttgggattaagtttccaacacatgctttatgaggggcatattcaagccataacaaggaccaaaaacaaaaaacaaaacaaggaagaatacctctggaaggcctgaacatagaagggatatagaaagaatatggtgactgcctttaaatatttggggttctgccatgacaaagagactggttattttctgtgtgtctcctgtggaatggaattaagaccaatggatagccattaaagcaggagaaattctgattcacaaaaaggtaaagtttgataacaaacagacctgcccagggagctgctttttgagatgatgagctccttgccattgggcattccccaaggagaagctgtgcaacaatccatcagggatgtaatcaaggagattcctatatagtgatctatatatctattcctatagatatataggaatatcctatgtagggagatatatacatatatattcctatagagggaatcctttattatatccctgatggattgttgcacagcttttcttcaaggtcagttgaaagtcattggctgcatctcatgtcatcatggttgctttgcaggcatggaaaagtagaagacaaagggcaagaggccaaaatggtaaaagggcataagccaactgaatttgtgcccctttgaggagctcccctgggatctctgcccaataagacctccttgtatttcaggcgacataattagttctatcagcaagaaaggatggccaaaaaatgattttgctgggctttaaaagatcaggattgcattagaatgaaaggtggaataactattgaatagataaacttttcccccaaatatttgttgactgcctgctgggttttatgtcctagaacacagctaggtactaaagagataaggttattgatgtaatggagctgatgcttggatggatttgggtagggaatttgtgactccactgcagaggtttggytggaggttcacacctgactcttagaacacatctggagcacaggattcagggattcagtaaatattttacacaaatgcaagacttggactctttttactacagacctctaaagtatgaaacatcaaagctgcagtggatttcttttagaagttacatgaaaggaaaggtcagactccagaagaaatagtggaagggtatggatcttcctccctggtgaagaaaagaagagcgtgcaaaaggaccctgggatgggccaagtcatcagttgtctgagcatcaccttatcacaaactgaatttgtcacaaggctggtgacctggagacatgacaggagggagcatgtgcagctctgggaactcatagtcactctgtgctcagagtgactccagctgaaaactgaagagctgccctgagactctaggcaacccatccccacacaaacatgggtagacagtaagtgtaggcaaggctcaaagtcactttccttggtacatttccacatcccgtgttttcctctatcagagcaatgtcataacgttctcacatgcccaccagactatgagccccttgaggtcaagaattgtatcttatccatctttgtgtctctagcagctagcatagcatctggcacatggatggctctgaatatcatattttaaatgaatggaatgaatgaatagtagatgaccatttccttccttcccctagccaccccctactccacccccacccacacacacacatcattacagaatcatcaacagggaatgaaaaactggcaagagaagagaaatcagtctctctgtcaatacagcaaaagtacaccagaaattatcccttgaagcactttgagcagaaagctgcagctgagtttttgctatacatattcatatacatgtacatattagataacgtgaagaaaaattcaagtaattatccagatcatttaagttaagacaaaagttatgggcctgaattattcatgggtatttgtcgattatcaaacactttaaatggatcaggcccatctactcaaaatagagtccaattgctagcaaatacatcaccctcttgttctcttccctctttgttcttcagcatcctggctctgaatctctatacccagctctggagttctttgcttttatagctgcagtccccaacctttttggcaccaaggaatggtttcatggaagataatttttccacagacatgggtgggggatgattttgggaggatccaagagctttacatttatgtgtattttatctctgttattattacgttgtaatatataatgaaattattgtacaagtcacaccataatgttttcctgcagctagatggtcccatctggggatgatgggagacagtgacagatcatcaagcatcacattctcataaggagcttgcagtctagatctcgcgcatgtgcagttcacaatagggtttgaactcctatgagaatctaatgccaccactggcaactgatctgacaggaggcagagctcaggcggtaatgcaagcgatggggagtggctgtaaatacagatgcagcttcactcatttgccctgcctctcacttgctgctgtgcaacccacaacctgctgtgcaagcacactggaaatcacttcctgggcttgacgtctcagtggtgcccccttctggtgggtgctcaccatctgggtacatacaggtacagctgggggcaggaggtactcccacacttccacttgactcctggtactccatacccgaggggctggtaggcctcactccttaggggaagatatcggacaaagcaggttgactttcctaagcgtaaaaaatggataggtgcttagtccactgtttcctacagcttaaaacctgtcacataaagaccatattgtaccctaactggaccagtttatctacagacttctaaaaagcaaaccaaagtcagattttagagaatggaactcaaagcaattaactaaaactgtctttataaagtcccaaaaacggtcatgagtctttttagttctttttttttttctgctaattagttcaagaaaaaaaatcactaagagcaagctggttttcttctaaagtcaaatctcccacaccctcattcatcgggtgagccttcccagcctattggaggcgggtagttcatttgagaatgagttcatggccccaagtggtcaatgtgcagtgactacaaagtctcctcttttctatttatgagagatatattgcccttggctcttgccaggtgaattatgacatgatacgcagctctttgggccctgcccaagccatctcagccagagagaagctgtgccaatggacaatgaaagatatttttgaaaccatgtaagtatatttccttaaaaacatagaaaacacaaattctcctcctrtttttgctatgggtttttcacagcaactttggcttcagcttctttgggccaaaatttcttcatgtctaaaagaaggatagttcaacactcctgacccagttagatattcctcctctgagggcatggccctttacctgcccatttatcctgcctcattttgcagtgctattggcttccacatctctctcaccagctgggctgtgagcttcacaaagtctggggtggcatctgggtcactgttaagtctctacagcatagtgtagtgctggttacatactcttctttctcaggttcctccaggtcttgtttttcaattcacctcttcaatgttggggctcctgaagtttccgtcctatatgacttcacattatctcactccacaccactccctggataatcaaatccctccctcagtcagcaagtatgtatctttgtgctgctaactcctaaccctgtatctctaccccagttttatctgctaagcttaagacctggcaatctggagacctactggatacctccattgaggcagcccaaccccaacaagtaacaattgactccatcccgtctgatatctacatgaaattctgatggtttagtcttccattgctggggtctgtccacagctctctatcctgctctttctgttctagtgcagccccacccccaagattcatcaagccaccccatgctccgctgaaccaccccaacactccccagtgggagcttctcccatatgctagcattctcaccacttcacttcactgggtaagttctactgttgaacctcatcaccagttttcttcatattccatgctggcttctgcctgtgtgtgttttctaggacaattgtttaccttccttgcctggcaatattcaagtgtcaccacttcctggaattccttctgtaccccttctccgggacaagtacctgcttaagaataagtggggtgtgtttaaatggagaattgtgtttgtttgactttgataatctaagctcatgttaggtgtttaaggaaaggaggggcagagagataagcagaatttgacaaaaaaatgagcagtccttcaagcatgactctcaatgagacagaactgtattggagattgctatatgccaaacttaacacacttcccaaggaaagaaaaaagcatagagttcatagcacaggatgtggattcagactgcctgggattgatctgcaattttttcattttataacactgacaagagcctcaatctttctgcacctcactttcttcagctgtaaaatgggaataataataatagctcaggaggttgttgaagagatgaaataatacacatggagtatttaaatcagaacctggtaaagaggaatcaggtaatacatttcatttgattttatartttaagttttaaaacaatcaccctttttcaatgagttctctgccctaagctgacagtttctgggcttcacctggcttaacccctgcatcttttagaccagtgcttctccaactttaatgtgaataggaatcacttggagatcttgacaaaatttggatttaggaggaggaccctaggttctgtgtttctgacaagttgccaggtartggatgcttgcagtctgcagatcataatttgtgggaaaggctttggagtttggcacagaccccaccttctcttcagtgggtccctgctactccaccaggtagatttagatccctgtcctctaattcacttatattattgaacattcaggcttccatagcaatataccataactgactgacttgtaacaaacaaacaaaaaaaaacatttatttctcatagttctggaggctgggaagctcaaaatctaagcaccagtagatttggtgcctggtgagggcctgcttcctggttcacatggccatcttccgactgtgtccttgcaggatgaaagagacaaggcagctctctgaggccttttttctagacactaatcccattcatgaaggctccaccctcatgacacattcacctcccacctcttaattccatcaccttagggttagcattttaacatgtgtattttggagggacacaaacattcagaccatagcaacattcttccatcattcattaatgcatgctttcatttagcctcatatggcgaatatttatggagtaccacartgtgctgcatgcaggcagtaggggtgctgtggtgaggaaaagaatccaggatcctgctattaaagagattataatctagagttatagacagtcatccatcaaataatcacctaaataagtgaatgatttcaaactgagttaaggacttttaaagcaggtttgatgtggggccatgattagttgagaaaagtgaggcatccagggtacaaagcttacaagaagcacttgttctcaggggctgaccctgcacttgtgcaaccctgcgaaggaataattcctgaaattgtgtgctctaggcattcagcttgcactcatttctatttaaaaggaaaatcctgactagacctgagatgaggaaattattcttaatatctacaggaagaattcatgttagcaggtaagattggaattatgttttatttatttgtctctactgttaaacaacgtgctctttgagagcagggtctgtccttttgtatatcaccggaatggacactggcacatcacgcgggaatctcatatcagaagcttgttgagtaaatgcctgaacaatcatattcgcatcagtattgctgtttccctttttatagttgaggatgctgaacacagagttgttacagcatttccctttggtcatatgatgaatacgagatttcatccacagctatctgattccaaagctgccctctagatttgatgcttctttaaggccactttatctcaataactatgctcatttcagaggcaataagattaataaagaaaaagaaaaatgaaatgtaccttgcaaatagtagcaatgtttatcatgatagttatcactatcatagatagagccaaggggataagcacactgtattgaaaacaacacctgaataaagggtcatcaaaagacccacctcagattttacatacaaaacagtgcaactttcttcaagccactcagcctgtcttggcttcaaaatgagtttctgatagctctaaaattctatgactatgaaatgatttctgagtttccttacagctctcaaaaattttattccatgagttataatgaatgtgcatgtggggattggtatgctttccccatttatttgcctcccaagatcagataatgacaattcttatagaacacataacttgttgaggtctttgacctctgagattcttaagaagagaattatgastaatgatttagcaaatactgaaagaatcactccctagatggtatttaatatttaatttctcctagtggtttaattacattggcaccatcagttgcaaatttgtgtgtcattttagtcattcagtcattgaatttgtttcgaacggactagtaattgtgataattaattgacaaacaattgtgtactttgactatataattagtgacttcatggcacttgcctatctctcatttccacaatgtgcatgttactgtaatcaacagccattttgtgaaagtattaccgagccatgattgaattggacatttacacagcctgaatagtcacaacctggagcccgactttggcacattcatcttccttgtctatggaccccaggaaatagataaggtagcctgaaggaactcacttaatcctgctataggttagtcactgcatccataacaagatgagaataaagtagctcctttatcagtaaatgagctaatgaataagaaaacattttgaaccaatatacagcagtaaacaaacactgggctgtattattattattattatwaattattcctataacacagttgtgtctgatgatgtcacgcaatagcaagctgtcttgttctgtcattggcgtgaaactgccaaacacgcgacagtggtccacaaggtgactccactcatgaatcacctgaacagtggatgaaacaaatggtgccctgggccattgctggcaataatgagcattgcacactagaaacaagaactacactgcaggatgagaggatgtccactcatggacaaaaatagcaatcattagcaatcacctctttgccctgtatctagaacactcttataaggaagagaagccatgttgctctaaatgctggtatgtcttcttagagctttccacactgaagtctttccttatgtaaagtccttcttaattttgtggaaggtctatacaaatttttcttcaacatcctacaaaaaagacccaactagccatgggttcgaggtaatttggatataaaaaagcctaaaagtatccttttaaaatctagttaataaaattgatctccttgggcatatctcatgcacatgtgcagatttcaaactgggaacttatctcaatatcaaacaaccattaaatgacagcaaaactaatccattgtcaataaaattgctaggaaatatgtagtaagataaatatcaaatttcttccaacaaataggacgaacaaaagatttttagaatagtggcagctcctttttcaaactagactaagcactaaaatataaaacttatgaaagtggcactgtgtgttgggcaaggagggaagatacagtctgcctctcctcctgcagcactgccatcttctgctctgtgacctaccaaggcactgccaagcttccaccaaaaaatgtttcagaactaccactttataaacccactcctaggtctttagctgttgaggacttaacttagatgttcctaaaaggagagtaaggtaaaagaacacrctcatatgtggcaataatttattggtgttgattccagtgtccatgggcatcagggcagaagggtctcttttgtttcagagtagcttaggcacagggcaatggctgtgatatctagcacttcctacacacctaccatatctgaatctgcattatatggtttgcacacatcctgtccactcttaatggtattcctgcataatattgcaggattgcaacctccagtttgaaaatgaagaagttgaggattagagagtttaacctagctagagtcattccgattgtgtgtggccaagtgaggatttgaactgaagttaatttggctccaaacatgcatgggttcccactgactctcaccatcaccaccctgtacatgctgagtggtcatttaaataaatgtatatttacatttagtaattcatattccttccatcattccaccatctactatgtgctagacttgagggaagcagtcaaataatacatgtgttctaccctggagccacttacattaccagaatacaaacacaagaaagaaaagtttatctgttgttacatggactgcctcttgtgttggccctgctgagagctgcaatgggttttatactttaatgggtttcatcctttccactaagaaacttgagaaatggttcattcttttacctggccggcacttgctgcctgtgacagaagtaaaactagcatttatggggaaaatatagacatcaaataatataaagttctgatgacttcatagttcaccatctttctttaagaccaatccaaatgcccatcaatgatagactggataaagaaaatttggcacatatacaccatggaatactatacaaccataaaaaaggatgagttcatgtcctttacagggacatggatgaagctggaaaccttcattctcagcaaactaacacaagaacagaaaaccaaacactgtatgttctcattcataagtgggagttgagcaatgagaacacatggacacagggagggtaacatcacacactggggcctgcctgggggtggagggtaggggagggatagctttagaagaattacctaatgtagatgacgggttgatgggtgcagcaaaccaccatggcatgtgtatacctatgtagcaaaactgcacgttgtgcaaatgtaccccagaacttaaagtataataataataaaaaaaacagattggtgtgcacaccaaatggaaaaagaaaagaatcattacataatatatcaaaatacgcagaccaagcatttatttttacccagatccctactaacaaaaataaattcctttctttcctacttatattcctgaaagtaatccaaacttagttgcccacataattctgaattaccctaaattgtttttgcatatgtttgaaaatgataagccatttgaggacacacttgttgtattagtctgttctcacacagctataaggacatacctgagactgggtaatttataaaggaaggagacttaattgactcacagttcagcatcgctggggaggcctcagaaaacttacaagcatagcagaaggggaagcaaacatgtccttcttcacatggcagcagcaaggagaagtgccaagcaaaagagggaaaagccccttataaaaccatcagatctcgtgagaactcactcactatcacgagaacatcatgaaggtaactgctcccatgattaaattacctcccaccagttccctcccacaatgtgtgaggattatgggaactacaattcaagatgagatttgagtgggtacacagccaaaccatatcacatatagaaccaaactttattttgggaggtaatgtgcccagttgcattactagaggatttggagaagcgtttaaaaggtgtctgatccctctgggagacccacmtttttttcacccaccctacatcctttagccatctttctacctggtagacagatgtcatgacagctccaacagccatcttggactatgaggagagatggaagccatacagaaggttggtgggccacaaagaaataagaatccaagaacgctgatgatacgactaggcaccatgccagccctagactgctcattgctagattttttttaagtgatagaaaatactctacttttgttttagttctcctttaccaatatctaatataatttctaatcaatattggctgcaaaatatactcatgctgtatcatccartaaattaacattaactattttttgagataacattgtaattgcaattcttctatcttatacttatctgtttaatcacctaagacaaatagagccatttacattttatgggtgctttgttttgctttgctccatatttgagatttgagaaacagaaagacctagatcagatgtcatgtcatctgatgtataatttatagcacataataaataccaggcaacaattattgctggagaagactagtgggactatttcccaagggaagaaactgataccttcctacttgtaactctttgaaagtgcaccaggccttgtgagattagaaagtagtccccgagggtgcttagcagaagccagatgcccatcatcagggatttggggaaaagaagaaggagctggactaaactattttaaaggtcttctctaatttgcagcttatgattctgactcttgaagttataaataattggtaagatgtagaataattggactctaaaaagtagagaagtccaataaatcttccaaatctcagaaaggaatgttggatatttacatcaaactatgtccctaactttgtcctcctcctggttcttgatctcaatgaattcagcattctctatttcatctttgcagttgcccaagacagaaagctcagaaggcatccccaacaattctccctctcactgtcccatggccagtccattgcaagtttgcctgctgaatgtcctcaagtgcatccaatccgtgtcttctccttccactctagagcagaagatactggtcctcacctgaatcacagtagcctcactacatccacttttgcccccttctaatctattttccacagtgttaccagggtgcaatttttttatgatgatggcttagaatcttcagtaactgccaatagctccttattgatcttaagacagaggacaaattctttcctgggatctacctcttagatctgactgctctccctcaggtagtggtaatcttcatcttgttctccttccacaatatttttcattcagttctttgaaagaccyatgccatcttctacccctcagctgtctaagtttctgttcttcctttgcccaagatgttcttccctcattctcagctcaaggaacctttctcagggacgcttcctctgctctctcttaagtcacaactcaattccatttcattttcaaaacacccgcaattttcttgaaaaacactcccttattgagagagagagagagagagagagagagacagacagagagagagagagagagagagagagagagagagagagagaatttgttccatgtgttttctggttttcccagcagatagtaagagcaatgaagatagggagtgagtcaggtatgcttgctcacctgagtagtctcagcatcccatgtttgttaagtatttatctaagagtaaatgtataaatgagaatacccaaggctggtgctaaaggcttgtatgtatggcaataggatgtgtatgtccaagaaggtgagatatacctgggttggattaagattcaagttagtgcttctaccagacttctggcctgtttctatctggctcaaatcctaggtaaggctaaaaattgaagctaaaatgtttccagtaccagcagcttaacaggaatcatatcaagagaagatgacccaaagaatctgccaaattrtaactccaatgatcctacacaaaatcactgtgccagaatgatgttcttcttttaatagctgatgttctggtaaaaatacttgtggcttccacagcctttaaatagatggtatcattaaagaagcaaacacaaattttattaaacataatttatctcattttgttgcttatgtggcaactctacttgtagaaaacatttgttgttgacctgatatagttagctaccctatttgtgcaatgctaaaggccaagattgcctaatatacaccagctcatcattttcattaataccaacaataccgtcaatttyataccatcatmttcctctttctcctccctcctcatcaccttcacaagagtccctggcatttctgtagtgttttgagctaaaatgaaagtgtcattatttctgagaacattgaggaagacttcaccatggaggtggcaggtgaactgggtaagatttagagataacaacaaaaatagacctccactgatagacatggaggcctaacctcctcctaaccmtgcccttccttatatgttaatctccaggagattaacactcctatatttcctctcaaatggaagaagatggtttggcagaatgagtgagaacacatgctgtggagacagagtacctggcttgaattctgacaccatcactcattagctgtatgacctggcaaatcactaaacttccataagcctcaattccttcatctataaaatgggataattacagcatgtgtcttatataggagtgagcataaacagagacaatgcaggtaaagtctcagagtggtgccaagcctgtaagtgttacctgtcattgtgcagcttgcagggaaagcatcatgatggctgtgatcttgattctctaatttactgtcacatctccactcttgagaacaatgcctagcacacaacacatgcttcatggaaattttattgaatgaatgaacagaacccctggggagggtagtgtggccaacctatgaaaaagttagcagcagactgtgacaaagcacaagaaagaagcatgattaattgaaatgcatgtctttgatattttaaactgatatttccaaaccatgcaactgaaaactgaaaaaaataaagttgaatacgagcattattccttcaaggtagtgtattttaacaaaaggaggggaaagaactacctctctttctttgagggttctstttgagctttgaaaaataataattgctaaagaagacagtatcagaactacattgagtcattattttatatgaaatattgaagaagggtaagtacttcaaagcccacttctttcccttaaaccaacacttattccaaatgacaaactccctcaattacccgtaacattaatgtttatactcgrcatttgtaatacaataaaacataaaatgtttatactcggcatttgtaatacaatttatattttaaagttttctgatatttgatgtatcagatgttggtgcttatcagataaggaaacaagggtccgaaaggtttcttaacttccaagagctgagcaggctgctaacctggtctgctcatctcctagtgggattttttttttttctcttacatggcatacttctctgccatcatttttaaaactctgagggggaaaaggaagctaaatgttaacatgctgtgaccagtaaaccaaagatgcagtgattgctagtaggctccatcgtcggccccttgcaggtggtggggacatattcaggggtggtggatatcagtgagcacagcccctgactggtggctgcccatgcagagtgtgggggtggggagtagatggggggcttttcctaatgcatctagcacccagtgctctctggcttcctagcttttcccatcccataccataaagagtagttatgtaagcatatttcctgtacttaaattcacaagccaatgtgtggagacaaggacttaggataggagtaaagagtccaaatttgaatgtctccagccatctagctccgactgctgcctgctctgactttagaatcatggacattccagcccggtgtggtggctcatgcctgtcatcccagcactttaggagaccaaggcgggtggatcacctgagatcaaaagttcgagaccagcatggccaacatggcgaaaccccgtctctactaaaaatacacaaattagccgggcgtggtggcacatgcctgtagtcccagctactagggaggctgaggtatgagaatcacttgaacctgggatgcaaaggttgcagtgaaccgagatcatgccgctgcactccagccttagtgacaaagtgagactccatctcaaaaaaaaaaaaaaatcatgtacattccaatggacattccaagttggagtggtcctcaaggccaccaaagtcaccttctaatcaaagcacgagttctttctccaacatcctagataggaataggagagttactcttagggctaaagaaacttcaggaagagttcaggaggcagcctgtctgctagtttgtgttctgtcaattttagcagatgggccaatggcttttgggggataactctcgaacagaagtcaggcctgtcctctgytccaaacctagaaggactcctcatctcatgccgggtcgagccagtgtccctacaatggtccaaagacctgcctctggccctacaccttcttcgtccctgtctccacatactctctctctctttctcactctgctccagcctcacctctctcccaggagtcccttaaatgtaccatcttggccttaccactggctattccctctgcctgaattatcctttcctcagagatctgcaagactcactcaagctttgacacaaaagtgacccaatcagtgagagctcctcctgtgacattcttyttttattttttaaaagasagagatggggtctcgattgatcacccaggctagagtgcagtagtgcaatcatagctcactgaggactcaatctcctgggcttaagcaatcctcccacctcagcctcctgagtagctgggactatggtcgtgtgctaccatgcctagctaattctttttacttactctattgcctagacttgtctcaaattctggcctcaagtgatcctttttcttggcctcccaaagtgctgggattgcaagtgtgagccaccatgcccagcctcttatttaaawttgtaacctccccccaccatactgcattcccaccccaaccccatgttactctcccctttaactgctctattgttttaaattactttttaccttctatcactccagataatttatttatttaagttatttgctcctgctagcaaagcaggcacatagtttggagatcatgtccatttctcactgacatccccagggtctacagaaatgcctgacatgtagtaggtactcaggaagtattaatcaaatgatgaatgaagaaatggatttccatcaataactgtgtattgatgtttgctgtcattcttaggtagacacaggcttcctctctaggtgttaggattaaaaatagagtcttcagaaaaggagcatttggaatcatcagatttgggtctgagtttgggtccagccctctctacctagctatgtgcgtagagaagttgttttacctctctgagcctcacgtttcacacctagacgtggatataataactcccatactgacttgtcattataaaaaataagataatttttttaaataaatcactagataccaaggagaaaaataatacatttaactattatttttagagtagtaacagctggataaagctatgaattgtttagagataaaatagccaaaattaaagggaagacaataagsctttctggactgagtttttaaagtctctgtaaaagttgatttgtttatatcttctctaccaccctttatttgcaccattcagatttatgaaggcaattgctgcaaatgtttgttgataatggaatctgtactcctcattactcctttggatacctgcatagtgygctcaccatttggggtctctgcrtaaatataacctcatcagagataccttccctggctactccacctaaaatggaaactcccttcttctataatttgtttctccttttaatcagctttatttttctccatagcacttttcatcaaggcaaataaaatgttattttttctttgtttattttctgtctctccataaggcaagtgagagatttcwtctattttgatgactgacatatcctcagagcctagagttgttcctgctctcaccaaattgaagaaactgctctttatcaatcaattttccaaaaatatagtttgaagacttatcttagaggcctatgtctaacccaatagcatgtgccctgggtaagaccttagtgtgcccagaatactccacatttatgcctgtctcctttctctctgaaatacgtcccattttgtacaataaatgacattgtcacaataaccgtgaagttcagaagaattaactatgacacataatcccacattaaaagaacagatggtatagatgagaaaaagaaagaaattaccattgatagtaacagctaatagtattaagtgctattatatgccaaggggtctatgtaattatgtcactcagtcacaacaacctatgaagtaagtcccattaccattcccatttaacatatgagaagtctgaagtttagagggggtaagtagattccctgtgttctcacaactagtaaaaggcagagctgggattcaaatcccaaaaacagatctttgaactactaggctagaattgcaagcactatggtgaggcttttccctgtgtggcctcattttatcctgtgttaatactggaaggtagttattaattatcctgctttaaaaaaaatggtaaaataggcttagctgtgttaagtggcagaattaggatttaaatctaaaataagcatatttatttttaaaaattgtgaacaggatggtgttaggtatgaatcaccatgggctaaagatattttatgttactagcttccattatatttttactacctaacgtgtcacaaggtatataactcagcattatagaccaaaacccattgcacttactcataatcaccatgtacataaatttcggaagaacattttatttgattgaaacgtgaaatgagtaaatttgaaaaagcaagggtaaactaaatgcttgttaatagatttgcttatgcttattccctgctgtagaggttaactgatgcctctctttagctagatcaccaattttaagccactctattctctatactcatcagagaaaaggagtattgggagaccacttgattggtctcarcttgtaaaataatacagttgagaaactttgtaaagttatttcatgtgaagtcaccttctttatgagtggggctactcaatttgtacttaacaaaccattttttcatttttcttaggctaatgtgagattcctttgcaacaataaacacacttttttggtaaagtataacagaatatataatggacttctctgaaggagttaggatcaagacttaggtgacttgggaaaatgttccaacttttggtgcatactgtactttatcaaccctgaacaacagatgcattttaagagaaaacaagcccktggcaagttgctatttttcgctcagtaactaatgatgaatcaaaatgcttcttcaaacccaattacccaataaaaattgccatagtaaccatcacattacaccacacacccttcatgctcacaccaaaaacttccttaggaactgctgacactacctccttgacactgccatctgctatggaggaggagatggtgggggaagttggcaaggaaaaggtaattctgtgttttgcaaatcactgggggagggggtcttgtggcagagatacactggtagaaaaattattttctgaagaactctatatcggtttttaccatgagcttgaagtggctcaacccaggagcttcagacctaaatttaagcttggtcataaagtgacctcttcccttcctccttcccttaccctacggcactgtaggatcaccctccctgctctccttctgcccagaataattgttgcctgggtcttttcttggtccactcctcttcatttgtcaggttttatctaaatatttcatccccagaggttttcccctgactacttaatttaaatgaaagtctccacaggatgtcccattgggaaggggcctaatttgtcttatttgtcactggaatctaaatgcctcagtcatacttgggactcaataaatgcttataaagtgaatgaatgagggaggaaattatatatkggtagtcattatcaacattaacctaataacctagatggtacaaactaattaaatccattgattaggtttatttgacaaattcattcattcaactgcattagtgagggtaatgcacatttgttagttgttcaaagttaggtcttctgagaagcagactctgagaaggagataagtttgtaggaagcttattagggattcggttgggatcagtacccacggaggagaaaagttggaagcagaaatagacaagttgagctgtgacgcaatttcaacagagaccacagtcaacacttcggagagttctgaagctgggatgaccttcccaggatgttctgagttccattatgagttccattatgatcctttatgcctccatgttgatcagttttggagcatgaccttggatgagaagaccctctttagctgaggtaatcctcaaaggagactggcagctgaggactgtctgccagaagcaatcctaggaggacaagtccatctttcctgaatggagacccgatggctcatcacaggatccaccacggtgcaccccttgtacctctaggatccacttcttcatactgtttctgagagctgttcctctatgatcctggtaggtttctcttctttggggaaatttaaaaaaggaagattagtgggacaaattacagtccctkytgctgcagttgagtcttgggggcaccaaccgatgtacattattctagattcccctcacactccactagtacctctgctggtcttgtggtttacctggtggtgtgacccagactctaacctctgagtgctctgagcctctggtcaccatgacttcctcaggccatagaagaacccattccagatggtgattcttcttgtctgttggtcacttgacatgaagaacccaacatgctcaggtgaaagtcatggtttagagttcagtgggactcttgctctgtcacctgatgaaaacattcagttttggcaacctggaactctaaagcaacaaaatgcagagtttctggttctgagatgccaggctccccaaatgggttcctgggagtgatggtaattggggccactcctgcctctacccccttgttcccctgactcatgtattctacctatcagggacacagcaccatttagaggcctttgatttagtgtgtccactatgtcctggagggtgacaacccatcctcagggagtattgactgcaagatggctcttcagctgcaccctcaccagggtgctcctgcattctacctgggcatcagcttctggggggtagagtcagtgttggaaccagaggatcccacggttttatgccaattcttgcaccccatctgctgtaagggaggtccctttgtccgacacaacacctggaggaacctacagtattctccccaagccaggtccttcaatacacatcactccccaaagctataacaaacctaccccaggcccatactgtcacctccacttttagatgattacagctagccttagaagaaacactcttaaatgttgttaaagcagagcccttgctgtcccatcctctgggggtcaggcactgagaatgtggtgagaagggcagctttggcagtgacctgctggcccaggtccatccagcaggggaaagagtcacttgattctttcaggtcccatccataaagcactctagatgcaatgcttggcaggccctacataaagaggggagagaattgaatyggtattcactctggtcttcaaaasatatctaatttgcctatctgtgaatatttatagactttatttccacagcaatgttgaaaatgtccctgtgtccacatgaggagccttctcagaaagtatacctgattcttttctgacagccagcaactcatgggtcattaattcttttttttttcattcaataaacttttaatatgcacctttcattgctaactactctgccaggggctgcatgcgtctatcctagattcgaggcacagaagactggattttccaaggtatacctcttttgctcacttctacatctgtttcatgtgttatgactggattgtgatgcatattctattttgtaacttaggtgaaacctaacttccttggaatcactgcttcactggggttaggttttaaaaccaacagctgagtaaaaatcatgcttttaaaaactctctcaaatgcccacaaaaatcagtaaatggatgtatcatatttcagcaagtccaggatagccaaatttcctttctgtatggttgaactccagataaagcagttggcttgtatttaggtagcatgattatgaaagagatgtaactttaaacctagtgacacactgagtccagtggagtgagcacgctattggcrgccacagcttgagacactatagatcctcatcttctcactccatgtcaaatgctcatgaacagacagcattgctggaattatttaaagtgctttatttcctcctttcctctcccttttgcttccttttacttaccttcatttttcttcccttatttgtgtatctgtttttctctctctcttttttctctctttctctttctctccccaaatatttaattaaaatggcatacaaactaaagacacagatgtgaacattccactgcattataatatgttactttgtacaactcaaattcaaagagagaaacttcctccaaaaccctrtgcagatttgacagaactctgaacctggttctttgttttccttgcaaataatagttggattttattatgcacatgatcccctagaagcagcatctccccataacactcaatttattaacattgatactaataagaattatttggtggtgacatctctagctcgaatgttcaaggaagtgtttgtgacctcctaaaataagaaagtccatatattgtgaggttcagaattggacatattgacatgaaatggattttggaatccatactctcagctccattgtaaatatgtaattcttgggcaagttaggtgagctatctaagctgtctttctttttcatacaaaacaatgcagtcatactttgcaggattgggatgaggatttaaggagataatggcactataatgtgaggcatttaggtatggtaatctcttggctctctccttgcttccccaaccatgtgcagccactccaaccttaccatcctattctccagcaattctgggcacttttttacctccccaaatgcttccygcattttcttgactttctacccattgcttctttaaaacactttccccatccttgcttgcctaacttctatacattattcatgaatcaacttaaatgttacctcctcgagggagccttcctggattccctaccatctayagattctactctaatgcattatctttacagcatagtatagttagtgcttaaaagcgcagtctttgtgttagtccattctcatgctgatatgaagaaatgcccaagattgggtaatttataaagaaaataggtttaattggctcacagttctgcatacctggtgaggtctcaggaaatttacaatcatggtggaagacacctcttcacagggtggcagaagatagaatgagtgccagcaggggaaatgccagatgcttataaaaccatcagatgtcctgaggactcactcactatcatgagaataggatggggaaaagggggaaaccaccccatgattcaaatacctccacctggtcactctctcaagcaatggcccaagctgatgttggccccttttagccatgactggggctcagagcgccaagtcctgaggctgcacagagcagcaggggggcccttggcctaccccaggmaaccatttgttcctcctgggcctccaggcctgtgatggggtagggaggctgctgtgaaggtctctgacatgccctgcagacattttccccattgtcttggtgattgacattcagctcctcgttacttatgcaaatttctccagctggctcgaatttctctccagaaaatggatttttctttcctcttgcattgtcasgttgcaaattttgtgaacttttatgctctgctttctcttgaaccttttgccgcttagaaatttcttccactagttaccctaaatcatctctctcaagttcaaagttccacagatctctagggcaggggcaaaatgcagccaatctccttgccaaaacatagcaagggtcaccattgctccagttccaaagatgtttctcatctacatctgagaccacctcatcctggacttcattgtccatatcactatcagaattttggtcaaagccattcaacaagtgtctaggaagttccaaacttttccacattttcctgtcttcttctgagccctccaaacttttccaacctctgcctgtaacccagttccaaagtcacgtccacatttttgagtactctyatagcagcacaccactcctggtaccaatttattgtattagtctgttctcacactactatgaagaaatacycaagactgggtaatttataaagaaaagaggcttaattgactcacagttccacatggctggctggagaggcctcaggaaacttacaattatagtgtaaggcacttcttcacagggcagcagaagagagaatgagtgccagcaggggacatgccagacgcttataaaaccatcagatctcatgagaactgactgattatcccaagaatagcatgggtgaaactgccccattgtttcaattacctccatctggtcccactcttgacacatggggattattaccattcgaggttggatttgggcagggacacaaagccaaaccatataagtctctgaagcctgacttgctgggctccaaatttgtwtggaggggtgagctgaagcaagttacttaacttgtctttgcttcagcatcctcatatataaactggggattagggtgacgttgcatccctattttcttatgaaaaatgaggtttagacctctgaccctaacagaattactacaaacagccctttcattgtcaaaaccattctgattggacaataaattatatggtcaccctaataataatagtagcacctacctcattggctgactatgtgaatttaatgggtagcaatgcctatgacacagtagatattcaataaaatcagctgttcatgtgacaggtatcaattgtctcagtgtacctctgtcctagcactcattcctctatgcagtaagtgcatgtctaattgtctgycttcctcaccagacctgaactacttgagggcagggagatcatctatcatgatcatatttgtaccctcagtgtgcagttcaatggatagctgtaaagtcacatatacaaaaagaaaataaatccctatcacaggattagaaatttgtaaatgtttgaaagataattgctgtattttgcaaacaaaacagatttgtaaatgaagctgcacacctctcatttatctagcaataatttactgggcatctactgtatgctggtgactgctaagctctaggaggtttctcagtcttcaaactattgatatttagagctagataatttttttggtgggggagagaatattgtcttgtgcagtgtaggttgtttggcagcctctatggcctccactactatatatgccagtagcacatgctctctctagatgtgacaaccaaaaacctctccaggcattgtcagatgtctccttgcaggtaaaatagtccccatctgagatcactaataaggaggtaggacctacctctttcaccttggaaatggtgctgggagtctgggagatctagtacttgcaaattttgcctaacaaaaaccatgcatgggatcctgacatagttcatatagtcttcttatttcctccctgagtaattagtattcataaaaagttaattcagtactatgtgctttttttaactaaaagagtttaatcaatgaatttaataaagataacacatctgcataagattttcttttttactgtttgtacattcattcattattgtgtgcctactgtttgccagatggtttatcttcatttgggattttatctcctttggacatgatatctttttcctctcttctttggtataataagcaaagaatcatatacatccattgcagataagtcatgaatggctctaaaagattgatatcatcaagaaactgaaatcctctgtttgagaacaaagcctccatggaaasgttgtcwtctggccttggcactcacccatgcctttctgaggaaattattacaggtcttttggaaaccctcagttctgacatttctcatggagatctaaacaggattggtgagagaacctcttgttatttgtgtttcctgccactccttccctttttatcaatgttgcccagcattgttggtgacccaggcagtgatctgtccgctaagccaccagggattgtgactgtgaaaatgtaagcttcctaagatttcatgttccatatgcaaatggaaaaaaactaaggtctagaatcctgccatgtttagatagactttttaggtagtagatcctttattaataatagtaagtcatggggaaaaatctcatcattgccagagtaaataaacttgaaaaagccccactgcccaggaaatcattctcttgataagggcatatgattttttcccttgagccacaagcacacagaggtcactggtgcctcttcagtgcctctcctgctgaatctcccagcggctcctacagacaaccacaggagcgtcctgtcaacaaagatttactgaatgactgctgtgtgtcaactacaggaatacatcaatggatggcagtaactcctgcccacaggaaaacacagacaagacccaagaactgacaggagctatagagcagtrtgataacagtttgctggcaggaaatgtgagagggggacagcctaaaagatagggggctttcagggaaagagaagctgcttcttgtgcattgtgaagcatgctgaggaagtagttgtgtgtgtgtgcgtgtgtgtgtgtgacagagagagagaaagagagagagagagagaatttggagtgggagcagggagacatttaaggaaaagggaaccaaatgtgcaaacaccaaggtgtggttcatgtattattcagggttccagcaggaaacattcaaaagagtaaatgaagtaagctgaagcaaagttttgagatgggattaagggagccacaaggcttgatgaagcacccatggactagctgcagaggaagctgtttccactcctatgggcctgaaggggcaaggggagggatggtatcaccaggccctcacaagagctcctctacagtagaggaatacagtaattgcacaaactccagcacagcaggataagcaattgccccagatcttgctctctctcgttcctgatttttctgtcttcctcttcggctagccatggcaaagcccaaatggaaactaaagatgaagaaacttgatagatacagtccagagataacaacttttctgggcaaagagtgggacacagaagggcagttttttagaggccaaaggagaatagccagcaaagttggtccagttaactccaarttatcctgtgtgactrgaagcctggaagtacacagggaagaaataagagtcaggagagggaaccagagaggagagggaaagcaccaaatcccaaaggctcattcatagtctctgcccagtgctttagtatggaggcagcctgtatgaggacggcagtactagtggctgccattttsggatatttactgtgtatcaggcaaatactaagtattttgtagacagcgcttccaatggcctcgtttagcctttatagccacccaggaagaatcctcatgcactgactgctaagttccaattcctttaataatgatttgacaagttctgcttcattttatgctctcagtaactttaggtgataaggatttattttttcttttgcatgtgaagmgactgtaatttcactggaatatgagatctagggggacagagacttgttctgtatccctgagccaggggtagtgtctggcacacagtatataataggtcaccagtaagttaaaaactaaaatagactcagaggctctcagaggtggagttttggagttaaattctgacttccaaactctgaaagccctaaaccacagaatgatcccagccagttgaggggggaagaagtgcacttcccttcaaccctgtgagtgtccatgagaatctaatttagcagaggccttccctaagagaaggmtgcctggctcacagccctttagtctctcccctagaaggactgcatattattagtctgtaagctccaagagggcaggawatgtgtttgtttggtccacataygtataaccctagcacactgcttgacctataggaggcactcagtaaatatttgattactctacagatgaataagaagcagcaccgtgatgaataaatgcgagcactgtgcaaagcactggggctaacagagttcataatgggtgagcctgatcaccaacatttaagggcaatagtagatgcctatacagagtacaggtcgagagatcaaaaaagaaaagagtgattgaccaagatgaggcttgacctccatgaattraatagatgattgtcagacagatgaggaggaagctgcagaaagagcatgccagaaaaatggtatggcttcaacaaaaaagcatgggaggtggagtgggaatgggaggtacatgtgagacttccaggggcagaacaaagaaagataaagctggggagggtgttgggaggcagatcacaggcaacctgtatgctacactgtgaagttcaggcttgctgcaaatgccctgccctgtacctacttactttgcctgttctttgctcgtgtaaacctaatccctccatggtacactagactacatccaccctctcacctgctcaaggacttcactcttgcaaatcttcccccaccccttcccgataactgtgaagaccaaaaggaaacctttttttctctgcagttactccagcatggtgggggaggaaaggctcaacaagtcttgttgctgttgttgttgtttgtttttatttgcaaagagccaggcagtaaataagtaaatatttgaggcttagccaaccacatagttaatttccctccccctcctcttcctcttctcctcctccacctcctccttcttctcccacacttctttaaaaatgtaattattcttagctcacccataatctgtggaccctaggagaaaagtgtggataaaactcctccttgtcttcccagaaytctccaggttttaaaataaagccctgtgtcccagtcaaaccaagacagtcaatcaccctagtaccacttactagctctattatttaacctcgctgagcctcaattttcttttctgtgaaatggagctaataagcccaagcagggttgctattggactgtccataaaatagcatgtgtaaaggctaaagcacaggatctggaaaacagctggagtgtgtaaacagacgttcccccaagtccccttctgaagaggttggcaggatttctaaatggtagaattaagtcaggctgcaaaacactcctggaataattatggctacttgttttgtccacttctctgaatacaataaatagacattttgaatatgttgatatcttaaactactttgcattagcataatttaactttaaaatttgtgcaaaaattccttcatcatttttacctatttttaaatgttgtaatcacttcttttattttttctcaattatgggccttacttttagcctttaacatttttacttcttccttaatgtttgtgtgtgtgtgtgtgtgtgtgtgtgtgtgtgtgtgtgtgtgagatggtgtttcactcttgttgcccaggctggagtgcaatggtgcgatctcagctcactagctcactgcaacctctacctcctgggttcaagcaattctcctgcctccacctcccaagtagctgggattataggcatccaccaccatgcccggctaatttttttatttttagtagagatggggttttgccatgttgaccagggtggtcttgaactcctgacctcaggtgatgcacctgccttggccatccaaagtgctgggatgcaggcgtgagccaccgtgcccagccttagttttttaaattcatttttttaaaaaccttatatccctgttctttttcttttcattctatttttcaaaattctttctgttatcatttgaaatgactgtttttttccccttcttactttgtaatttctcaggatattattcttggaattcaagttgttaatagaggtttttcatcattcagttttactcttttatttattttacttttatttacttttttagctgagttcagsaggcctcatttttttttttaccttttcttagatttttacttaagtttactactttattgctatgttattttttaagcttcactatgaactatttataattctttctccaattcagtgtgtactatttataaagggcaggcaggaagcatggccacagagccaacagctgtgggaaaagcccacgaccctggcagaggatgttggtgggaactgtttgtccttcctcttatctctgcagctactcctatagattttcttcctcttttatccctttcttcactgaatccttaaagagtttaaccttcgcgataactgttcctcaagtggcctttctataacacatacccgaccaagtcacttacctgttaaatcccttcagtgggtcactgtagtgacatatagmcaatgaaamcaataataatgmcaataactgcaaccacagtcaatacatattgagtaatgattgtgttacaggtcttctgctaatttcattgattatccaacattttgaggaaggtattcctgtttccaggtaagaaaatttgggggccaaaaaagttgattaactgagccaagtttacataacaagtaaatggcattattagaagcccaaattcttagccactaagctaaactgttaagctctatgcgtagcacagcaaatcacactttgagtatccactcccgtagtgaggataaggacttcctacagtccccctggaggtaaatggcagcaacaggactgaaggccactctgtctgatccctaagcaccccctctactcttttccctgcagagtaaataatggacataaatgttctttgtaaagcaccgtaaatatagaagactttaatacttcatggtcctctgggatatttcttaacctggaggaagaacatccatggtgcatcatttatccagaaataaaatagaaaaaaattacaccataaactagactttggaaaaatagatggcctcatatttccatatatatctaacatttattgggcatttgtgatctgctagacatattcatatacagtatatatatataatgtatatatataaaatatttgtatatatagtatgtgtatatattagatatatataatatataatatttgtatatatagtatgtgtatatattagatatacacacacgtatatgtagtattaacctcacttgtatgaggcaagggtttattcccattggtcagatcagaaagttgaggctcatcgagacataaagtgacttgcctaaactcacatggctagcaggtggtggagctgaggaatgcaaacccaggtctctgatgacaaaagctccagcatctggcaggtgcaaaggcgtttagtaggaagcttccccacccactctctcaggacgcccacctactgcagattccagacacccctgagagctgtggagagcgtctaatctccttccaggttttctccctcactcctcgtcctcaggctttgaggcggaatagcccaggtggtaatcaccgctccagaattttttaagctacttggctttgggcaaattactctcagggccttagcttttccatttaaagatagagatattatggtgtgcttgagaacacctttgtgagggaagggataaacatacaggccctagacaggaatgggacctagttcacagtgaaatgctccatgaacgtcttaactgaatgaagtaactattttttacgatgcatttgaagaccctttccctgccttaggtggctcttttatttcctagagccacctggaagccaacctggtcttctagactgtgctggaaaggcctgcagacaacacgcacctccttcccaaggtgcgtgttgtctcttttccctttaccaggctcaagaactgatctgtaaaaatggccgaatcctagggtgcatgtggcgagcctggatttgttgatggggtgaactgtcgttgtgttagtccagcagagactcagccatggggttggtgagcacagctgttataattcaggctctggctcccattaccagggatcacacctcagctttaccacttgcatcattcattatctcaagcaaatgactaaacttcgagcttcagttccggcatctacagaatgctcatgttatagtgtctaccatattgggctattgtgaagactaaatgaattaaaatatgcaaggcactttggatgattcctggcacatattaagtgttctgctcaacaaatgctagctagctattagagaatgaggccaacacttcttcagccaggctcgtttacctgcatatatgagacctttacctacatttttcccatacacccagcacattgtggcaaaatattaaacctgtgtcctgccttgtccagtatttatttactaaattatacccctgtctcctgagtgggctttgttttctctgaatatcaaaggtctccatcagatcctagccaggtcttgcttagaccccaccctcctgtacccaattcccaggcctaccactgtggagctgtttaactttagagatgttccttaacttctctgatcccaagctcccacatatgtgaaataaacataataatggctccttcctcactgaaattaaatatgaacatgtatgaaagggactttgtaaagtgttctgcacttaatataaactcaattaaagtaagtcatacttgttattatttagtctcccaatttcagttttaacattctccaaaatttatgatgaaacatcagtcctaaggacaaaccagggtaaaagatccacaaaagaaagtattggaaaatatccaaatgcaaatcagtactggattgcaacacatcgttcctttattttctgtctaaatgtttaaaagaaaatgaactcaaggcccagatccagggatcactttcccagagctggtctttccacgcacacaatcacacttgagtgggtgcttcggggagatccagaaataggtggaagtatcttctttccgctctgaataaagcaggcctttctagccttcaacagcttgggctgcagactgtggggatgttccttgtacaaagtgtgctatgaagaaaatatagtgcaacttcctgtggcaccagaaaacacacagtgagtgcagagtggagaggacgggcccctcaggacaccccagggagatatccccctttcccacctccactctggggagttaggcccttaaaacacaaatcctatatcaatggggaagctggctctgtgagtgcttccaactttgaactccctggcatcaaacagcagtgcccatgctgtctctatcacccaagcttcatggagaacctttccactcctggggttgggggaacgagaaggggaaagtgaggagggaatcttcttcctgttccagaagaattcatagaggacttctcacctcagagtgacaactttccactttccggtgatcacaaaactggaccaaagaggtgggcaattggaattcactcatgttattgtgtcaactcagttagattcaccaagtgtatgaagcactgggatgctaggccctgtgctaggagataagagacggtggacacaagctctgccctgggggagttcagattgagtaaggttgatggacatataaaaaggatatcaaagttcagggttatacgtgatcatcaggtcattgacatgactcagagatttcttcatgccagtctatggacccaccgcagcagatcgacttgggagcttcctaaaaataaagttctccaagatcacatccctggatatttgtattcagtgggtctcagtatggccaaaggatcygcattttttttaactagaacttgctgagaatcatctttgtctcttctcttttctatgtagtccacaaaaaatccaccagcaaatcctgttgtctcttcccttggaatacattcagggtgtggccctatctcatcacctgcataattaccactgtggtccatgtcaaaatctcttttcaaggagactcttggaagcagcctctaacttgtctmcctgactgtccttgctgcactactgtctgttttcttyccagtcgcccaagtgactcttgaaacacagatggtaggtcatgtttccaagtgctaagaactttgcagggccttcccatctcatggagagaaaagcttcaagaccctccatggtctggccctttgagacctttcagagtctgcttctgaaagctcttccccaggctcccacaaggctctctgctccagccacagtgggccgcatgctgggctgaagtgggttcttgcttctcctgcctcagaaccttggaacttttctgtgcctggaatgctcttcccaratgaggatgactccctcacttctttcaggtcattgctcaaatgtcttcttatcagagaggccttctctgaactccctttaaattagcagtcttattcctgtgccatcactttccatcctacttatgctgctgtattattatttatggcatttatcacactctcataccaccaccaccaccatgtgttaaatattccttggcttgcttgtttattgcccatctcccaccactagaatgacagcaggacattayctgctttgtacactgccagtttataaaactgcctgacacatagaactcgttccataaataatttcaaatggattaattaatagaagtgaggggttaggaaggcttttcaaatgtagtttacaratgcataagggcaggaaaaaatgattaataaatatttctcaagtatatcacacctagcacatcaactctgggtcagaggtggcttacagataggatgggacccgagggatccaggtagagccgtaggttggagggattacaaagcacaaccaatctgagatggtcatcaccatatgcatttaacccttcatggaactaccaatctgctactgccacaatggagtggtatttccatcaaaacatttagtaaaaattaataatagtaataattgaacagttcaggcatttttagataattactagatactaaaacccaaacacttatttttaaagttatttgtgaggtcagttactggccaatatcaggagactctatctggatggtcttttctgcattgtttttttctcattggttccagacctcaggatttgttctactggctgcataagttttgaacatcctgctctgcttctcagactctcagtcatctcttttggaatctgcaaatgctcccaggaaggaagaagccccaaatgctagggtcacctgtctaagtgtagatcttgacaccttagggtttgtactgccttgttagatctccacaactgagtttgtttgaataacttattcttcctatttcagtacacacacagatacacacatatttacacaagtgcgtgcagacttacgtacttatttttatttatatatgtatatgtatatatgtatatgtatatatatatttcttcatattttaagcattagaatcacattgaatttatagatttgtatgttaagtgcagtttaaaatattacattttacttaattcatcagagatttgctaatgtcattaagtattttaaatgcaattttacattctttttgtttacacagaccacaatttattcagccatttctcttactgttaaaaatatgcagtttccatttataaatttttcatgaataaagctacaatgaatattccctaacagaagtttctaatgttctgtctgatgatctcctaaagacagatttctagaggttgggtcagtgggtcaaaagaaatgagtcaaattttgcaacatgttgccaattttcttctcataaatattacagtaaagttccttcatatcagcaaggtatcagattggttttgttaataagaaccagttttctttaatttgagactttgctcacatttttctgcttagattagagcagtattcccctttatttttccccctttttatagtttcattttccacatttagctctaatccattggcatttatttttgcatataatatgaggtgactatcagtccatttttttcccctgtagttgaccaattatcttttttgggaaaattttctttccctttaaacctttgatctttgagctacatgtatcatgtacaaactttttacaatttttattgtctgtttctatacagcatagtctactttattccattagttttgcagttgggtttttctctgctgtgacagttttaattatcatagcattatactacatgttaccttctggttggtcaagacccccctctaatctcttttgttaaaaatttatttgatagtctaactcatgtgttctttcagatatacttttaaatcatctttcaagtcccaaataaaaattccatatgggattttgattgtaataatattaaagctgtaaatcatcttaagtcatgcatatatatagttacatattataactattaacatagttaataatagcatttttaacagaaatacctctcttctttatcttttgtaaagtcatgtactttttttcttttctagctctcatgcatttgttagtattgcttaagaatagttttggtgttttatcttaccaatgctattgtaagatcattgttctggcatattttataaatgataattactggtacataggaaagctattcacccattcatgtatttatttatcaaatatctagaacttattaagwgctgagcaattaattgacactatgctgagcatttatttactgtgctggatgctagttgtccattaatggctaaaacaaacatcatctctgtattattagaactcacaatccagtgcggcagataggcatcaagtaaccaagcaagcaaataatatataattacaatttgtgataaattcacagggtgcaggaataaagtatagcagggaaatcctactttgatatagtgatcagggagtgtctatccgagaaaactataataaagccaagaacagaaggataagaagaatcagcaaggcaagaagtatggagagtagtgttcgaagaagaggagatgacatttgaatgtcccagaaatgataaaaatctaatgaaggaatggaaagtaacagaaatcagattggttagagcaaaatgagtaagtgaggaaaagtacaaaatggtcttgaagaggatcaaacgatcctcactgtcatgatgggaagtcttcattttactattttaacaatgtattatattataataggtacactacatgcacatatacaaaaaccaaaaaggtagagtttaaaaacccagacttcagtttctgtccccagcattacccaataacttattgagtgtgtctgtgcatttaaaaatgatagtacatgttagttctttccttctcccamgcccacttttcaactggatggatttacaatatgaccaatcctctgtttagggtcatttaagttatttctaattatttattattgtaaargatcttattatatcctttgatctttgcacatggatggtcatatttatgaaataagtctacagaattagggttactgaactcatgagtagaaatattrtcaatttttacagatattgccagattcacacatttcaccaactaggtataagagtgactattttccccacaacctagccagtgtgaaatgttagtaatctgggaaattgacattaaaatcataatgggagaccattctgtatccaccaggttagcactgagtattcccactccacaccccagagtcacctttgcacatgtgccccaggaacatgcccacaatgttcagagcagcattttccacaagagaatgggagtggaaataatcagaatgtccatgagtggtggaacagataaatattttgtggtgtattaagtactatttagcagtaaaaataaakgaactatcaatgtatgcatcaaaatgaataaagaaaataatgtttagtaaaaaatgtgattccaatgatataaaatttaaaaacaactgaagtcaaactaagcaatacgagagatttttcaaaatgttcatgcccayttgactccacaggatcagtgattcctcacagttgtttatttaactggatttaaatgatgggtttatggtaagataatatggatttcaaaactttttgcaccaaaataaacttatacaaatgtggcaatgtgtctaaataggattcaacttgagatactaaaaaggataagatatcagttacaaaagaacccctatcagagcaacatgaattctgctaaaattgaagtaaggacaaacgtcaaattgatggggaagctttggtggaagaatggtgaaatcactggtgctttacaaaagttcatagaaagaatgccccagagaaattggcagtttacaaatggatcactcattttaagaaaggatgagatgatgttgaagatgtaaagcccacagggcagacaatccacatcaatctgtgaagaaaaagttaattgtgtccatgtcctaactgaagaggaccaactattaacggcagaaacaatagccaatatcattgacatcttaattagttcagcttacacaattctggctgaacaatgaaagttgatcaaactctacktgatgggtatcaaaatccatgtgcccaaatcagctgcagacaaaagcagagctttcagtggacattttaaacaagtaggatcaagatcctgaagcatttctttgaaacactgtaacaggagatgaaacctggttttcaaaatttgctgaggctaacttcaagtcctatcctaagatgatattttacaaattttcaatatgtgccttaaaagaatttctactatctaattattgaatagcatgtttgtattagtccgttttcatgaggttgataaagacatacctgagactgggtaatttataaagaaaagaggattaatggactcagagttccacgtggctggggaggcctcacaatcatggcagaaggagaaaggcatgtcttacatggtggcaggcaagacagaatgaaagccaagtgaaagaagaaatctctcataaaaccatcagatamcttaagacttattcactaccatgagaacagtatgggggaaaccatagccatgatttaattttatcccactggatccctcccactacacctcagaattatgggagctacaattcaagatgagattttggtagggacacagccaaaccatatcaatgtttcatttcamggttgttaatcatatgagctttccagattatctctatctttgctgactttttaatctgtttggtatataaactgctgaaaattgtkttaaaagagaccactrtgactatagatttataaataattacatagacttttatcttattttgcagtgtatactttgaggctgtgctattaaatgtgtagatgttcagaatttttatgtatttctgawgtattaaaccctttattattgtatagtgaccctacttatctctagtaatgcccttttcaaaaaattatctttagtctggcatttatacaacaaagccagctttattttgttttcacttccaaatttttatatcaatatattttaggactatattttacaaataggacatataatatttctttttatctaatgtgaaaatctttatcataactgaagaatatgtctcctatatgtaacatttttatctgactgttttcaagattttgtttttttagcatttggattatgatgtgcccaggaatagttttgttcacagttaacctatgtagggtttgctaagattattgaacstgtaaatatgtatctttataaaatttataagaattgcattatatctttaaacaaattagtttagccccattctctccttcctttccttctgagaatccaattatatgtatgttaggcccttcaatgttgtcacacgaactactaaaaccttttcataaatcatttaaaaatttttttttggctgtccgtggtggctcacacatgtaatcccagcactttgggaggcccaggcaggcagatcacctgaggtcaggatgtcaagaccagcctggccaacataggaaaatctcatctctactaaaaatacaaaaattagccacatgcggtggtaaacacctgtaatcccagctactcgggaggctgaggcaggagaattgcttgaatctgggaggcagaggttgcagtgagccaagattgtgctactgcactcctgcctgggtgacagagtgagaccctatctcaaatatatatatatatatataggcacagtatgatcaatatatatatgtgccaggcacagttgctcatgtatgtaatcccagcactttcagaggtcaaggtggatagatcacttgaggtcaggagtttgagacctaccagcctggccaacatggtgaaaccccatctctactaaaaatacaaaaattagctgggcatggtagtacacacctgtaatcccagctactcaggaggctgaggcaggagaatcacttgaaccccagaggcagaggttgcagtgaaccagtatcacactactgcactccagcctgggtgatggagtgagactccattcaaaaaagtatataaaatatatttttatttattaatatatattattaaataattattagtaattttttcaaaatggttatattctattggcctatttccaaatttactgattcttccgtcatctatgttctgctgttaatatccagttggttcagatattttctttttcagttctgaaattttcyttttttgaggtttctatttcttttcttatttcttatcttttcattcactgctaaaatatttactttcagtgaatttcattcactgctagaatgtcactgagcaaagttgtaagaactattataatctcgacctgctgattccaacatctgggtcagattagaatagatgtctgttgactatcttttctcttgagattgagtcacattttaatgtttatttttatgtcacataattctrtgctatgttctgggcattgtgaatgctctatggttaagactgaattatcttacattcccctggaaatagtgatttttgttttgttccgtttcactttagcaggtaattaacttgattgaaatcaaaagaaagtctgtcttttggactgcagttcaaatatcagttcagttattttatccttaactcaattgcttactgtcttccctatgcatatgtggttcagataagaggttataaaacaattttaggttttctttcaccgggttcttttctttttggaattctcctcccaccttctggaagctacagtggtctggaactctgttctttgcttctttaagccacctgcattttctactggagttatagctaccacacactgcatgagctgtgacctgttctcaggctaaagccatgaaaataaagaaattcatactttgtgtatgaaattattccatgtgttgaccccttttcaagaatctgtctacttttcttgactgaacagtagttagaaggggggcaaatgaaaaagtaggaagcccaatttaagagtccaggaagcatattttgatgcctagaaatagaataatggaagtggagatgaaaagcaatagaaaaacgtgtttcttttcttgagttagaaacaagacttggattctatccaagaagacccgagaacaccagagtctaaatatagtagtcaatgtattcgaaggcaaaggtattcaatggattcctttcctgtttcttattagtctcttctttttattcccaccagattctccagccccttaaaagccagaggcttttgctggtgaaggggagacagataaggtggagtgaagaagccaaccagattccctctttttcacagcaggtttcccatgaagactccagtctaaacctggggagaaagaagccttaaattggagaaagtggtgaaagaagccctctccaaagggatgacatttgcctcaagatctgaatgaagggcatagctctacaaacatgcgattaaacatatggattactacattaggatttaccttggaaattcatatttatttgtgtattttattgttgcttgtaaatagcttttgttttaagcrcctgaccagactgtgtttattttaggttgtggcccaggcagtgytattcatgtgtatgaacacagctggaatcttcatcagttacctgtcagaccgggcccagcgccaagctttcctggagactcggaggtgtgtggaggccaggctgcgcctggagacagagaaccaaagacaggtaccaactgacaaggctgtgtgttttagttatcacctagccagtctctaaattatatggagytactgttttactcccaaacacgtcctgacttaaaagtgttctcttaaagtttatgtcacaggattccagagtctgaaatagttgtgttagacttacaggtcaaaatgggttggtcttattctccacactcaattcatcgttccccataagaaataaagaggttacagtcacaaatttattttctgacacctttcactgacatctgtgtttgtgaacaaggtcatgattcctcaaaatcatcrgcatgcctatctttgaccctctttcttttaaactgtaaatgtgttatttcagacattttttttctgtttaccaattcaaattagagtaagcgcatggaagaatcttacacatgtctagtctctaaaaccacaacctgatttttagaagagatgtacacaaaaaagtcctgtcgacatgatgccaacatcaaaataagggatacagtaggaaaagaagttggattgcagggggcaataatgtgttccaatttggagaggttaagataaaagaattttttggacatcctgattgggtggatgttataagaacttaaaagtagctttggcctcaaataatatatttctccaaaattaaatttactttcaaagaataaagatttgtccctattaaagmtatttatatattttaagtccatgaatacctttgttctgaacacaattttccaggaggaatatcaagtatgtgttgaaaactgattttagcatcaacttgtagcatcctaagtatatatgctcttggaaattttatgcttgtagatatattatctctacaatcctagacctttttttaactaagcccttyttcttaaagttatgtcttattatttataatacagcacatttcttatttaagactttaggcaataatagtttgcaaaaatcataaagaaagtagcagagaaagactcaacattttcttcatgattaatttgcatcaaatcaccaggaagtcagggatctttgaagtaagtgaagccaggtccgtgtgactctaatggatgagacagacaggtagggccyacctgacaggactgaactcccactgccatctgctgtctcccagggcagaggaaactactgagttttcagatcttactttgactttacaaaattcagaataaggaatttctatgttattgcctaaaataattctggaacctcatagtagtttctctgaatagcccttggaataattaagaaaaataactttaagaaagaagacaccttgtacaataaacatgagtatctcccaggactactgtattatgttcgtgtgcaaaacagatcagttgccagactggcatgtcactctttccatgggatctgtgccaattcagagaatgctgccatattaataatttattcaactgttcttaatgctttgtcacaacaagagctgaaattgtgggtgagttgtatgggatgcctcttatttcgtgtttatgatatattggagacactaaaaaatattgccttaccatctccataagactttttgcttcttttctcatccttcaagctgggtgtcttggaatcactgtgatctaataatctaaaattgtggaggaatcatccaccattctctctaatctttattttttttaagtttgcagaaggaggaagaaaataataatatacagaggtaagagaaagtgacaactagaatttagtgaaaagaccactagagtttgggtcatggctcttattacttcctagttgggccacctaagctacttaactttccaccataggttccttttttatacatgggccaatatctttctcttctgcattatatttgcctcaaatgagatactatgtagaaagcaatacaaacatataagtcagtttcattgatttcttggataaaatacaagaaaaggctatcttttgtggaaggttctttgttcctaggattaagtaaaatactgtgtaggcttcttttagtcctgtgttcacaactatgataagaagtttgtggcatgttgaccaccctttatttacccaagggtattgtctgagatagctgactccacatcatcagtgctaaagttactttccactggcatctgatctctgcttcaggtttccattatccttgagaacttcctcagtaatagacggacagtgtagtctggcagaaaaaacataggctttcaaatgagattgccctggattagtaatttttacttacttactattttagtgagcttgagcaagctctgagtcttagtttgcccatcaatggcatgggaataataacatccttcctgaaaagtctccttaatggttagaattactttgtgtgagatgcccttgcaagtcagtgaagagtttctattagcattattgtgtgtaatgatttatatgaatcagtcaacatagttcagtcccaagaggactcatgtgagaatttattatggattgacttggctcagttgtaataacttagggttatttatatggaggtaaatcaggatgatggctctccttaagtgcatagcaaccagaatcatcgttaggtcccattcatatcttttaaaatatcatgtgtcattgacaaatgaattcccattttcctcttatcagaactaattataatgccataattgttaaaaattctataccctgtgaaggagatgctgtaagaacctaagcgacagcagataccttttccttggataatgatcctaaataagattgatagtaatattttgcaattataaattaagaatcaaataggttatattcaacagaaatgactgggttttgtgggatttttcaagcactcatgatttttatctcatggtaggatacaaaaaaaaaataattatttaatttgttcaaccgtgaattaatttctttatggagggtttattatgtgtcaggagctctgctgagcaatgggaatataatgctgactagcaatcagatcctggccttaaagagtttaccaggtgtagaagaagctgaatgactacacagacatgtatggcaatagtgtatgggtcaaacctaacctggaggcttgcagaaggctatcgaaaaaaaattttacctgagctgacatgtgaataggattcagctcagtggagaagcagtaaagggtacaccataaagagcaaaaaacacatgcaaaaatcttaaaggaagagagaaagtggtttgtcagaaggatttatgagaattcccatgatcattcattcatttattcatctatctattcacccattcattctgtagagagagagcccaataagactgtctttactctgaattggacctggaggatgagtatgactttaattattagaagagagggaagaaagaaattagcaaagataccgatgacaagatacgtatgacctattaaaggacagcaatgctggacactaggttttctctgatatcctgcagcaaattgtgaacctcttaagtggaatattactgctttccattcaataacagatatatatttcctgagtgttaactatgcaccaggcattattcaaagtgctgtgtacaccaaagtgaagamattctttgacagatctgtgttaacagcatgccacactggatctcaatcattgcatgtctctttccccaaactgctatttcaccagcctgtgccatgtattaatagttctgggaaatccacctccctcctaatgtgtctctactcttctgcctcagcattcctttctccaggaggcttgcttttgtctcccaggtagagttgaaattgttttcttgtactcgctgcatgtcatgatagttaagtctattaaagaatgcatcccactttattacatatactactctgtgcttctctctctctccacaatctctaaagactagttaaaggcagctactctacataattcaatggagtctctggtttttatctagcatagtggctgaaatgtaggatcttctgagtaatatttatttaactagttctattgaattcaaactttggctcctagcttcacttctacctatatgaatattaaaataactcctttgcgtaaaaataaagatacctgtgcccattgtgccctccattagaaaactaagtgggaagagcacttttacccaattcaggagagactgggacaggctaagcatacatcttaagctgacttgttaggggaattttccatctggaagctacatcttgaagcatctttctttagggagttagattctaatttagtagttttcataatyctgctgcttctcccaaatgatgcaaatggcccatatttattttaaatattaaaatgaattaattgtttttcttgcagcttggagaattgtataaacctccttatggtaatcatggcatttcgaggtgtctcagaagctctgggggcactggaataaagtttctgatgataccatatgttgcagcagcaggaagattatttttaaatgcagcagatgttttagctgtattaaagcaattctgttaaacttaaatatctttgttagacaatactggtgtaaactggtggttcggacagtagattgagaaarctgggtttcctactgagttctgagttgattagtttgattcattttggtaccttttaacatcttggggactttttaaagttaaaaataatattgattagtacagtagagctttgtcattgttaattcattcagagaatcaaggttgacctaaaagtggtagaaccttrgaatctttattctttctgctccaactagatgggtcttctcattatactccaaaaacctcttacttccaagtcattttctgttattcttcattccttacattcaaagccacccactgaccacccatcatrttcagccttatctgttatcaacatctttcatattcattattctttagtttatactgaaatattcactgtttcttacacattcttcttaccctctacactcatgcctttgtttacacctttttccctacctggtgtaactttcctttcatccctgcaccttatcaatccttcaaaactcagctcaaatgtcacctccatgagagtttcattcatacatttctgtatggaattaatctctttatatattctgctatacccttgccttatttttgcctcctcgtatccttgattttcacagcacttggcattgctgagtcacccsccaaccccctttccttgaagcactctcctctcttaattttactagggggaacttgattttctttccagtctttcagattcctgtttccttcacatatccctcttcctcctccaaacacttaaaggtaggcatccttcaagggcctctccttgaccccttcttttttgttcaygtcttggttctcttttggtgctgtatcatggcttcaaccttcacttccggattgttcccacatcagcatctctaacattacattcttttctgagatccagatgcccaccaccagcaccagcttgatagcctcatcagcatgtcccacatatatcaccagctcggcctgttcatgatcctcccattcccccaaaaagtactcctctttctctgtgatacacgcttgtacctgatcctttcacatcaaccatggtccctatcactgtgggtgctattttcaccatatatgcacacatttttttctatatttcctttactagcactgcctggtttaagtcctctcacaaaatagctttctaattgatgttaaccagttactaaccagtgtatactaatctagccacctgtagtcactcaccttaacattcttcttgaaaaataaatctatttcccttttctccactttccttacgatctatgaaattaaaaaaaaaaaaaaactaaacaaacttactgagctctgcagggcatgaagccaaagccactgctttctttcacctattcttgtccttctctagctgatgttgagatggtgaggcaggaatccattggtttctcttttccagagagcagtattcatatgttagaagtcattgtatatacattctccagacctttctgtsgggtaagaatgtgcttcctccccacaggcagtctaccccacagggagcccactcatgcagtctcctctcctccccacagggagcccactcatgcaggctcctgtcctccccacagagagcccactcatgcagtctcctctgtcccacacagggagcccgcccatgcaagctcttgtcctcttcacagggagcccacccatgcaggctcctgtcccctacccctgataggaagcccagacattcaggctgctgtcctccctgcagggattccactgatgcagtgagcccacagtagccagctactctgcctctggctgaggaactgtggctatagagcagaaagaaaaaataggaagctcatgtctgcttcctttgcagccaagtctcccattcatttgccaataataaagtggctgctttgattgaatgatttgatttggtcgattcctgtctgtcttccatatctatttctcagttggttcatttgagaagggaggtgtatgactaactcacatctcaaaaccccagcacagagtattacacctgtcaggatcatcttcttagtgcctaatttggattatataagacctcacactaaatgtgagaaagccccaggattgctactgcccatagaacccacccaatttcatttaccctgcatcacagcccattcaccacctgtccccagcgtgacattccaatcatgtcacttgctacctctcactttgtactccaacacttcacacagcccagcaaagatgccccgcacgtctatgccttggatttcttgctggtcgttccctatctgtctccctccctctctgcttctctgccattctctctgcccctggagtgtggcctttatggatctcatcaacagactcattaccctctggcttcttgttgggttcggccaatgggaggcactggatgtgaactagagtgtgggaggacagagacgtccatacatttatcttcccatatcctaccctgctggattgtagatttacagtggctgcatttatctaccaaaagccacagttcctattaggcagccctcgcttagagtaaaggatttgccagattccatgggtgtttgtagctgcctgcccttcctaaccttggggtgctttaccatccattgttgagtaccttaatttttcagtaactctcttttattatcccttttgaggtaccagctatgtcctgccaggaaactaaatgacatgccactattgctccattaggatgagatgtyccactcccactctgcatatatttgtgaggcagttcagcagagcagaaagacactgggctagaagtcagaaaatctctactctgtccagtatggtactagccctctgtgtatatttagcatctgcaacgtgcctgttttaaaatgagacatgctgtgcatgtacaatacacaccagatgttaaagacaatccaaaaaaagaagaaatgcaaaatatctcattaatgactttttacaaactaattgaatgttgattatacattgaaatgatatttggaatatatttggttaactagaatatacaattaacaatgaatttcaactgtttctggctaattttttatggaatttttaaattatatatgtggttcacattgtatttctattggacagtattgacctagatgcttgtcccatttctatttctaacttgctagtgtgactctgagcaagttgtcaaaccattttgtatgtgagtttcctcatctctcaattagaaatgataattccttccctaacccacaggagtgttttgagagacaaataacataatgcctgaaaaagtgttatttcagctgtaaagaattctacaaatgttagggctatttctgtgaaaatytcaccaacgccccaatctgatgctcagatgccccgccccccttatgaagcatcctctaatgtttcctgttgtaagttatttctttctttttggcactaagacatttttgttaacatgagtttatcacattctgttttatatcagggttagcaccatgcttcccttcaattgccaggaaggttttgagtggcaagcacagtaccagcgttaatggcctctgatctccctgtaacaattgacttcattcaaagaactgtgtttacccgatgtgggtaggacaccagctcttgtgttccatctggctgcctggttctttgcaatcttcctagcgcattatttgcattttctggcatgacggaagaagtgaaggctttgaagaaaaacaaacctgtatttgattcctagctctaagtctatatctgggtgactgtgtgtacaccaaccttagattcaacatctgtcgaagataataatccctagatctcaagctggttgtaagaaaatcaagcagtatatagaaagcatctgacccattggctgacatagtggggcctcaatagatgagagctgagggtcatggctgatccttgaactgttggatcacccaggccatatcctaagtttcaaagtagaaggtattctgattctagtaacaacagtttttcttcttgttatttgtgttcttattcaaatttggcatccacaagcaatacaaatttttaatgctacccttgattcaaagacagttcatgaccctatgctcatgtgcaattataatttgcatactgaggccatccagaaagcagaaatcaatcaccatcagggacctcaacacctttgatccagcctggaggagctgcaggagccactgaagaactctgtgggggctttttatcttgaaagtctgtgcagataattttgactaaagaaattgaaattggaaacctaatatagcctaactataaaatgctgaagagaagacatgctctgttgccttgatacagttgaaggcacttttcaagagtgrcagtaaaatagagcaggagaaaaataaaataagtattttttaaataacccatgcctaaaatagcttattttagtgggacttgagtatgggtcagttgaccagaattctacatttactattttgcatgagtcacacccaaaatagattggctataaaagaggtaaaataatttaacggcactatctcagctatcttggtgtaaaaccatcctagaatttttttccttctaatcttttgcaaatgtcttgcccacacctcatttgaaagcaatgtttttagaatgaaagttttgagtatagtrtagtattcaactcatttttcatagaaacgaaagcttgcttatcatgaacagatttggaaacaaacattactgcctcttggtaaagaaagataggacacagctagcagacgtggggggtagacttgaaagaaccagctagctatgagtgtttagtgtatactgttgacagcctttcacagtagataggctagtgaatcacttaagtkgggtagggaggccactgtgatgcagtgctattctgtaaattatttatgaaaagtccaaaattccaagtttatcttttaaaaaccttgacactactcttgatcggccattggaatctagaaagttgagacagaggctgagaactatgccgtcaaagcaaaaggaaatctggcatagggcaaaaccattatttcatccttcatttgctcaacaagtattgatctttccttcccaaaacatttgcccttgcagtatttcctatcttagtgaacaaacagcaccacttgtccaccaactcttcaagctcacactacccatcctctccattttccctgacatgcagtaataattatgagcagttaattctctttctcatccatcttttttccacattttttyccaacgtttctaaccctacttccttctccatttctctcctgcatcactgtaacaaccctttggttccctgcaattcattctccaggctgcagccagagtgatccttctaaaatctaaawctagttaggtcatctctatgacttctgtactgggttgaatagtgtccccctaaaatgcatgttcccccgaacctcaaaatgtgatcttacttggaaataggatctttacagatttattcaagatgcaatcacacttgattagggtgggccttaattcaatatcactggtatccttataagaagagaacacagagaatcccagaggcaggagcaggaaacgcacaaaagagcaccacatgaagacagaggcagaggttggagcgaggcatctgcaaggactgctggcagccacaagaagccaggagagtgacatgggacagtttctccatcagggccccagaaaaaaatccaaccctgacaataccttcctttcagacttctgacctccaaaactgtaggagaatacatttctattgttttaaaccaccaaattgtgtggtaattttttatgccagcttaggatactaatacaacttcctattgctgttagaatgaagtcagacccatttcttacctctctcccctccttaaacattgcctggatggaagtaacagtgactggctctgatatagcatttactatgtgtgaggttctgtacttcacatagattacttcattcaatcctcagataaatcctatgaagtgggtgaattttttacctccattttatagatgaggaatttgaaaaacatagaggctaaataacagctagtaagttgtacacctggtactcagacctaaacagtcttctccagagcccatataaccaattattatgctacgatgtccttcaacatgggatgctcttcacaatctacccctctctccactgggagggccctagccctcccttccacatgggcacgctcctttagcctcaaatgacaggaaactcaactcatattggttctagcaataagaagaacatattgcctcatgttactgaatatccaggggcaggtgtacaattgtcacaacaggactgtaatgtgatcaacaggaatacacatagtgatgtggggaaatcagatgagttgtcttaatatagggaaaagatatagttcaacacacactaaagctacccagaggaaaagacccagtagcccatgaaggtgccagcttccaatgaaggctcccacccacagtgatatgtcctgactagactgaggatagtgcgttcttcagggagctccctttgcccttctcacatgggattttatgctcttgtagctcttccaaagtattctaaaggctccagctttctcctttcctacccaccaagtatgagaaaactgctaataatcatagaacattacttattccatggtagactgtcttccgccccaaccagcattagacctaagttctatttctaagcaggcttcaggcacagcttggtccaggggccatctagtacgcttgtttgatcacttcattattcaggactcagcaaaggcattaaaatccaatcaaaattctatactaattgacttttttcttagagycttccactcaagagttctcttcagagctttggtgatagtcaaatacatcttatcaaaatctaattaggttactgcattatagaatacatactgtggaccaagtcctgagttaggtgccggaattaaaaacaagaggagatttttaaatagaatttttttgtaacaaactagagtttggtaagcttggcagtttccaacttagtcttagagttatatatgtcatgtcttcatatctcctctgctggattacaagttccttgatccatggaggaattgtgattttccccctataatatctatcctgatatttaaacattcactaacactgtatcaaatgagtaaagtaataattaacttaaggaacatttccaatgagcatttctctttccccaaatatgtgattattatcaacagatattgaagaatcattttcttctctctttagtaaattagaggctagtttttgatgaattttcatatccaacagagaatgttcttgttgaactctataatccattaactcttctttcttcattctcactgtccaactgaatttgcaatttagatttatgggagccatgtcttttgtatattaattacagggatgtaaatatttcrtctttacaacccctgattccccaacagctcaaagcattttagttttcacacaattattccagaatctctttggaatatgcaagggacatatgatgccttgtgctgacttctatggtaatgtaattaatatttcattatagtcattttcagtttctcagccaagcagactgcaagcatggtgaaggcagagtgaagcttctccactgctctccccagtgcagagcacagggcctgccactaactcattccttactacacgtttgctgaagaacagtttgtcagatgcatgaatgagtagtggaagatatttcacaatagattagatggaatcatggaaaagattatgactcgagagtcagccccatgtgatccactgcacccaagaaaaggatgaactctaaatcagattctgcaacacagagcctgaaaaggagaattcactaatgaatccagatgcctgtgtgcacatctgggtgctgccacttacttgctgtgtgtcctaggacaagtacctaacctctctgtgcctcaatttacacatctgtggaatagtggtaataaatatccctatctcattaattgttatgaggattaaatcacataattcatgtgcaaatcttgaaacatagtaggtgcccaataagagctctcactggcagtggtgtagtccatatttattgcttctctcctttaggcattttctttaattgtgaaatatatacattccacagaaagcaaaatcctcagactaccagagactgaattgattttaaataagtaaagggagaaaccaatagagatgtttggagtatgaaaagaggaaaaaagcaaagaaggttggattacaccttatggatgattcaaaaaacaagagacccactgaatgaatgagtattacaagtattgtccaagtaagctctgttgattctgatattttctgtttttcgagtataagtaagaaaggttggattgatcattgttcttctcatgagcagaaaattgacacaagcttacagttaaatgctggtgtgaaaagtgacaattccatttattaaaggctctgaggaggaggttgcaaacaccatgcgctcacacccgacccgggcagtttctccaggcaatgtgaggagatatagtagtaaaggggtggagacttccagcctctgatcaatttctgtttcggagcactggcctggatggtcatgttttcttgatagctgagatgcagcagaagcagaatacagggttgatgtcctgcgcgatgggacaggttggccttgagcaaggtaatctctgagcttcagtctcctcacttgtaaaaccattttaataattcctaccaaggttgttttgatataaaatgagctccatgtaaaggtaatttttaactgtaaacacactacaaatgtaaattatttttaaaattttttaaatatcatatttgaggaggatatataatctcctgagaatgctgcaagcaaagggcttcttatttgaattttaattatctttcaacttccaaattagctcctccaattgatattaaaatatgatcttcttgaataaatgtgaaaagctcagttccacatcaagataaaatataaattcaatattttttaaatttcagtagatgagtgcataaaatatatatcaatgaataagaaatgacttcagaattataaaaattgaattagaaactaagaattcgctatgtagatgrtggtgttcaaataacctctgaagcatgtattatggcatagggataatcaggtatctatggaaactgtcgcatattaatacttgaaataggcaataatttgctttatctgtccacatgcagtcatgggttaggtagttatccaaggtgttagcatcttccgacacytacaataatgaaatacagtttgctttatcacaagtgcccttatcatsaagccaatgatggttaagcttcaaaggccttcactcgcaagccccttctaaggccttcagaggggccctagcaagttcgcagttatgattttcacagtttttcttaaagagtattctcttaccccacccccaagttatttaagtctcaggacccacaaaacctggatcaatcactactgctatccccttggagtagacagaatgttcttggaggggtggtgaggaaacttacaatgtaaaggtcttttccacaycaccatttgcagttttccaaaagataggtggtggttttttttagcatactgaagtaatattttagtagcttttataaaatatcctgcccccatcacaaattatagcatgcattttaagggattttgaagttactatagtataaaagtaattttcagaattgcgggcagtgtcactgggaattgtccaatagctaacaacaccccaatctatctgtgacttctgatctttcaatgttagaattctttcagcagaagaatttctgagagactgttaactgtatttatagacaacttaatggctacatagacaatagagttagacaggcctggtttggaacaccagctttgcatctcattagctgtataaaattgagcaaagaatgtaactttacgtgcttcagctttcttatctattacattggaataatccagcctgcctcactgaatcactgtgacacttatttgaaataaatgcttgtggtttaactaatttagggactgacaccaactggtaccctttccccatcccccgtgtcactcttagtgtccccagagttcaaggttcttgcttctacaatggaccttgttttgtggttgggagtttcttgctcctgcattccccacagactgtgtgttcttcaggatggtracatatttaactcccagcagcacattcagagcctgtcacatgtcagcatgactactgtttattgaagggaattgaattgaatagtcaaacagagtcaagtacgcatgttctttgggtatggagtgggatggtagagagatatgtggtgcaatatttgcaaatatatggtcagaagaacttccagggtgtacataatttctaagggcctgatgaattttagaaaggatttttgagagtgttgattaaattataaaatgccttccttctcctctcacctctcccaygattaaacaagaggacagcactgttcttgcccatgggcctcggaggtgggtgaaattctctcttgatagatcgaagcttctcttctgaacctggtgaagcagcttcccatttattataaagggcataggtcagaaaaccaccattgccacagctgttagctccagaggtatgtcgccttctagatacaccctggcaatatgtggacaatagccaccttctgaacagccacaaaacttgtgactagacactggagggctgctatttaaaaatccattatctccgtaactgtggttgccaggaatgaaaagcagaagtagctaagaatgctctccttttaaccttcacgttttaaatcttgcaggggtgcatctaactggcaaaactcaagcaacatccagagctgcaaggattctgggaaattaaatcattagctttccagcctcacctattcaggaaggaatactcatggcctttttattttttcaactgcaactcccagtaagaagttcattttacttgatgatttagtacacaaaggcatacaggcatatataaaacaaatgaaatcttcacaaaaaaacttacctttatagttattacagtctgatattttctattttcttctatttcatttttgcctgctgggtatgatccactaaatttgatttcaagctcacaaatgtgtcacaaactccaatttaaaaaatactgcactggctgtgcttggaagagatgtggaggtcttggctaccatgcccaccacagtcctttatgccccattccagctggatctcatcagtctctagtgtctctagctagagccattagcttgtaagtaattttgattcttcaggattcaggcccccaagagaaagcatcccgggcacagggcatctgtccctcatccaagacaggagccagcaaagrctgccattcttgataataaagctcagaagttagggaggtggaaaacccatcaagggataatgggccacacaaacgaagggtgctttgttggataggktgctagtctactctacagacagagagacagctttggaagcactttgtatacacatattatcaagagtattcaaaagagtattggcttgtgtgtcaagcttaccaagttttcaaatctggttctgtcatctgcattgttgagtctcttgagcaaatttcttcatttctgagtcaatatactcagaactataaaacaagatactaattcccactttgtgatatgtccttgaatgatatatagtatctctctggatttattttcttagctataaaatatgcttttttgctccattgagtagctgtgaggatcacatgaggtaagctaggtgacaacagccacacacaacaggagcactcagaagccgttagccctccttcctagtcatgtagcctaatcaaccatcctgtctttccatatgtgttaattmattgtatcaattatcttttgctctgtaaaaaagtaacaccagaatgtagtggcttaaagcaatcaccatttacttagctcacaaatgtgtgttggctggagagttctggtctgatcagctctgctgactctggctgctggatggtatagggcagcctcactcacatgcctagtattttggaagactgtggaccagggcatctaattcttcaccatgtgccctctcatcctccagcaagctagtgcaggtacrttcatatagttgtctcacggttccaagcattgcaaaagaaaacataagccctaatgtacaaacaattttgaagattctgtttatgccacatttgctgttgtcccattggtcaaggcaagtagcatgactaagccaagaatcaacatgtaaggcattagccaaaaggaattattatgcacatatgtgcaagcaatctaccacatttagtaagtttgggttgtccgtgactcccttcccaaaactctacaggatacaactggacaaaaaacacacgtacctacaggcttataggaaaagggagaattttattgtagatactgtagatagttgtgacttgtcaaagaggcaagggatgaaagtaaatgcactagtattagcctttttttctgtttcatgttaagggtttaaagtgtaaaagaaaataaatgtggagaaggatttagctcccacttatgttagtgactctagttgtcattttcacatgagccactccatgagaggctaattatcgttcccattttacagattaaaaaaaaaactgatgcttatctccttatcccagatggtttgggggaaaaaaaaaactgatgctgaaggaaggtcactcagctagaaaatgtactgaaacctagcctgtcatactccagaataaaattactttcttctcacaggtagcataagaccagggtggcaaatgtgttgggcttcattcgtgcggtttcctaaatgaccgccaggaaagaatattcattttaaatgaacaaaacaggtttataaatataagctggccctaagagaatatcaaagtaccctactttggttgccttgatcatttaagaaataccatttttcagactcgggaagctattccaaaatagatattttgggtctttttaagttttttaaatgttgtcctatttctggctttattattattaccttgcaaattgttttttccttacaaagcaaatgaatcaaggtctaagtttgatctgtttcattgtctgtatgtgtatgtgttgcaaattgatcccagccctgttgacaactggaacattaaggtttagcaaaacacacatgatgagagatgacagcagactgtggacatatatttttctgtattgacctatatacactgaaatctcacagctacctcatcagttgttgtgagaactaaatgattcatgtacagggcttgacacatagtaagtgctcaataaragtatggttggtaatggttttgtcaaaatgattgctattctctcttgggcttttgctttattattgaaataatgtattccctcctccttgtaagagtggtgattgtatgaggacacaagaggcttctagggttctattatggtctgcttctaggtagattctgtttatgagagtggttttactttatgaaaattcatagagctgtaaacctgtgatatgtacattattctctatgtaaatcgtacttcaaataagaagagatccttcagtagcccccagtagctttcaagatgaagttgatattccccagcttagtacacaagcctctttataatctggcccttgcctaattccacatccaactatttgaagctccatgaatacatcatctttgtcatatcatcrttgcttcactcatacaatttcttctacttaaaaccattgtcactcttatccatctagctaaagtctgcttgtgctccaaaactcagctcacatatcacctcttccaggaagccttccctgagactagacatccttaattgggcttgcactgtctttaaccttccatccatcactgcatttatcacactcagttatccttattgacttgcctgaagctctgtaagagtagtaaccttttcttcagtaaattgcatcattttgagagtttgaaaaaatatttaatgaatgattatctcaatagataaatgaatgatattatgatgagcaatgaaccccttttaaaattgtgattatagagacatgggaatgagaaaacacagaactgtaagttctgcagtaatatacaaataacattgggttctctatgtgtatcaatatcatgttcagtatccttaattcacacttaaccctcttgtaagaggttccttmtcagcagggcttctgtaactgggaataatactttgacttataaataatctaagcaagagtaccaaatacaggtgatgtctaactctatcaccaggagcttgttattaacatacaataattaacatgacaatgaccacttgttaacacagtaacacaccagagatattcagcaagcaagggtttattgggctcctactgtataccagacttgtgctaaacctaaagaggtgtaagattcactagcctttgacttcagagagcatattaataacatcagtacctaatgttattgaatcctttctacgtgccaagtcttcacaaaaattatcccgaatgtctttctttcatccatccctcatagccaatctgtcacaccatagcaaaagtagatctaaaagccattcacctctctccctgccaccatgttccargtccctgtcatttctcattggacactcagaataacctcactggatactcagaataacctaacgggtctgttttcattcttgcttttctataagccattctgcaaccagaagtgagagtgacctaaaaaagaaacaatgaggaaacacccccaatggctttccaccagagttggtgaattccaactagtggaaccaacacaatatcatctagggcagcagttcccaacctttttggcaccagggaccagtttctctaaagacaatttttccacacaccagggtggagggggatggtttgggaatgattccagtgcattacatttattatgcgctttatttctattattacattgtaatatgtaatgaaataattatatgagtcaccataatgtagaatcagtgggagccctgggcttgtttccctgcaactagacagtcccatcttgggggtgatgagagacagtgataaatcatcaggcattacattcccataagaagcacgcaacctacaccctcacatgcacrgttcaccatagggtttgcgctcctatgagaatctaatgctgccaccgatctgacaggaggcagagctcaggtggtaatgtgagcaatggggagtggctgtaaatacagatgaagccttgtcggcttgcccactgcttacctcctgctgtgcagcccagttcctaacaggccgtggaccagtaccagtccatggcccaggaactggggactgctgatctagggagcaggcaactgagttaatcctgcaaagctgcatggatgtagrcagattaggttgaaagcacatgcatagctgagccagggactattcagaaactcacaaaggtgtcattgtccctgcagaaaggaccctatagttataatttaatgcagaacataagataaatgaacaaaatatattaagatacaaaaattaagaggaaaagacactgcatcaataaagctcagagataatgaccctaataaaatcctggtcccactactcacttgttgtgtgatcttaggcaagtccctaatcttctctgagcctcagtttccttatctgttccctgttggcaggggcggagatgatgcataagaagcagtctcttccacctttgtccacatcattacatacataagaagggttaagatttgctctagggctaaataaagatgctgctcatggttagaggtgactgacctgaagactctggcagccccaagagctgcacacccaggttacaatctatttttggcaaatcattgtggccaggaacacatttgggaagttctgagaaactcaatacagggtcttcacatgacaaaatgatgggagctacaagtgtagttaataataacaatagctacagtaacaacagcaatgataataactatactatgtatattagtcagggttccacagagaaacagagccaagagaatgtgtagatagagagaaaaagaaagagagctttattttaaggaattggtgcattcagttatggaggctagcatgtccagaatctgcaattcaaattctacagccatcagactggaaactgaggaaagagccaatgttgcagttcaaatcaaaatgccatctgctgcagaattcctttctgcttgggagaggtcagcttttttttctctatttaggcctaaaactgattggaccacccatattatgaaggacaatctgctttcctcaaagtccatcaatttaaatgttaatcttgtccaaaatcaccttcacagaaacatccagaataacatataatctaatatctgtgcaccatggcccagagggttgacacataaagttaaccttcacacagtccttaatgacacaatgcttagcagtgttttctgcgtcttgatagaagtagcgaaactcctgtaaaaagatgttttggcactctctaaaaagactttgaagtctttaagccctaagatgtggttaagagaaagattttttccaaagggggctacttagcagtagattcagtgtctaatgtcttctgggcttgcaaatgtgttctttattcctcacatttgactaaatacctttcaggagacctcagcattttccccaagtgtttatcattttattatcaaagaaaaaagtgccttcctctttatttcataatgttagaattgttgctatatcagactaagacctcagctaaagaataccgctgatgtcctaagcattacttaaggttaaactgatcgtgggttattctacatgagaagagctaatcactggagtagggtggagagccacagaggatgtgcatgatgccacaccatctatcaagcagtcacctgggagcaaagactgtttttttcactgccattgtttaaaactgccaaggaatagtgatgataaaaagcagaataactggccgggtgcggtggctcacgcctgtaatcccagcactttgggaggccgaggcaggcagatcacgaggtcaggagatcgcgacccttctggctaacacggtggaaccccgtctctactaaaaaaataccaaaagttagccaggcatggtggtgggcgcctgtagtcccagctactcaggaggctgagtcaggagaatggcgtgaacccagaaggcagagcttgcagtgagcggagatgcgccactgcactccagcctgggtgacagagcgagaccctgtctcaaaaaaaaaaaaaagcagaataacttttagtcattttttttatgattttaaattctctacagaccacggtccctcttattgcctgcatctagtacagaccactcttcattctctctcccccacctgcccatgcccatggcatgtcactgccactaagcatgttacaagaacatatcacactgtgttcaataatctcacaagggagctattattattttacagatgaggacaatgaggtttggagaggttaagtaacttgcctgagttcccacaactaacttacagaacctgagcttctgtctgtgaagtgtggccttggcctgccttatgcattggggtctcctggcacagagtgagcatctagcaatgattgaacaaatcaggaaagagctttgtcccaaagttcccagtttgatgtattttagaactgctaataaaggcatctgagaaaatcttcactccttaaaaacataaaaagaaaaaaaaacaacaaaatatgaaacctgaatacctgaattttgtgactcattctttaaatcacataccatatccatggaatatagactatagagtaatgcagaccatggcctgtgagttgagcactgggaagaattaaaacatatctgatggccactgctattttctaatcacctttataaggagcattttcataaggagctttgtcatttagtctaaacaatcctgggagacaggtattgttctcactctgtagatgaagaaaccaaagctcaaaggaacaatataagttatcacagttacagagcaagcgagttgctgagcttagctgggattcagctcaagcttgcttgacacgagaacactgcagtcttaatatttctgagcagaaccaaaattcctagggtcttagaccactaacaaatagacatgaatgttatccagacttccaccctccttgctgaatcagtctgaagtgaacctacagaatatgmcttcaggagccaattaagcaacagcttctgcaatgctatgctcacaattggcttttagaaacatttatgggtgaaaattccataaaaaaccctttaatatataaacccaaatgccagagtcaagattttggcaacaaaaatttttaattttttttcaaattattaacagttttcactgtgtagcacaattgtcttttcacatatgaggtctattcatttcccctatattttctgggtaattccttttttctaagagtgaaagctttagcaccaatatacaattaaagttcaaaaacaatgattaaaatagagcaggcttgccagtaaatttaacaaacatttgggttgtggttacaatgtgctagatgctatctaattcttttataaatattaactgatttaatcccacaccaaccctataaaatagatgttattattatcatctgcaattcacacaggacgcaactggtacagaggggttcagcaggttgtcccaagtcagagctggagaggggcagaggtagggttcaaacccagagcctagcttcaggatcatgtgcattattcctctactatgctgccgcttgctgtcacttaccatcacttcaggttccttgctttgcttccccccttttagggttagatacttgatgctggtctgggttaggtatttgcctttgattcatctgttccttctacaaacatgcattggcagccttattgtaccaatttatttcctgccctgcccttcatttttctgggacttcccttcttccctctgcacctaacccaccccactcttaacagtgacccccataataaatatgcttattctcatggccctgcacctcaatcatgtacgttaggcaggagtcattgtttgacccatgcagagttcttattcagacatgttaagactgaaactgaacaagtttcctccaaatgcatagacataaggtgcaaggatccagaggtcttagtggctgagaagtgagaggggatgaggaagctagccttcaggagaagcagagatccaagtttaagggtgtcatgatgagtcatgcagactcttttgttcccaaagtccagcctcagtttcacccttagattccataagtcatcccagtttactaatgatcaagcatgattttgcttcaggtgaatactgaggaaaatatgagtatcttgatgaccaaaggagtccagacaaatacagccacttcttttttactaagcttgtgttgggttctggaggtagagaaaacatcttggtctcaaatatttcacattctagggaggatgacagacattcaaacagaaattgcaaatttccttttagctgaaatagtctgtatgggctgttgcttggttaattgaaaaagcaaactaaaatgaagaattatgaaaaattatacataaaccttttatttgtaacttaaacataaaatgataaatttattatctattcttttgaaataatgctgagccatttttaaaaaaacttctgtaaatttccattttacattcaaatgattatcagaaatcaaatattctgataatatcaagtttgaatgtgggttcatgggcatacacattgctagtaagtagagcagctattagtatgttgtaagaacataacattacttaatgaggttgaatgtgtgactctcatgatgtagcctgatgatgtaggcacataccacaggtttatttattttattttattttcaacttttattttagattcaggggtacatgtacaggtttgttgcattggtatatcatgtgatgctgaggtttggggaatgactgatcttgtcacccagtcagtgagcatagtacccaacaggtagtttttcacacgtttccccctccatcctcccttttggagtccctagtgtctattatttccatctttgtgcccatgtgcactcaatgtttaataccattctakatttcagccttggccaagaacttatgactgaatgctcaaaagcaattgcaacaaaagcaaaagttgacaggtgggacctaattaaactaaagagcttctatacagcaaaataaactatcaacagagtaaaaaatgaaagaaatccatttctacagaatgaaatattcacaaactatgcatctgacaaagatctaatatccagaatctataagaatgtaaacaaacccacaagcataaaccaaataaccctttaaaaagtgggcaaaggacatgaacagacacctctcaaaagaagacatacgagaggccracaaacctatgaaaaaatgctcagcatcactaatcaccagagaaatgcaatacaaaaccacaatgagacactatctcacacgagtaagaatggctattattaaaaagtgaaaacataatagatgctggtgagactgtgcagaaaagggaatgctcatatattgtcatagattgttggtagaaatgtaagttagttcaactactgtggaaagcatttttttagtgttgatctattgtttcttacagagaccatagccaaagtgcattagttartatttctagttccttaaaatgtactgagaatttaaaagtactttcaaaattatcagagtgacttccagatttttataayttttttcacagatgtttacagctatcttgccgacatctaatttagtgtcattgttttagctgctcagcattacaaagtcttcccaaagtatttgatttcattatcatgcaaagggcatctctcttttcctatttacttagtcttttatttaatatttaattaaatcacataaatacactaacagatgataaaactaacatagctgggtttgaggacaagctcagtgatttctgttcagcatggggctacagatagaatagaagctgtaggtatttataaatctgtttaccatctgggaacctttcaccctgcagtggcctgatccactgacatgtgtaagagagtgattgaagagagtgggttagtccagtaaatcaattaagacagagagttgattaaatggatgtcagccaagagagcgtctaccacactaaggtggtacaggtgatgatttaaaggttgatgcaggtttcagtgaggcagaaggatgcaggtctacatgaygtacgaggacttgggggaacttcatggaggtagtgtcacttcagcagaccagttagagaaggcatcccaggtacagatctagcatgatcaaaggaatgtatgacccatctgagtaacctcacagtctaaaacattggggtggaaagcctttattttagtgataagcacgtcttatttcttatttctagaatttcttatttctagtttttagtctccataatcttyctgacacttggtctctgtcttgctctgagtgtggatgataaaccatgcagaagcccagcttttcctcctttctgttctcagctatctaaaaccttcccagggtctcacctgctgctgatagaacagccaatcaatcctaagtaactgagttgccttcccacatctctagcatgggcctsctcctgacttactgttgtagtattcatcaaactactgctggacctctctgataccatgactatcatctctccccctctcctgtcatcttggggactaaaccccccatgaagtagaggatcatgtctgccttgttcaactctaaatttatagcgtctaatacagtacattgtcttaagtaggatctcaataaaaaatttgttgaatacataaatgatttaatttaataaaagacagcataccatagcctcagtattgactgttcccctgtgtctgaaacacccttccctagctctccacaggtctagctccttctgtccttcaggtaccagttaaacatcactcccttgaaaatttcttcattgaccattttgctaaagcagccacaaactccccttaaacttcactacagggtttgtttgctgcttttagaacaatggttctgcaaaagtgaacaccatgtctgtttttcttttctgctgattcttcctgccaagsactaagccacttactcctggacttagtaaataaatgattaaatgggtgaactatgatccaagtttcagaaaaaaaaaaaaaaaaagaaagaaaaacacgggcttgggtcttcactacgcacttaccaaatgcgtgactctgagttgcctgatttacttaaactctttgattttcagtatcttcrtacgtataatggaatgaaaatagcatcatattccctcttacrattaatgtgaggttttaattagacaataaataggaagcacttggtgtgctacgtaatgtgtgatcaacaacaataagatattttttgtaactccagaacaagtctctccccagtgcctggaacttggctccagttaatgccactttgcctgcagtggagagaaagagattaataagaagtctctccatttgtgagagcctgaaagtggcaagctcttcctgaagctgttcagaaacactgctgctatgtgtaagyccaaaagtgctgtctgattcacagggctgcsctgatacctttatcttcactgctataagcatttgcataaaataaagatcctgaatccctcactgttttcaccttgacttcccctcagggtgcactgtagcaattgatgcctgtaaaaccattttgacgacttgaatagagtatgttatgtgagatgagaggggaatccagacaggagccactaatggactttgaatcaatccagggtctcttttcatgcaaatggaaaaactcagggagaaaaagatgtgcagaatgtgagcacaaaggccacccagggccacagtctggctccaggagagaagctggtacttctgatccccaaagccagaaaaggatatattgcgccccagcaggagttgggaatcgtattaaagagcaaactttcctattttatttcagagtgtgttttcagggaatttaaatgatgtttctcaggcagtgaacaaatgtgagggaaacaaaagtgttgaaaatgggcttttattagcagactccaggcaaactcccatgtcttgcagaaaatgctttacaragggaggagctgggatgattgccagtagcacaactggctggaggctggcaagcctgggtgcttgagaattttaccagtaaaattttattttcaaagtgtcccatgaaagcatcgatgacttgaggatctaaygagtgttggcacttaaagactatttaataatgttgttttctttttagagacagagtctcactctgttgcccaggctggagtacggtggcatgatcatagctcgctgcagccttgaactcctgggctcaaatgatcctagaaactatttrcccaatgttctctaccaggaacattactggtcactgcagaaaatgcatccatgagctggatacagccsctgccttctgtatgttcacaagtttgctcgagaaatatttacttagaacctgctactctcaagcactgaggaagttgctgaggatcctgagtgaacaaagaagacagaatcactgtcttcaaagcatctgtagtcttgttaggggaaccagacaactaaacgtgtgtgatgagcattacaagaagggaattggaaggataaaaagattctgtgttgcagggcaacagtacatagacctctcaaaggaaagaacattaagcaactttaaagcagaactatgaagtatgattcggagctgtgaacaactggggagagatttatgaagactcataaagactcataaatctcttcataaagagatttatgaagagatttatgaagagatttatgaagatttatgaagaaagtgattggacagtagctcacacctgtaattccagcgctttgggagaccgaggtgggtggatcacttgaggtcaggagttcaagactagcctggccagcatgatgaaaccccgtctctactaaaaatrcaaaaaattagccaggagtggtggcaggcacctgtaatcccagctactcagaaggctgaggcaggagaattgcttgaacccagaggcagaggttgcagtgaaccaagatctcgccactgcattccagcctgggtgacagagtgagactccgtctcaaaaaaataaataagaaagaaagtgattggagattttaaggaagtaaaaggcctcctttgtgctttttgccaaaaatgagagggaagggaaagagtgactggaatcccaaacagtggtcagtaggtattataaggggtttggaatttctcctaagaacagcagggtttaaattcggtaagtggcataatagagactaagaggtatgttaaaaccaaaactaagtcaggcaatctatgggattggcctgcctatgagaatacagattcatatcctccaagaagacactggacatatgatcatatatgatcaccacagtcttcccatttcacattcatttactcctgggccattgtcccatcccagatttgttcactgatagaatctcccctttcccctgcttgaattttcccctgtttgtattcaatctactttagtgttgttgctgtatcttctggcactagcccatccatgctctgtttttattgcaagacaatgtagttgtccygtccactcccattctgaccatttccaggctctttttctgattgtatcattctcgcctgtgcctaggtggctgcagaaaccctcttgctctgtgcaacctaaagtaagacatgctgaaatcataaggtcaagcaaggacctggatttgcttcataatgatakcccaaggatgagtcataaataggtttcatttcctttgttaattccattcaattagtgatgcctgccagtgctgtttttggaggctgagcaagagccagtgttcaagtcaattaatgatgtctacatggacagaagtaagaaagttaagcagtacatgcttgggtcatttttctttcccagtccagagtaaatattaatacctgcctatgggaattctattcaggtagatccaaggttccatcctttacaagtccagaaacccaggagtcctcttgatacccctctttccctctttcacagtcccaattcctacaagtctccctcccatgtgcccatgtttctccatctccactgccatgaatttggtctaagtttccttcacctcctgcctggatgattacattaaccatttaattcctttcattcttccttccctctatattaaccatttcattgaatctactcttttctgtatttcagttggaatgatgttgaaaaaaatctaaatgtgatcatttctctgatctccaagccaaacactttagttgcttctggtaactctcgagataaacacccagcaaggcccagcatgtctccataccctcacgccactctactccactgcacttggctggatgctagccatgatccttcttttggtttctcaaacatgctgtgccctcttcaatcaggcctttgcacatactgctctcttctgttagaatggtattccacaaccattagcacacacataaacacatttgtacatgcttgcatacacacccttcaattaactgttcatctaagttaatcctttcactctggactctcgatgaaccatttgtgtctctttcacataacttgttacagatgtaattgtataattattactatgcttatttgattactacctcaactatcctgccagaccatgcagccttcatgtcttgcttggtctgttcaccaatgttctctatctattgctgtgcttggcactagaaacagttacaggaattatgaatcacagcttcatagctactttattttctgttaaatgttacactaaggtaaattttcaataatgaggaagattaaatgaagaatgtgtaaattgggtatctatactcacccatttttcctgtaaccgagaaaaccatatgaacatttctggtggcaaagtcaacattgtaattactaaatcaaaggtagacaattccaatgtcttccataagacagtttcaaaccttccataaatctattcaaatagagagcatgttaatgcatgtcaatatatactttaatatagtttaatattttaaaaaccggtaatacaataagggtttaattttcaactgtacaatattatacactctctcacttcacaattattacttgtagaacagtggactgaaaagacaaggatcagttaaatcaagttcgtaattacagaaatcctacaacaaatatatattgaggccctatataaaccaggtgttattctaggtgctgggattattgaactgaacaaaagagacaaaaggtatatcatcataaagcttatatttaagtgaaatagatagacaataaacaagataagttaataaaatatatagaaaattaaaaaatattgagtcctaagaaagaaaaaataaataaaacaggaaaagagtgtgatatggtttggctgtttccccacccaaatctcaccttgaattgtaataatcctcacatgtcaagggcagggccaggtggaaataactaaatcataggggcagtttcccccatactgttctcctgttagtgaataaktctcatgagatctgatggttctataaacatgagttcccctgcacaagcctctcttgcctgctgccatggaagatgtccttttgctcttcctttgtcttctgccrtgattgtgagagctcccagccatgtggaactgtgaatccattaaacctctttcctttattattacccagtctcagatacgtcttcattagcagcgtgagaagaggctaatgcagagcacatgaaatgagaggccaggagcatgtgaccactgagatatgggcataaggggaggtctccacgagagggtaacttttgcataaagacctcaagaaagtgggatgcattcattgttgcttatgcattcaattttctacaattatttacaaactgggctgttttaatgtctgaaactctctctttttactacccacttgcttataaagcatcatttatgaacaaatagatttattcacatattttttgtgggcgttggggtatgtcctgggtcctcccaagggattatgttgctcactaagcatcacttttcccacatgkcgtaacccaaagacatccaggagaatggtgcaaactattggtagatctaccattctggggtctggaggacggtggccctcttctcacagctccactagatggtgccccagtagggactctgtgttgggcctctgaccccacatttcccttctgcactgccctagcagaggttctccatgaatgccccatccctgtaacaaacttctgtctgagcatccaggtatttccatacatcttctgaaatccagaaggcagaggttcccaaaccccaattcttaacttctatgtaatcgcaggctcaacaccatgtggaagctgccaagacttggggcttgcaccctctgaaaccacggcctgagctctacattgacccctttcagccacatctagagctgctgggacacagggcaccaagtccctaggctgcacacagtatggggaccctgggcctggcccattaaaccattttttcctaggyctctgggtctgtgatgggaggagctgccatgaagacctgtgacatgccctggagacattttccccattgtcytggggattaacattcagctcctcgttacttatgcaaatttctgcaggcagcttgaatttctcctcagaaaattgktttttcttttctatcacatcgtcaagttgcaaattttccaaacttttatgctctgcttcccttataaaactgaatgccttcaacagcacccaagtcatctcttgaatgcttttctgcttaaaaatttcttcccttagataccctaaatcatttctctcaagttcaaatttccacaaatctctaggacagcagcaaaatgccaccagtctctttgctaaaacacaacaagagtcacctttgctccagttcccaacaagttcctsatctccatctgagaccatctcagccaggaccttattgtccatgtcattatcagcattwtggtcaaagccattcaacaagtctctagggarttccaaactttcccacmttttcatgtcttcttctgagccctccagactgttccaacctctgcctgttacccagttccaaagttgcttccacattttggggtatcttttcagcaacgccccagtcccggtaccaatttattgtattcgtctgttttcacgctactagtaaagatatacccaagactgggtaatttatacaggaaaaagggttttaattggacttacatttccacatggctggggaagcctcacaatcatggcagaaagcaaggaggagcacatcccatcttacatgaatggcagcaggcaaagagagaatgagagccaagtgaaaggatttttccttatcaaaccatcaaatctagtgagacttattcactaccatgagaacagtaaggaagaaactacccctgtgattcaattatctcccaccaggtccctcccacaacacgtgagaattatgggagtacaatttaagatgagatttgccaaaccataccacaaggcattattctgggccttggatacaaaaagatgaacgcaaagagctccgagtttaccaactggtatataagcaaacaggtgccatgtggtgtaataaatgctgtgagaaagatctgagcaaagggacatgcttttggaggtagtgactaatccccttcaccacggaaatgagatttaccctcaaatttgaagatgagtaggagtccatgtgcaaaccacaggaaatgacaatggagaaaggatatttaaggacagaagaacagtagcacgcattgtagtgacctgtgctcagtttaacacaataaatagcccataatctcctgctcagaatagaggatgtgaggatagacaagactatctctcactataggatcctacagtgtgtcagggttgggagaagaaaacaagggttagccaaggagagctggacttttccattcaaaaatacaaatctagttccacagatttttttgtttgtttgtttgtttttttgaggcagggtctttctctgttgaccaggctggagtgccgtggcacaaacacagctcactgcagtctcgacctccctggttcaaacgatcctcccacctcagcctcccaagtatctgggactataggcacatgccaccatgcctggctaattattaaatttttggtagcaatgaggtcttgacatgttgcccaagctagtctcaaactcctgtgctcaagcattcttcccagctcagtctcccaaagtgctgggattacaggcctgagcaaccacactcggcctggctctacacatttaacttcagatgagttgcatttaataactgcttccctaggcatttctttgcatcagaaaatctgatgcagagtccatgtgtctgaaaagtagctgagttccacaaaaggaaacccactatgggtcatnnnnnnnnnnnnnnnnnnnncagttgtaaagtttcttaatttttcatttaaaaaatgtttttagtttgcataatgtatggtagcaacaatttttggcaccatttgacatatttccattgatttattttaactgtactattctgttttatttttatttgtttgcattaaggattcaattaagtaatcattgagtatcatgtgtatgttttgtttaactgtagacataattgtgcaccactaattgcagtggtaattacattttcaatttctgaaaatggggcttggagggatttttttaggaacagctttctgataaggtgaaggggaagcttccaactggctctggggtctgatagactagatactggcccttctttgctgtataaccttgagaaactacttctccgagacttcattttctcagttgttmatctacaatgagttatttctgccatggagttatgttgaatgttatatgaaattatatatgaagctcttaactcagtccctggcccacagtagttgcttcagagccaactagatggtagctctgaagtaagaatgcgtatctttccatgccattccaggagcctgtcagtctctacctataaagtctccctcttgaatcttggctgtcttactctctatgtatctatatatctcccatatctagaactgagctgacatgtagtatgttctcaataaatatttgttagatgaataaataaataaatgtttgaaccctcacacatttttcaggaaccctccttagaaactcgtccctcatcttccttaatgaacaatggttctttcctcctcggaggctttgttgcatactgttagctccaatcataggaatatcccacgtgctgccttaatttacaattttctaagagccatgtggatcagataagaagtgattagaatacattttgtaggaagtgcagttgttagagctattttgggaatcaggagaatttggtttcaattctttgctatttatgatctaggtgctcatgttgctaggtaatcagtttactataaccatgtgtttgttttatttggaacataatctgttttatggagctatagtaaaggttgagtataataaagtgcttagtagtgcttgccacaggataggccagaatttctcaatcctacctgagtatcccaaaaacctaaggagtttttaaaaactccaccctcttgaccatttttctcagagtccaattcagtaggtgtgggtggggtcagggcagctgcacttttatgaaccttcaaaacatactgatgaatggtcagatcacagaatmcatgggatagccttataaatatgtccatggacttgaatttcagggaggaacatcttcctaactaggtcctgtgaatgaatagctttcttgtgtctctcttcagttcccatttcttccctacacttggatcattttatgtgctgcatcaccacctttttatctcctgtgccattctcttcctaacataagttcttccatttttctcactctggttattaaaacatcactgtaatacaacactagtgtaaggatgatttgcaatcaaacacttttacaaactgaccgtggggtcctggagtgtgtgtggattgtgtattacagctctatcacttacaagtgcagatgcagtggcatcttaattaaacatccccagccattgacagagcactagtgcccctcacagctgtaattagcacctactcccacccagcagcaattgagagagcagggccacaagtacctgggaagttgacaaatagcacaaatgaacacaaaatggacatgatgttggggcatttgcagaaagcatgcctcttagtcccgtgatgggatagcactcaagagaagaaagggcttcatcatatgtcattcaatgggcatttcattaataaagccttttgcatgagaggcagagtgaagtagaggtgagaggagggagaaggatttgatgccaggcccctcacatattttattgcattnnnnnnnnnnnnnnnnnnnntgccaggcccctcacatattttattgcattgaattctcacagcaactctttgaagtagatgatattattgctattaatatttgccaaattagggaactaaggcacagaaagatgagatagtttacctaatggatatccaatgatagagttggaatctaaacttcttcatcagactcaatccaagacttttcccatctcaccaagaatcccagctaggaataacaagggaaaggaccgtaccctgcaactgccgcttgattaactgttcaggttgtgcaagtaacttaatctctcctggactcattctgtccattatatgaaaatgattatttctgcaagctgattgtcagggtttcgagagaaacacatgaaagaatgaatggtgacaatgcttaatacccataaataactacaaagatatgaggaactgtgatgattagaacgtgcctgtcttaaactgtttgacactatagtaaaccatagaccaagaaaaattttatctctctatagtgatatgcctcaactagataattccacatgacctattattatcatatcaatgataattaccctattttctattattcaactaaaagtattaaacttcatctatcacagtaaaccacgtaaccaagtaaaccatgtgtcagaagccagcctcttgcctagtttccacaacacaaagactttttagaatttaattcatgttgctagttaacccattactttccttttgtctacagtggtgatcacaatagaaatattattgtttggtgttaggaacccactttcaggctgcgtgcgtctcacttcctctcatctttgataaagagctagtgccttgtaagcctggtttcttttgtatgttcgctgtttctgtaagtgtagctcactctcccaggcaactaaagtcaaaactagctatcatggtgggcacaccctttttctttcctgccatctcggttgccagttctatgaatcttatctcacctggacactccaggagcttcccccacctggtccctctgcctccagccttggctcctccccagaacacattctccaaatcccagccaaagtgatcttttaaaacataaatccaattatgtcactctgctgcttagtaccatttagtggctttcagttgtagttggaattaaacacaaacattgtatgctcacctgcaagatctagctacacctccaacctcattgctatcaccaccctccagccacaccattgctcatttctgcctcaggatatttgtagttattatttttaattcctggatttctcattgcactacacaggacagactccttccaaattttcaggtctcaattttaaatatcagttccttggtaaggccattcttaatccctgatatgcatcgctgtcatcaaccattgtactctctcatcatgacctgtttttgcatggcattcatcacattttgtaaatgtgtgtaggtatctttgggtatgtaatacttaatgtatcttccttattagaatgtaagctccaccagagtcagaaccacatccatttggttcaccactatatatccaacaccagcagagtgcctggcaaataataagtactcaataaatatttgttgtattcatagaatggtatgaaattagcaatcccaaagggagttcatccaaaagccccatgacttctccaccctccaccctcccatctgagactcgctggtcagcctaacaggaccgtccctcttcatttgttccaggagcggctcgtgctttctgtgctcccccggtttgttgtcctggaaatgatcaacgacatgaccaatgtggaagatgagcacctgcagcaccagttccatcggatctacatccatcgctatgagaacgtcaggtgagaaacacaacacccttgccccrgctcttgcatgatccatgtgtgtttgggtgctctcattgcacttccgtgacttccrtctgcttgaatgtcagcacctttcctcatctggttgattaattcattacctagtgattattcatcagagagttctacatttccaaattaaggctagagaagaatgtcacagataaaattatatttgctggttgacttactgcctagctctcctacagtaggcgtgtctgtctttacattttgagtgggaaaggcaaacaccttttagactatgataagaaaaataatcccagaatgtaatctgggggtttcaggtgtgatcacatacatcccctccttatattactcataagtgtgtttaaaacagtacaaagaggatgacagtttattttcctttgcaaacttatttttggccaaccatccatctatccatccacccatccatctatccatccatccatgtatcttcccacttactcccccatccatgcatcagtgccctctatgtgcccagcacaacactggacaacatggcatgtactgaaaatcaaagggtgaactscatggtgaggcacacaagctttaaaatcccaattctgcctattccttgtttgtgatcttgggaaatttatttacctgaatctcaaaattcttccctgtaaaataagcaycttagccactttgcagagttttatgtggatcatataagtgaatattaatacaaaatataaaacaggcagagttaagcaagtagtagagcattcggtacattgtagttcatttcagacatgtttcctagtttcagtcaaaagaatccaaccatgactgatttaaaagaaatgtactggccgggcacggtcgctcgcgcctgtaatcccagcactttgggaggccaaggtgggcggatcacgaggtcaagagatcgagaccatcctggccaacaaggtgaaaccccatctctaccaaaaatacaaaaattagctgagtatggtggtgcatgcctgtagtcccagctactcaggagactaaggcaggagaattgcttgaacccgggaggtggaggttgcagtgaactgagatcgcaccactgaactccagcctggcaacagagcaagactctatctcaaaaaataataataataaacgtwttgaaaggttatgtcatggattacagaatagttagggaagaatggagaagtacatgagggaaatgggccagaatgaagcaaggccacagagtgaaaggcataggcaaaatcaagccagagcacttaggccagttaggaggccactgccactgtctctgaccagtccattgcttgtgcaatcaaccctgtccccaaaccagcccccaaaccctgacacagccaccactgcaattccctgtccccaaaccagcccccaaaccctgacacggccaccactgcaattcctcctgcagccccagaaactgacattgctgtctttgctctgccctgacttcctgctcctgctgcttctttgcatctcaarttaaagcctggagcagatgggtctgattggctgagcccagtcattttctttaagtgcctggaaagcaagtctctggcattttcagcttatacagtggaactgtatctcccacccaccaaatatcataaggtaaaactttcccaaacatagagtcagagtccttacattaagcaacttcaaaagtgacaaacctattctcatagttcctttcctcctaatgtcagcaggatagaggacaattttgcacttagcagcatctgtaggtgttctactcctggcatgcaggaacacgcgttttaaaattcagtagagatcatgattctaacacaacccttcagcgggcayagcaggataggtcattcccagggtcttgtccaagaattgagctacactgatttagatgcttgagtttgcaaaacagccctttgtcaaacagcaattccaggaagagatgcgccccagatctaggaattggtcccacacrtaataagaactcttcaatactagttctaagacaataggaacctattaatcataatagaatatggggtttgattattaagcaggccacaaatgccaagagatcataaaaggaggaaaacctggggcaaggaggtggagggcgggacagggagataggtagagaaaccttcctggaagagatgatgattcttcttggctttatttgagacgaagtcagccaagtgaaaaacacaaatacatgaattctgagcaaaggggtcagcagaagtgaaggcagagccacggtccatgcagagaatcataggtggtgttccatattccttccctggtggcaaaatggcttgaccacgaatgcagatccagagaaagcagaaattgcgtgaatatttggggaaaaaataaatatttaattacatactcatctataaatatatacaaatcatataaatttataaataaaatatgtggcatatgatgaaagtacctgtcaccatggagaaagaaggagggaaaaatacctttaaaaagaaaaataaggaaaattcaacaagccagcgcgtccacaccaacatgctcaggtgccttaagtgcaataaacagcatgttcggcggctcgctttctgcaggaatccttyttcagtgctcccgttactcttaagcagctagtttcttctgcccccacccctccaaccccgcccatttattttaagtcattgaactgagttcttgtgctggagacccttttccagaagttcacgccacagtacattaaaatttcgttttctgctctccgtgtctccgcgttttcagagccgytactagggggaggagaattgatgcagaaaccagccgccggccctgttgctcccgggctattctcagagcagcgtggygagatgcccgcggctccgggggtttcgggaagatgaactcagctcggggcggcggggcgtctcctgcccactgcgaggctgcagggtgctaaaataagaccggagccttgaaagcagaggaggacggtccctagcccaagtcggagaacaaagccaactggctgctccacccgcttccccagcccccaaagcaaccccgctgcggtgttgggagcatttttgaaatcatttccaagcccgtcaccctcttcatggtaaactgcctggtgcattattttttctcccttggctttttttttttttttttttaattttgaagactctttcctaaaaaagtgctgtacacatctaagtcttgacttacatttcataccactgtttaccttcatcaggaaagggtatgcttaaaggcgccatgcttgggggcattcgtgtgcccacgtgggctggggtagccacacccttggcaagacttcgactgcatcacctcatccctgtgggcctccgtttcccaatctaaaagctggactctttgaacgctcaarttgacttcagctatcaacctctgagacttctccaggttcacctgaggatccacctggccaccagctttttactggaagtcattcacgctctccatcccacctacccgattgtattgatctttcctgtttttcccccagatacttaagacacttcttgtattcattagggtaatgctatctgctctttcaaataccctttcaatttcagtgatttttaactcaatcaagtttattcatgcaagtgttcactgctgatattactggtcagtgggtgattcaggaacaaaggctcctttgttttgtaactaccatcccttgggcctcaaagttcccagcatttggttattggaaggggaagcagagtactcacacccacttttttttccaccttaaccagaaaatgacgtatgtcatttctgttcagattccattagggagaatcaattccaggtgcccacctagaaacaaagtgggctgggaacagtgcctctggctcaatggcttttcctagtgacaggtggattgactatgcaaatagaggcatggatctggtggacagtcatccttctctgtcatggttctttttcccatttcctattggccctgccaattccatttcatgtacatttgcacatttgctgacatacattttgtgggtctgtctgggagacatgtttgtctttatctctccctatgccatggtagatattttagtgaccaattgtcaaggatcaaaaaaatcctcgtttttagagtcttgctcagtctgttcactttcttgactggctgttaatttccagccagccctgtcaacatgtgtgatcactacatctgtcctgtagactagagtttcacgaacaagcaaaatgcaattgaatggagctagagaacttgatgactttctagatccatccgcatggcagttaagcacttccagattcgtaaaaacttcccaaagaggttatatacccttcatttattgagaattatgcaatgatttacaagttgtcttcttatggtagtcctacagagtagctttaatgacctttgctgtattatcaaggaaaatggaagctcagagaggttaagtaactttcccaagaacacacagttatgatattggaacaccgaacacatctgaaacttagttagtgagaggagtctacacagggaccacgttcctaatgattctattgaactccgcaaaagcttccttggggattctatttgaagagtgactattaggtaacatgacttatttttagccaaataaacaatttatttggctaaaagttggctaaattagagttgaaaattactatggcccccttggtatattcatcctggaaagctacaaattatgccaagaatcaaaagacttgatgatctgagctcagcacctggaggtggcagaacaagcaatggaatgagaaccagggccctggtttctgcttctggtcttttattcaataaatccttattgtacaactatgacttaaaccagtgcttctgagtcttaaatgtgcacacaaatcatctacggctcagttaaagcagattgtggtacagtgggtctggagaggtggcttgagagtctacatttctaacaatttcatgagatgccactgggggccatgaccatgctctgaggaaggaggacttaattctgaatgtttctgttgattggactaaggaaacatgtaatagggccaactgtgtgctgggcaggtgggatgcagaggtgacttcattcttgttcttcagctaatagatggagcacacttagccacatatgattgtgctattgagagttaagtgttatgacagagaggggcaccaacagggcgagaagcttgagttggggataactggctatgcttggggaagtctccagaggggtatagactcttaacatgattttaacacctgagtggggctctgaaggacaagtcagattttaacaggtagcaaaagggggaaaaakctataccagggagcaggcatagcatgtacaaagatacaggtgcataatgtatggtgggatcgaaagacctggagaagtttgatgatattggaacactgaagacatctgaaacttttatgaccttagctctcagggaatccatttgttctttcaataggctgtgagctttataaaggctgggatgatgctatcatctgctcactactttatctccactgcctggtgtatagtagtcatttaattaataagctgttgaatgaataaataaattggtaaaccattcttgccatagacagatggatactagtagctttgggcttatggattcataaagggaatgtgttaaaccaagtgatctaagagcctgtccacttcccacctgtcatagcaatgacttttctttcttcaaaaakagcatagctgagcaataaagaggatggatgccagagccaggcttcctggttcaaattctagctcttcatgattataggcaagatacgtaggcctcagttccataaaatggagaagaacatgataggttctccctcataagttacatggaataaatgagtgaatacatgtagggctctcagagcattaccaagtccacagtgaatactctgtaagtgttgctgctgcctggcagttcaggcttcatcaacagttaggaatgcttttagctacaagtaatacataatcaaatgaatggccatattattttctacctctgttacctctctcttctctttctctctcaaatataacatgcaattatagtataattttgtaaaatgatgataacaaaagctaacacgtttaaggaacatttactatgctggcaattgccaggtgatgtgctaaacactacccactaatgaggcaagtatgccagttatctccagtttacagagctagggcttacagaagttcaggaagttgcccaaggtcatagaattcctaagtggtgagctaagatttgaacccagatctatctagactcaaattctgtgcatatgaccatatgttctgccaccacggaactgtagaagacaatggcagtatagtcactctgccaaaggtagcttagtaaactgaaaatctattggcatcatgtccatgcttaaatcccattcactagctttccatcactttcaggacaaagtctacattcttcatcctggcttaccagccccttctccatcattgccccacctgtatttctgacctcatctctctcttctttctagcctccttgctcagtgataccttctgactggctgcccttgaattactgcagaaccttgatacatacacttattcttccaccagaccctagaatgtactgttctctctgctcagagcatccatcctcccaatcacttcgctcatcacattcttcaagaaccagctgagacttttctctactgggagactcctgatccctctgtggctggtcaccccccaatatgtccttcaatcacagtgatcatcaccctgcactgtttccatttttctttttgtctttccagctccattcctcagactcagcatcttgaggaaaggcactaggtcttatatatcatttaatctaactttctagtccagtgcctagctgaacacatagtaaatatataaatatttgctgaaagaatgagccattcaataattaactaaagcaatagatctaaggattcctaatgatttcatgaatggactttgcggaaggtaaaaatccctttaagtgaggtgcaaaattttgaatgctcgtacatttttgggagagataatccatagtctatgtcaaattcttaaaagggtttgtaaaggagatgaattttaagaattattgaataaatgtggtgactgatgtaagtcaacacattccacgatgtcttctagcccaattacctatttcattaaaactaaattacactcataggctgattgtaagacttgtcattattttaggcaacactaagaaaagatgtaaaaagctcgacacagctaaagtgatcaattgtaagacacatctcactttcagagaggatgaaaaatgagaaatgatcaaatatggtatcctgttttgtgtcctatctttcctttcagaggtccctgagatgacatggtaagataattggagcaatatccctcagtgcaattcaaccaaatggacaatcccagctatgccatgtgccactagtgagatgctgggcaagtctccttgcatctctgagcctcagtttcctcatgggctgaatggagagaactatgcttgccccacagagtaactggatggcttaaccaagagagtaacctggcttttagaaggctttgggaagctgccctgtcccttataccaggccatatacatagaacaagacctcacctaactgaaatctttagtaatgtgagagtattgggaaattaattattctgcctgaggtctcccagatttgccacctattgtcataatttttgagaaatgcctatttacctgccattttgggtacggtacctgtcattgggttcaagatgatgaggttttcggttctgcccctgccccttgtgaccattttactctgtgttcattgcatgtgcattgctgttcattgtgaaaatatggagataattcataaagtttcatcttgcttttcacaagaaattgatatcttcatggtgacaaattcttttggattgtttgcattgcccactctacacagccctgcacaggaaaaaagggcttcctgttgtccccttgtccttcctgagctcctgagtggactctctgctgagatatttattaaatactgagacattcctcctgactctcatggcagcaagagctaaaatctcagaccacaaagacagtttatctgctgggatggtgttgatgtgtatcccaagatggactaaaatattaatatacttcctccccccacccccaccctcttccctgtgtttagtattctttttgcagatgttaaaggatttaccaacctctccacgaccttgtctgctcaggagctggtcaggatgctcaacgagctctttgccagatttgatcgactggcccatgtgagttgaatttaatttcctcctcgtcttttgcaggagtgagggactgcatatggaataaggaaagagaaggattcagccttcttccccaatgtcattaccattctgcatcctgtccctaggcatggaccctgaccctctcacattctggggactgatgttagctatttacaggtctcatgcaggaggtttgtcagattaattttctcaattgagagacggctggttgagtgacaatcaaaccccagtcctttttatctgctttccacgcccctatcattgcttccccttgcacgtggccaggtgccatccagctgcagcttcagtgctcatgcatgcagtaatgatggcctgcagtttcccagccaaccctggccatctgggatgaattagcatgttctcaaaaaccagtaatctgctgggccatcccaccaccatcttgatcaacctaacttaagagctttgtttttagccaacaagacagtaccttcattttccagctgtcttgatcagagctaagctagaaaacagattaaaggagatggacatttgctatcaaaacacagattcatagtcctaaagccacttgagttacgaagtaatatcattatcacgctgtacttcagagtgggctttgggttcaaatagacatcttaatttcctgctgtgtaaagtgtgtatgttagtgccaacttcacagagctgtaatgagaattaaataagaccacatcggtgggagttcatttttagagcatcaaaatgtcctctgttaaggctgcctcactctatgggaaatacattaatacttgcatttaagcacctactaggtattgtacatgctgctatgtgttaggaatatgagaatgatgaaaacacacctcctcccttcctggaattaagtctagttaggtattcattaataggtaaggaatgtaaaatgtgccrtgtgttatgaggaaggtaagtctgggggccatggaaacacagaggtaacacatgacctttagatgagagaagacttcttgaagaaagtgactcttaagctgagtcttaaaaatgatataaataatacaatagaatactgttcagcaataaaaataggattatccactcttacgtgcaacaccaatgaatctcaagtgcagtatgccaagtgaaagaaaccagatacaaaatgctaggtattttatgactccatttacaagacatcctataaaaggtacaattacagaggcagaaaacagataagtagctgcaaggagggctgggaatggagtaagcatatggatagcaatggagcatggggtggggtgatttgggggattacatagctgatttatatttttattatggtggttgttttattattacagttttgtagagagagggcatgaagccccacagtcagacagacatgggtttgaatttgtcaagaaggtgattttattatacataatttatacactaattagcaaggcaaagaaatcagagcaggatattttatgcagaggagaaaacaagcataaagatgttactctgtatttgtgaagaaaccagaagagattgctagaggataaagtgcagggtaggaagtggtggagatgaggctagaaagacaggcagggacttgtcaagcaaccttagtataaatttcagctactgaacagctactagctaggagactgacgggggcggaggaggaagtggaaactgagggatcctcctaataggagggttggttttagctggagggctagggactgggggaaaacatgtataccatttccttttattgttgcatcagtggtggttggtatcagttacacatagctattccatttcctattatggttctgatattttttatcaaagatgccaagatgaacaaaaacggccatccaaaggccattggcagatgtgattaaggtgcatttctggtgtcacagtaaaccctgctgacccagagaaagagaaagggtactttttcaggtactgcgcaagactgaaaagacaaaaccagtccttcccctcaggatgctcagaatctggcaagggaaaatcacatgtgaatrcatagcagcctccacggagagggcaggaagaccaggcttccagggtgctgtgtgtctgacgagaagaggccatcctagggaacttcaaccttatctacagtttcatttttactaggacaatatattcacgtactacttacgtgattacaattagataaaatactataaagttttttgggatttctaactttttagaaaagtacactgatagcactaatgtttttgctttgagagtctttttcatttgtattgagtttttctgcttattaaagttatacatgttcattacataaaattcaaacatcaaagatgtacacaatgcaaagtatacatccctgtgattctaccctgtgaacaatataaccatctttgataatttggtgcattcatctcctaatttttgtctattgtctgtatgtgcagtttcataaactcttgggaattttccaagattttgataatgtcaaagtcatcaagacaagaggaaaggattgcaataaggccaactcaataaaattttcaagaagatcctcaccctactttatttttctttttgaatatktttttccaaagyagkctgtcttcctttatgtgatcttttcaaggtagtttctggtacaaataagttattcagatattactgtcaagtcatctgacagctcatagtatttgatcagaaaaatgtgtctgcaaattgacagaccttgacagataagaatccaggcctttaatgtattatatatattacatacattttatttttttgtataaaataattttatataatatatatgcgtatatacaaccatgtatttgggatccaaagagttycaaggaggctaccagctccacattttgttggaagaataacaaaccctggacgtgaacatcatcacatcattatccaatgtctgcctcagaygagtaataaactattttacacaatctccttctaaaacacacttttgtcaggagacctaccattctggactttgccataattcctgcagttttgccaagagagagcatggagccccacaatcagacaaacatgggtttgaattcttcttctgcctcttacttgccgtgtggcctttccctcaagcctgctgttcccatccgtaagatgacacgtgacttagaaagtggtcctgaagactgagataggtgtaatgcatttagtacattgcctggcacatagtacatgctcaatgactattagctcctgtccccacttagatttttkccaaagtgctttcacctctgttttcagggaaagatcacagattcagagttggtgagggtgacatccagcccaggttgttactgttagctagctcctctgtagcacaggaagcttcccctctctccactgagatttctgtatctgtaaaacagacgtgactttacctgctctgccatgttcagagttttattgtgaagctcaacgaaaaaagataaggagcagcatgttgaacattgagaaggctacttccaggtgtcagttgtcattgtcattgttaagtaatggccaagcttactctgttgtgtattaaggacaagatagattattttggcacttgtcacatatgaggaattgaaacccacatacagtggcttcagtgtcttatccaaggtcaaacagctggtaaatttctctggaatgcagatgtcagattcttagaccaaagtaatttttgttatgcccctttccctcatccctccctgtagcaaacaggcaacaggccaatccatgcatctgattttgatggtaccaggctttctttcgcataagtctctcataccaacccgatgccccaaaagaccatttgcagatgaagtcaccaatccctgccttccagtctcagtgttcggatctgcaaaatcagagtaagattttggaacactggttctcaaattctccttcatacacaaaaattggaaattttaaacttggcatgagattttaaaaatgataaaagcaatgtagtgagttttcataatgttaaatttatttaggtaaaaagaaaaccttgcctttattctgaagatatgtctttccagtagttctggtgttaaaaatatatttgcttttataagtgatggggatagtagatagtatttgggttgctgtttttggtgtttgttgatggattgttcatactttcttgacaaaaaaaaaaaatgtaccctacaacatctctaaaccctctgatttctttttccataacagtcccactgactccacaaatctgggcactgctagcaccaaagaacaagaaactttctaagttccattctgatcctgacaccctcaaggtcttagaagaaacaactgaaggccttaagcttcttttatttaatgaatcagacctaattgtcagctgtgttgcaaaattagctgcattgaagcagccaatagacaggagcccagatcccctaaaaataatcctgggatggctgtacatgctgtcagagttctgaagattgcatctgggcccatttgggaaggttgacaaggctccagaaatctgacgggaaagtaccagagacagttctgattctcttttccctgtctaatatttgtttttcttgggatagtatatttacttatccattacccaaacataatgtccaactcctggtgagattgggaaaccaacacagtgctttacagcttgctactacaagggcatcaacagtactgttggtctctcagtgggtactttttatcaataactccccttctccagctctggggccctccttttcccacacagccatagaaccataagcctctaggacttcagatctagaaggcatctcagaggtcattcagccccaacaagctgcccaaggaaaccaagaggatatgtcacttgtccatgatgaaaaacagatatgtgaaggagctaggcctggagtccaactcttcctcatagaaagaggcaatattaattgagtgccccatctgccaggccctgtactgagctttcacttgcaccatctcacttaaccctcatagtggcacaaggggacaggccctatgattatccccatttgatagatgaggcacctgaaggccagaggttaggtagtttacccaaagactcacagaaaagacagaggcagtatctgagatttgatcctgtgcagtgtgactcgtaaaccagtgcccttggctccccatgctatactaccttaagttctctttctactagaacctataacatctagctgcttcctatccaatataaaagcatgcattattttcttaatgcttgttgttctttgaaattttgtaagagttgtgtctttaagattgggaatccaccaaactaacaactacttctcaccggtgaaatggagatawaaaacaacccaccttagagggttgttgtgaggattaactctgttttatttatagtgcataataggagctattattagtcatctttgggttagggacaatgtttgccttattataggtgcccaattgatttttaattttttcaatgaacaaacatataaattaataaacgaataaaaggatatataagaagacttagttcctcctcataaagtgcaaatgtccttgctggaaaggaactttatagagttgaagtaataggaattcctaagtgatgtacatttttaagtgcttactattaagctaaagactgatgaaagctgttaattcacagctgtttttgagaagagagacattgcttggggctgaatttgtaggagatactatgagcactctgtcaggcctgaccaagtgacaggtgtgcagaccatagagctagtatatagcaaagcttggatataaccatgtagcttttgagctcaaaacctaatttctttatgattccattccacctctgggtccttcaaacccccatttaggttacacctcaaatattttagaaagacaggtagaagtatatttcaaaggyaggttctccttaccccaagttgcagaccacctaaccctgctygcctctttctcaagcctttctgaagaactgatccttctgctgacatagacctttccctcttatcctgttccttccaggagcatcactgccttcgtattaaaatcctgggggactgctactactgcgtgtctggacttcctgagccccgccaggaccatgcccactgctgtgttgaaatgggtctcagcatgatcaaaaccatcaggtaatttgtgatccccatcatgttacctgggtcttcaatgtgcacgatcacaggccacttcacctaccctttgtggtaaatcatatgtatggtgaaaggcagaaccttttgacttatttcacaaaaactgtgtgccccttagttctcccatataaaccaatgaacctgttagcatcattgttttctaagtttacctcacttttaattatttgtgctacaagtttgtattacaaatgcccttgtggagatgcagcaaggaacaagatgagcatagtccttaccttcagggatgttacagtgcagagagagagatgaatgaaagaatgaatgaatgaataaaaaatttcaatgcagaacaataagctttgtgataaatcaaatccaagtgcttggggaaaatagaggaggaagttaattcaacgtaggatgttggggaaggctttccggaatagaaatgtctaagctgttgactgaaaggtgggtggacattgacaggatcttggaagtggaggggagagttttcaagagaggatggacatgtacagaaaccaggatgtgctgcaatggctactgtgaagcctggggtggaaagagtagtgacagatggactgtaggctggcagcagccagagcccatatgaccttctcagtcatgttaagaggttgcactttatcctatggccaataggaaattactagaaggctgccaccagggttggcytcatggatgtgtggcaagtgcttttggttttattcagcatatctgacaaacagatgatggatcaagggggaaggaattattggggttgaggactctggaactaggctgtgtgtggctttcagacagaatcttagtattgtcagcactccccttgaggtccaaactggttgcagagcctctaagtgtcacgtcctcacaaagccacagcaaaagcagtaacaagaggatgcataggcagaaatacacacacacacacacacacacacacacacacacacatgtcagtgcttgggtgactaacaccctcaaaaactcagacttaattgatctagggaagaccatgggctgtttgtaagcttcttccatgagacaaaggtacagccagccttgaaaaccactgtctttagagagattttaaaggtggaatcagagcataccatggaaaaatcagtataatagagagtttctcaaaatgtagcttcacagatatgaacttttcacatgaagttttcccacctgcagtaaaagatatttccacagacaacccagttttcacaaaggaaacaaactagcaaacgtcatattctcccagaagctaccatgaggaaaaaccacgtttggttgaaagaaggcagtgggcaataggcgtacagcctctaaatgaaagctgtgtagcaaagatggtcactcaacagtcttcaagtggagtgctgtctgtaaactgcagggcctttgctgtcttctgcaaacagttgagtagggtgtgcagttgctgtagcacattgtcttgcaaaaaggagcagcaggaactcaccagaccaggcacagggaggtggactgtcaggagggacacagaggtcatggttctgggtgtcttaacgtcaaaatttgggattctttccttgtctgggtagcatcatatttttattctttcagaagagaaggaatctgaggagcaggagacaaaagcactctaaaaaccttctttctccctttacgccatctcttaatagaattttaagcattatctggccaagctttcctgccctacattaggctaccgccccagactacattaggctgggctggccagcttgrtgatcaaagtggatccagagtaattctgcatgcatccaagcctcttcgaagacagctggattaccattccagcacagggcaaagagactaggaatttccaaaatctttttagtacctttccatcagcagaaggcatgtgtccatagtgacagcagcctacctctggaaaggcacatgtagagctttatcatatctcaagaaaaatatccagttgtcacagtcttcttatgtcattgatcctatggaaagaaaaaattttgagtaacaatttcagaggccttatgcctcatttaagggatttatctgaaagtctcccataaagccaaaaaaatggaatcgggagatgtacaagtgggatgagaatttatggtacttttctgtgaagtgtatgatggaaaccaaaccctttactgtccctaataccaagtaggtaggtagataaagagacccaagatgtcctctctactatctccctgtcttctgtagagatgcggaagtactccactttaggaactatggagagaggaatctatgggttccaacacagagttcccttttgtttgggttttggttaatggaaaaggctgcagatgttttttaactgctaatttggacacttgagagtttttccctgaaaactaggatgaattgtaataatactttaactggtgtaaagggggacaatgggactgcgatatggttcggatttgtgttcccacccaaatctcatgtcaaattgtaatcctcagtgttggaggaggggcctaatgggaggtaattggatcatgggggtggatttccccattgctgttgtcatgatagtgagtgagttctcatgagagctggttgtttataagtgtgtagcacctccttctttgctctcttcctccttctctgttatgtaagatgtgcctgcttcccctttaccttctgccatgattgtaagtttcctgtggcctcgcagccatgcttcctgtacagcccgtggaactacttgttaattaaaccttttttctttataaattacccagtctcaggtagttctttatagcaatgcaagaacagactaacacagactgacacccagaagatcagagatctctacaactaattaggtgtgtgagccttattctgtcaatcagtaaacccatcaacaaatgtttattgagctccactatgtgtcaggaactgggctaagccctagaaatacagtgataaacatgtcacctggaggtctttgtacatgggtgtcctttaggggaacaattaaatttattgcctacaaaatgaaaaaatcagatcagacaactttgaagtctccaccagttctgaaaatctgtgatttatagccacataaacatcagagtttaagcagcaaaactttctacagactttccataaggatttgtatcttagccttaagtaaaagatatgttacagagataacattggaaaataaatgagcatctataatcaaatactttaagatacttagagcattattatttctctttctggagaggaccttattcttcctgatcattttattgaatttaagatctcctttctggagttttgaaattgaacagtgagaaatgattcaaagtctttttcaaactgtatgaatcaaaatctgttgatatccaaacaactccttgattctaatctaagtaacatgaggtccagtattaattattctagttagcaagaaagcatgctaaaaaggaattaataggagccctggaattagataaaccttggttgcaattggctcagacttctatagtttccagtcttactgccaaatatttcactctgaggaatggctggtgaacaatatttgcaccttaatgtgtttagaagaaaatgccagttacatagctttatcaaaaagttaataatcttaaccaattactgcttacacaagatggaattttttattcagctgcaaagttgcttgttccaatttgaaaacttgatagaagccataaagactggaaatgttcataatattatattgcatatatcataatgttatakgttaatawamcatttgtttactggtgtccccaratttcgtgttgaccctctttatttgctgtcagaaatggacccctgtttgaggttttgtctttccctttcagcagctctccttgtccctatttctggcattttctcaaagttaggataccatcaatccccagagtgcagaaagacaacaaggggccagtgctctgttggtaagatggcatttggatttttagtcactgtacctaacaactccaataatttccttgtttaggtgagatctataatttttgtgcaaatggcaaaccaacactcaaaatgaccctagtctcttactcactgatcattccaaacatgtgatagaaatcctctacaaccatagatatgggtaggatagggtgccaatatcacgaaaggccagggtcgtccactgctagttagtgcattggcaggtttcaaagagggtgaggagtagtaaagccagttaatgaaataggactctcttgtgattattctctaacagaaacatcaatttgagcaagtattcatatgtgaaaatagcttcaaaagagctaaggaaatcaggtgagatgtcataatactcagctgtagcacaataataataaaaggcacattaaatgragtaggcaggacaaatttatattatattacccatatcatccttcccccatcccaagcagcacagtgcagaaaaatataccatccatttggggaaaagagaaggaagtgggcataggactttgacttggaccccaacactgggcctgccacagtaaaacccagcactaggcagaccctcatgatcccatataccaggctggtacccacagactaagcctctacacaygccccgatggcagataggaccacacagctcaaggctacaggcttgcttggccagtctgatctcaggcacacaccactattaggttgacattagtggacctgggctctggacatcccttagcaatgggaaagcctcagtggtcctaggcttctggcccacccagaagtaatacccatgtagtagataccatgtttctagcaatgtcactctggctgcagctgccccaggcttctggcatgccccagtaccacacctgccgtagtgctttcccaggaaaatccagtctgtgaagactataataaggacttacttattcaactgagcagggattgaggcacaatgatgaaggtcaaaaatcatcagggaaacatgacatcactaagagataaaataaggtaccagtgactgaacctaaagaaatgaagatgtgtgaactacctgccaaatatttcaaaataactattttaaggaatcccagcaaacatgaagaaaatgcaaaaaaaaattaataaaatgaggaaaataataagtgaccagaacaagaaacttaatggagtgattgaaaataatttttaaaaagaaatctggagccaaaaaatataataaccaaaatgaaaactgcaatagagaacatcaacagcagaatttctcaggcagaagaaagaaattgtgaacaccaacacaggttatttgaaaatatacagtcaaagaagaaaaaagaataaagaagtataaagaaagcttacaagatttataggacaacatcaaaagagcaaatattcaagtcatgggggctttagaaggagaaaaataagataaaggggtagaaagcttatttaaacaaatagtagcaggaaacattccaaacttggaaaaaggtgtaaatatccaggtacatgaaagtcaaagatctccaatcagattcaacccaaataagaatagccaaagaaacataataatcaaactattaaaatcaaagacaaaaagaagatcctgaaagcaacaacaacaataagaagcaaataccatatataggagtcccaatatggttaacatcagaatcctcagcagaaaccttacaggctaggagaaagtgggagacatattcaaagtgctgaagggaaatgagaaacctgccagacaaaaatactatacctagcaaaactgtcctttagaaatgaagggagattaagacttttccagacaaacaaaagctgagggaattcatcaccaccagacttgtcttataagaaacgctaaaggaagttctagctgaaagaaaaggatgctaatgagtatcataaaaacatttgaaagtacaactcactggtaaaaataagtacaaagtaaaattcagaatattctaatattatagtaatacaggatttatgggacaactccaaaagagcaaatattcaagtcctgtgggttttagaaggagaacagaaagataaaagggtagaaagcttattttaaaaaatagtagcagaaaacttttcaaacttggaaaaagatgtaaattacttatatctttgtaatgtaggataaaaaaacaaaactactacaaatgataatacccacattaatttgttaagaaatatacaatattaaaatgtaaatattgatataaaaatagaaaatgctggagagaagtggattaaaaatatacagtagggtgtgtgtgtgtgaccaaagttaagttgccatcagcttaaaataacctgttatgaatatgagatgtttttgtaagcctcatggtaaccacaaagcaaaaacctatagtaaatacacaaaaaatagaagcaagaggctgggcgcggtggctcacacctgtaatcccagcactttgggaggctgaggtgggtggatcgtgaggtcaggggatcgacaccatcctggttaacacggtgaaaccctgtctctaccaaaaatacaaaaaattagccaggcttsgtggcaggtgcctgtagtcccagctacttgagaggctgaggcaggagaatggygtgaacttgggatatggagcttgcagtgagctgagattgtgccactgcactccagcctgggtgacagaacgagactccatctcaaaaaaaaaaaaaatgtagaagaaggaatccaaatataacactagtgaaaatcacttaacctcagaggaagacaaaaggaaaggaagaagtaacacaagatctacaaaacaactagaaaacaattaacaagtctctacatgtaatgtaaatgcattaaattctagaatcaaaaaatgtagagtgccttaatggatgaaaaacaagactcaactatatgctgcttacaaaggctcactttacctgtaggacacacatagattgaaagtgaaggatagaaaaggtattacctgcaaataaaaaacaaaagaaagcaggaatacctatacttatgcaagataaaatacactttacattaataactatgaaaatgaacaaagaaagtcattatgtaatgataaagggatgattcagcaagtggatataacattgtaaatttatctgcacccaacatcaaagtacctaaaaatacaaggcaaatattaatagatatgaagggaaagataatactatattataactatagtagaggacttcaacatcccagtttcagcagtacacagattatccacataggaaatcaataaggaaacatcagacttaagctatcctctcaaataagtggacctaatagacatatatagaacatttcattcaatagctgcagaatatacattattctcaatttcacatgaaagattctcgaggatagctcatatgttaggacataaacaaatcttaacaaatttaagaagattcaaatcatataaagtatattttctgaccacaagggtataacactagaaattaataacaggaggaacttcacaaaattcacaamtacattgaaattaaacaacatgctcctggacaaccaatggatcaatgaaggaacttaaaggaaaattttaaaatttcttgagacaaaattggaaaacaacaaacttatgggatacagcaaaggcagttatataagggaagtttacaataataaacacctgcatcaaaaaagaggatctcaaataaacaacctaacattgcacctcaagggactagaaaaacaagaacaaactaagtccaaagttagtagaagaaagaaaataataaaaatcaggacagaaatagactagaaaaaataaacaaaaccaagagttgattttttttgaaaagataaagttgaaagacctattgctggactaattaagaaaaaaacaaataaaataaaatgaayaaattcatttgatgcatgcaatctaccagaactgaattatgaagaaatagaaaatcttaatagaccaatagcaagtaaggagattgagtcagtaatacaaagtctctcatctaaaaaaaggcccaggacctgatggtttcactgtgaattctatcaaaatttaaagaagaatatcaattcttttcaaactcttccaaaaaattgaagagggaaaactgtttccaccctcattttatgaggctagcatcatccagagaccaaagccagacaaagacactagaaaaaagaaaattacagaatattcctgattaattacaaaaatattcctgattttattcctgataaagaaaaatatgcaataaaattctagaaaaacaaattcaacagcacattaaagggatcattcaccatgctcaagtaggattcatcccaggatgcatggatggttcaacatacatggatcaataactgtgatacatcacaatgacagaataaaggacaaaaccacatgatcatttcaatagatgcagaaaaagcatttgaaaaaatccaacatcctttcatgatgaaaattctcaattaattagagaaagaatgtacctcaaaataataaaggccatgtatatgacaaacccagggctaatatcatactcaataagaaaaagttaggccaagtgcagcagctcacacctgtaatcccaacacattgtgaggccaaggtgggaggatagcttgaggtcaggagtatgagactagcctgagcaataatagaaagatctcatttccacaaaatatttaaaaattatgtgggtgtggttgcacatgcctatagtcctagctacttgggaggctgaggagggaagatcacttgagcccaggaatttgaggttgctgtgttagcaccactgtattctcttcggcagccacaggtgactgctttggttcttcaaattgacctcccccaagctggacatagtggcactggtaatcccgtaactactcagagggctgaggtgggaggagtccttgagaccaggagtttcaggctgcagtgagttatgattgtgccactgcacaccagcctgggcaacagagcaggccctgtcattaaaacaaattttttaaacaataaaaagttgcaatcttttcctctaagatctgaaaaaagacagggatgtccactcttgccacttctattcaatataggtactggaggtcccagctagagcggtcaaacaagagaaagaattaaaaggcatctaaattggaaaggaacaagttaaattgtttctgtttgcagatgacatgattttatatagagaaaaccctaaagactccaccaaaaaaaaaatggttagaattaaacaaatttagtaaagttgcaggatataaaatccacatacaaaaataagtagcatttctatatattaacagcaaactatctgaaaaactaaaaactttctgcataacgaaagaaacgattaagatagtgaacctaaactacagaatgggagaaaatacttgtaaactatacttctgatgaaaggttaaaatccaaaatatataagaaattccaacaactcaatagcaagaaaatcaatcacctgattttaaaatgggcaaaggacctgaatatacatttctcaaaagaaggtatacaagccaacaggtatattttttaaaaagttaaacatcactaatcatcagggaaatgcaaataaaaaccacaatgagatatcacttcacacctattagaatagctgctatcaaaaagtcaagagataacaagtattgaccaggaggtggtggaaaggaaactttgaacactgccggtggaaatgtaaattaatacagtcattatttaaaacagtggcagttcttcagaaacttaaaaaatagaactaccatatgtctaataattccactactgagtagttatgcaaaggaaatgaaatctgtatgttgaagaaatatctgcattcccatgtttattgcagcattatttaccatagccaagatatgcaatcaacctgaatgtccatcaatggatgaaatggataaagaaaaatgtggtgtgtgtatatatatatatatatatatgtaatggaatactattacaccataaagaaggaaatcctggcattttcaataatatagatgaacgtggacattatgttaaaaaatataagctaagcacaggtagataaatacctcgtgatctcactcctatgtggaagctatagaagctaacccatagaagtagaggtggtgattatcagggtctaggggtggttggagtgtggttgaggagatgttaatcaaaagatacaaaatttcaattagataggagaaataaattcaaaagacctattatacatcttggtgactatagttgacaatatattttattcttgaaaaatggtaagagactggatgtcatgtgttctcaccataaaaatgataactgtgaggtaatacatgtgttaattagctagattccacaatgtatatatgtttcaaatcttcgtgtggtatgcaacaaatatatacaattttacctgtcaatgtacaaaaaataaaataaaaaatattttttaaatgcaaagtgggcaagagtcaagtcaatcaaaagtacgagtatgagggaaacctttttccctgtcatttgccttttactgagctgtttgcacagtagcmttttaaaccaagaaccaaaggtttttttttttttcctggaaacaaaggcttgaacaatgagtcatgctagctgttaagaatggcaaaagccacatgtatgtgtgcattagtgtatgtgtgtacatatgtatgtatgagtgtaaatgtatgtacctgtgtggtatatatgtgtgtgtttatatgtgtttgtatgtatgtgcatgtgtgtgtgttaagcattgaagctgaccttggtgattaccacaattctaaattaaaacaatagggttagggtacgatacgctggggctttatccctcaggcaatgaaaagtcactgactcttaaagtagggaagtgacatggtcagatctggatgtcaggaagatgactgtggagagggataactctctctccccttgacactggaatggaggagcagaggccaaagggaaggaaactggtttggggatattctcatactaatccaggggagagaagtaaggatctgaaatagagcagcagctgtgaaatagaaaggatgggatgataacacatcaaagctgagttccaagagtcacccaacagacaatatgtgacatacaaattttaattaaaccaaacatttatcatgacattaaactaattttcaattgactactccaagaattccagtcaggattccattttattaaaattataattcattgctggatgtgattgtgacaaagcttccctgaaagagtgcctattgtactgtaaggtgacatagaaaatatgctgagtgagtgggatgggttggggggcccttgacaggcagcaacagacctaccctgtttcctgcctcttcctgtaattaggtctgtaatgatgggtgggtgacttaacttatagcctccatggcctcgtctgcaaaatgaggataataagatcccaatttcaaataggaaaattcaaataggtagcatgcatgttatcactatggaaatatttttaatagaatattgcaagggaggctgagtttgggtcctggaaaatttgatgcagttgagttacagaaacctattgttttaccatggcttctattctatgcccataaaataatgatagcagtttgagtttctttttgtttgttttgttttgttttttgttttgtttttgagacagagtctcactctgctcacccgggctggagtgcagtggcgcgatcttggctcattgcaacccccacctcccggattcaagcaattctcctgcctcagcctccccagtagctgggactacaggcgcatgccaccaggcccagctaatttttttttttttttgtatttttagtagagactgggtttcactgtgtttctatctcctgaccttgtgatccacctgtctcagcctcccaaagtgctgggattacaggtgtgagccaccgtgcccggacgcttgagtttcttaaacactaactatatcccagatactgagataaatgtcttgcatgtattggctcattaagtcctcataaaaattctagaagataggcggggtgataggccaaatactgaagaactaagtatgtctgcagcatggacaaatcagactagtttagagcaacaatgagaatggatgcaaacaacaaacaatatagctagacaggtttgtcctaactaatggaaggtctggaagtgggctcctactttaccaatgagaaaattggagctgtgtagtgctggacccctattgcatccagtagggatggtackgtgtctcaggctgaagatgagacctagagacagcaaataagacatagggtttacagggggaaattacatatggggtggtctagtggtggcaccctgcacaagaagacaactaccatttgtaaaaagtatgctgtttatacagcatttttacttagtgctctctacctagcaacccccatttcatccaaagcaaagggcgtcagtccccttacagcctgtgtgccaggggaatgagccagaggtttggctgttcttcatggataagcagtggatctccatgttggccactctcagattccttagcttggaactccaaactaacgctcttcttagaccatagggtcaccctcagggtatgcttcagttatggctgtcaggtgcctctgccatacaagctaacagaggttgtataattacctccacctagatcacatgactagtcagtggcagcacaaggggaccaattctggaatcatctgacttcaaagccgtctatcttagtcatcatggtagcccacctcccaactccagatttgtgcaattgctactgatgcctgaaatttgccatcaatacycaaaggatcaacatatagtttaggagatcctacatacattggtacatttctaatactttagcagaactgatattgaaagaggaaaatgtcagtcaataaacatctaagaataacaagataataagccctaatcaaaacagcctcatagtaaattcaatccaccaaaaatacttaattttagaaacatgatattagctagatgaatggcaaaaaagagattgaatgtaattttatttccaatgaaacacttaatgtcatctcatgcatgtctgttcataaaattaaattaattaaaataggtttatataatagattctattacatagattgaaaagtggctccaggtggcttctcttcacatattctatgtctgttttggggagtcctgatcgttgagaagatgccagggctgacactgggctctgtcatatgcaatgtttattaatgatctgcaaaagttgttcttgattaatcttaatgaaaattgcagagcttggtcttttcagtgcaattgctaaaaaagtcataggaatgacagcagaatgccaagtagtaactggtttgtccccaacagttaatcagagtaaaggtcttaatccttgtggcagggtcaccctgccaagcaatatggcaggacaagaaacgaaaaacagaaattatattgtttttactgaaggcaagaatgcctaaacctgcctcccagcctcctttcctttttatttctctctttgttacattttatttttttctatttttttctgtctattccttccttcccttcgtcacttcttctccctcttttcttttctctctttctctctctctctttccctttctttatttcccccaaaaatcccttgtctcactctgttccaaaatgtcattaaattcagcactcataagcctgcttcaattagagtgatgttcagtacatggacagaaatttttatttttagcaaaattatttgtaataatgaaaattgaatatatctagaaataattgttgataaactaatattgatagaatgtttgccatgtgccaggcactatactaaataatctacctgaattacttcacaaataccaaaactctgtgaagaacaatttccaaatgaaactcaagctctgatagaataaaaacatcttctgaccaatgacacacagcttgtaagtgacatagcaaaggctctgaatcatgttcatctttattagcccgttttctgttgcttactgacagaatatttgaawcagactatgcctaaagaaagggaatttatctgcccggccaccaccccgtctgcgaggtgtacccaacagctcattgagaacgggccatgatgacaatggcggttttgtggaatagaaaggggggaaggtggggaaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttaaacagattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgtgagaaacacccaagaatgatcaattwaaaaaaaaaaaaaaaaaagaaagggaatttatttcttatagttctagaggctgagaagtccaaggctgagggaccatatctagtgagagacttactgctgctggagactcgctgtgaaagcgcaaggaggcacagggcatcttatgatgaggggttgagtgagctaatgtgctggctcaagcctcttcctctccttattaatccaccagttccactgccatgataacccactaatccattaacccatgaatccattaatctgtgaatggaatcattcattcataagggcagatcccttatgatccaatcacctcttaaaagccccctttcaatactgccacttggagactttctaatacatgaaatatgtgggacatattcaaaccacagcaccatctgatgccataaatgttcaaaggtacggaaatgattatataaattctggcatatgtaaaaaatagaaaaatgggtaacgaccaggtgcagtggctcacacctgtaatcccagcactttgggaggccaaggcaggcagatcacctgagatygggagttcgagaccagtctgaccaacatggagaaaccccatctctactaaaaatacaaaattagccaggcatggtggtgcgtgcctgtaatcccagctactagggaggctgaggcaggagaattgctggaacccgggaggcagaggttgtggtgagccaagatcatgccattgcactaccctagccggggcaataagagcaaaactctgtctcaaaaaaaaaaaaaaaaaagaaaagaaaaagaaaaatggataaccattaaacatcatggtttacattaatattcaatggcatgaaaaatgctcatgcatttaaagtatacatagtagaatacacacatacacacatgcacacatatttaaaccaacttcagcttttttaattttttatttatttttagctacccctgctggaatgggaacctccacttcttaatacatctatttttataaaaagaaakgacataaagctctgtgatgaaattgagtagttttaattttcttctttattctttactatattttttaatatttgggaataatcatgtataactaatagaactagaaaagaaaatgttatttcaaaaaggaaaagtattgacaggtagagatgacaggaaggtgtttgtgttagggttctctggagaaacagaaccaacagggtgtgtattacttataaaaatttgttttaagaaattggttcacaaaattgtggaggctagttaagtctaaaatctgcagggtggaccagcaggctggagatccagggaagagttgatattgtagcttgagtccaaaagcaggctggattcagaatttcatcttccttggggaacagcagtaatttttctcttaaggccttcaactgtgtaaagcccacacacattgtggagggtaatctgatttactcagtctactgatttaaatgttcatctcacctaaaaaaacaccttcccagcaacatctagcctggtgtttgaccaaatatctggatacaaaggcctaaccaaattgacacataaaattaaaaatcacagtgttcctccctcccttaggcaataacatctgcaaaagctcagagttagaatatatggagatgagtcagggtgactatcaaaatgtattaatggyaaaaaccgcaattacttttgcaccaacttagtaatagtaaaaacactttcacttcattggataagtggcagagcctttagaggtttgtgggcaggggagtctagtgtgaccacagctgtctttccctttgaaataccaggagccccacatgcggtggagccatattccattagcatccttggatcacggtgtttttggttctaaatggaaggctcctcacagtgtccctggcacactgtttgtctgttgcttactgtcttcatgtaacacagttctcactctaacccagtgacacttctgggaagaggccacgtgatataataggaaatgcttaggatttagaattcaggagaacttggtttacattctacttctaagaatcttttttttttttttttttttttttaagaaacggagtctcgttctgtcacccaggctaaagcacagtggtgcaatcatagctcactgcagcctggaaatcctgggctcaggggatcttcccacctcagccttccaagtagccgggattataggcaaatgccactgcaccaggccctgcttccaagaattttaaacatgctgaatctcagtttcttcctgaggaaatggggataataatgtggaaggccacaccataaggactaatccaggtttgaatactggaggatagttgaagtgacttcagctcattgccacaacagaaacaagcaagacacaaagcacagaggagtaagggcacaggaagtgggctgggctgtggtgtccctctctgttccatacagagggaagtgaattgcagtggtctcagctgcccctaggaggagaaaactacccagtcacaagccttaaaaagtgatatgcctaggtcagcccctgtctgtttgcaaaagccaactgttaaacttgcaggaattttacaagccagttgacctcaagttggaagcttgaactcatccatgacaaaaatagtgacaccacagaagttgacagacatcacaaatcaggaccttttcttcccaaagagacagttgttaaacatttacccacccaaccctcaagctctgcacccactcttctgcaggctaggagagaggccacattggcactcagagatcaacccctttacatgaaattcctgttgacacagagccatgttcttgctctcactgtatctatgtgcctacagctggcctggccatagcccatcacaacatacatcatgtgtgtggtgtgtgtgtgtgtgtgtgcgagtgtgagttaaataatgcacacaaaaatctttggccaggactccccacactctccacatgagcctgtaactgttaagtgtctgggccatgttaaaaaacagcaaaagggtagatgaagtttcgggttaaatgactctcccagtttggacatgcgatactgaccagtcccacagagctctgtttaaacagagacttctctcatggaacacctaatgggatacacactttctcttttttggagacggactgtcactctgtcgcccaggctggaatgcagtggcatgatctcggctcactgcaaccttcacctcccgggttcaagggattctcctgcctcagctactcctgagaagctgggactacaggcgtgtgccaccatgcccagctaatttttgtatttttagtagagatggggtttcatcatgttagccaggctggcgtcaaactcctgacctcaggcgatctgcccgccttggccttccaaagtgctgagattacggcatgagccaccgtgcccggccaggatacacaatttctatagcactggattagaggttgtccaatggaagggtttgattctggtttttaaaacagtgatttacaaactctttgctccatactctctaaaataatgttgaaagctacatccctcaaacagttctaagttgacatctaaaattttatccaacattgtttatttttactgacaagaaacaaaacaaataatttttaaattaattaaaatgggaataatctcttaaaatatatttcataatatagtttttttaaaaaaataggttttactccctcatttaataaatcacactgctatgggctgaattttatccccctcaaattcctgtgttgaagccctaaccacaaatataacagtatctggagatgaggcttttgggatctaattaggtttaaatgaggcttagtgcccttattagaagagaccccagagagcttgctggctctctctctccaccttgtaggggcacagtaggaaggcagccatctgcaagccaggaagagggccctcaccagaacctgatcctgctagcaccgtaatctcagacttcccagcctccagaattgtgagaaatacattcctcttgtttatgccatccagtctataaattttgttatggcagcctgagttgattaagacccacacaaaatcagagaatcataagaatatttatccctgagtattaccctatgtatcttgaaaattgtaataactccaaaaaacattccagttgtattaaaagaaacgnnnnnnnnnnnnnnnnnnnnnnnnnnnnnnnnnnnnnnnnnnnnnnnnnnnnnnnnnnnnnnnnnnnnnnnnnnnnnnnnctgcagcaggccaggctacagggccagatgtgggctgctagggaatgctgagtgcttccaggcaggtaggacagagggcacgttggaaaaggaaatgcactatacaataaggggcatcttgaaggaaggagaggaaattaacgggaataaaagaagcaccaatggtttcacccccaacacacacacacacacacacacacacacaaactccctgtgcctccctcacccctgagttagggccatttcaggaaataaattgtcctaaaaaatccagaattcagaacttcagaactcccctgagcgggatcaacaaggaaatgctgacttggcgcacagctgctgtcctgacttggtctctattgttcttctaagattccggggcaccagggcaggaagggtcagcaacgctttcatcttcaagaacaccattgctctcacttttctctccctagatccaccctgcttttgaatgtgagtgcagttaggtcttccccattacctttccactggaagggagtgcaagcagcagcaaagtatccaaacaccattcagcttggagtctggcattacctaacacccgtgtgacttaacctctctgggctccagcttccttggttgtaaaatgggaataaaccacattgatgtaagctccatgaatgcagaacttgatytgtctgtttgggtcactgcttatatctttagagttcttcaacagacacttgttgaaagaataaatggatgagctgtatatgtagcctgtggtggaaatgaggatgaaatgaggttattaaggtaaaaggcctagcacaggagaggtaataaccgcatcttaatcctctcagagcctcagtttgctcatctataaaatcaaaatttataatattgataggcatctacctttcagagtcactgtggctatcaaaatgagaacatgaattgggaagcactttgtgaaatcacaactttcatgtcagggtaagcatggtgccaagaccagctcggtcggggagaccttaacccagtggtgctagaggaattaaagacacacacacagaaatatagaggtgtgaagtgggaaatcaggagtctcacagccttcagagctgagagccccgaacagagatttacccacatatttattaacagcaatcattagcattgtttctatagatattaaattaactaaaagtatcccttgagggaaacgaagggatgggccgaattaattgcagcaggaacaygcccttaaggcacagatcgctcatgcttttgtttgtggcttaagaatgcctttaagcggtttccgccctgggtgggccaggtgttccttgccctcattcccgtaaacccacaatcttccagcttgtgcgttatggccattatggacatgttacattgctgcagagattttatttatggccagttttggggccagtttatggccagacattgaggggcttgctcccaacacacggtggctttcaaacattttaagaagcagatggaccctacgtttcatacggcaggctgacactaaagtccagcagaggcaatagaatggatcagggttgaaggaaaagttgggctycatggccaccacaatggcagtccctaccccacaatgactcctgaagtaccctcagcaaactcagatctataagaagggaggctttggagattaatctgtagagactgtgtccatatattgggctgagtcagctcagaccccagtagtccacatacttccttttgtatttccctttaaagaagccatgcagggaagtagaaatggaccaatgggttcaggcttatayacccggggtgaaattctaactagtccatcaataactgtgtgacgtaaagcaatatacctctcgtgactcagttctctyacttgtaaactggctctggtagtgatacccaggtttgttatgaagatgattccatagctgcacaaaacgccctgggcaatgaacgtagttgacctccataactaactcccttgcctttcctttgttctggaatgttcaagggcaccgttttttccaggtgactggggcccaatcaattctgcctaaattgtaaccattgttcactctgtttagaccagtttatgcctaagaactgtgccgctgatgggttggttgaagctatgtctgtgtgaatagagttgatgtaggcagagttttagcagaaaagggtaggtaaagtgatcaattcatcattttattggtctgattcaatctgtgcaattgaaaaatggtattacttccaaaagttagtactaggtactatttttgagtgttcagtatccaccaggctaagtgttttacatacattattttatgaaccaccctaacacctctacagaggaccaattctcttccccattgcacctgggaagactgagacactgagactaaagcaactagcctgacatccacaagcagtaaatggagaagtgtgatgtcagatccgggcctgctttaatgcatgttctatgcctgtgtggtgttgctggggaaatatgtgtaatttgctctagcccctacagcattgggattcctgtctaatgtatagatcaatgattgctactgaattatgcgtcctgtcattcctctagcaactcctatggattaattgtctaaaaagaaccctttgaagcatttaagttgaaagaaaaaatctaaggtccctcattttttaccttataattataacatgcttccttaatagttcagttaaaagaaataatgttgtcaatctttggtttgttaattgttgcatgatttgtccccagctagacagaggtgagcaaaaataataatgataattacgtgtgttttttatttaaaagaaattttgaatggaatctcaccatgaagaacagaaagtagatttgctctgtttgaaaggaggaggtttagggggttatcccctccccaactaggaggtcctaaggcaactcagtggtttctctgggactcttagatccatcttgggacagccaaaggcctgtgaacccagaaagccattgagctttctccattaacttgataaataactttcagcactgactatgtctgtgtgctgagctttgagctaagtgggaatggaaggtggcatccctgccctccagaatccgagtgtctagagaagaaagagaagatgcagatgtcatctatagtccttttctcttaatttgtgactgattaggcacagcaaaacatccctggggctctgctctggaagaactgaacaagacttgtcgctaggagtagaattgtctccattttagcttcaagaatgctccgaggtcctcccctcaagaactgatcttgaaatacattgtgtgtgtttgtggttctttgcaaccacagggtagccttactaatgagtatcaatgtctgtaaattattaattacttttatatagtttcattcttatctttaagtcaaatcccagacacaaaatgaaagagaaagaaaagctatgcagtaaaaaaatgtgaagtcttcttgctatgcttcttgttttgtagaggaaaataaaaatcatctaaatgtcttttcattaagatgctccagtgcattctctgtataatgttaattgcctaatgacattagcgccgtgtgctgtttagtagtctctcaccattagctggcaaagcactttaacatccattattatatccttcggggctcacaatagttctgtgtgtgaagcaatcaggtagtgccttattttacaactatggaaactcagggtcagattaaactatgtgcccaggatcacatgttcaaagagtatgggttttaaaaacacaacagtaccagtttagtcctggaatcctacttaccagctctgggccatagggaaaatcattttactttctcaggctacaattccttcataaatagtagacaagcaactagtccttattataggccaggcactgttataaactccctgcatgtgtttattcacttaatcttgacaacgttattaacattttatcgatgcagagattaaagcatctgtagggaaataaaataacttctctaagttcatgttgccagtcagtgatggaacaagatgagaacttggctgtctagcactaaagtctgtgatattaaccctcatactacagtgacaacagtgtaataaggaaaacatcaattgggactcatgattgtgccagtcaggatagtaacaaacatccctaaaatctcagtgcttaaaacagtaaacatttatttttcattcacactttatgtttatttttcattcacactttattacaggaggggggtgtgatagcaggatatcataacattttatcctgattcaaggaccctggttagaaggcttcatcaggagctccttgactcatgatggtgacacaggagagaaaaaattttaaagactgtggttgatcatggtcttaaagcttctgcccagaagtgacacatattacctctgctcatatttcattggtcaaaagtaacatcaatatccagacaaacatcacatgtttgcacttatttgcagaatctaaaaatcaaaacaattgaactcatggacatagagagtagaatgatggttaccagaggctgggaagggtagtggggggttaggagggaggtggggatggttaatgggtagaaaaaaatagaaaaaagaaataaaacttattatttgatagcccaacagactatagtcaataataacttgattgtacattttaaaatagctaaaagagtgtaattggattgtttgcaactcaaaggataaatgcttgagggaatggataccccattctccatgatgtgattatttcacattgcatgcctcaaaacacctcatgtaccccataaatatatacacctactatgtattcacaaaaattaaaaattaaaaaattatgcagggaggacaatcctactatacacttgaatagtatagtagtgggcatggctgtggatagcacaaatgactcctctcaatgacctcctgcacagaagctcactggaaaagtgcctcagaaactgatgtgctcctctcaaaggctggattccatttcttctcttgccttgtcaattttttttaaatggctcctacagttttcattrtcagtagatataaagtaccatatgctttttaacttgggagttaaagtaaaaacaatgacccagaaaccaggaacttcaccaagatcaagaaaaacctcatccattagttacaagcatttcttctaatgttcacaggttgcctgcctaatgtctaatttattacaatatttccatattctcaacccaattcaactttactttcttatgtaaatagctttgcattaccttacaatttaagaacagagactgcaaagattcaattgagtacatggaatcattcattcattctttatttatttttttcttttaaaaaaggacactgcatgtcttaagtcctactgtatggaaagcaggatgctccaggctgtgaggaatgtaaggctgcctcaggcaggaataatgccttcgaggaccttatactctttaccaaaaagcttggatatatatgaacattaatagaaagtattggacacccaggcatccacccatccacctactcagtaaacacctgctaagtgttaaccacgtgccagatacagtacaatcttaagaggggaacatacagagtagttgttcaaagtccccattctcaattagtttacaggagacagattattataacacagcaccctaattactgttcacccaggatgcaatgagaacacagggaagggtacatagtcagacttggaaatcagggcagcttactggccagagttaaaccaagcttcactctaaaagatggagtagaagctcttccattgaaagaggtaatggacattccagattgaggaagcaccatggtcccagagaggaaagaaggaacacaaggttcagacaatgacttgttgtttggatggctggagtctaatgtgtgcatgaggaatgagaagaataactaagrcactggacagatcatgaggaattttgtgtgccagactaggaattttccattgtatcttatagaccagtagtatctaaatattttgatcccctatttttattaataaaattatatgaagatatgcatatctaataaaattatatttattaactattctattaattatatttaattatattcatatgtttaaaaatatataccataaaatatacataatatagggattttaaaggataatgagaaaataaaaatactttaaagtattttaatttacagtatccaatttaatttaaatattttaatttgattacaawtttaaaawatyttaaattaattacaatttaatttagacttttctgctttcaccatttattagagagcaatgggtttaaacataattctttttaaaaaaaatttttaatagtttgtgatatagtaatgtaaaggtcaggttttaagttcaatttatctctataccaggcttcagtggctatcagagctaaacatatatcttataaatgttttccaatctcataaatggatttaagcccttataaatgggttctgacctcatcagaaatcttcatttagaagatatttaaacattagtaaatgtgcagctctaagaattttgatagatgatataacataactttggttttacaacaaaattcttaaaaagatggaaacatttccaaacttccattctcaaaatgctttcttcagagcatcaatttctttaaaaatcagttactttcttgctcattcttaagtcatcatcttgagttggaagaaayaaattaagcaagtttgtgtgtttttttcaaatatatgctagaaggaatattaatggcgacttattatcacaaaaatatcagcaaatttggaacacttgtcttctgtcaaagacaaatgaatagctcacytttaagtctgacaactcttttaagcattttgaagtcacataatcattgcatttggggggcaatgaaggtttttctagtaattctactacaaagtattatcttctaccatttgattttctgcataaatgacatcatttaatcataaactaaaattgttcaaaatactctgaaagaaagaaygctcatgactacaggaaatcatccaatggtagaaattcttctgtcttctcaagatgcctcctccatacttacagtcagaggatgaccagacatgtatcccctaagtttccaatatcaatctatatatcaaatgttggtaaagcttttcaacataagtaacaaaagctgtgaatggaagttctaacattttcctcctgcatctcaacggatgacccagttcagccctgggatgtaaacactctatttcagagaccacagctctaagtagtaggtcagaaaagagtgatggggtaatgaggtcacatttgtgtttagaaggagcagctggaaaccatgacagtatgggctggaaggaggtaaggctgaggcagggatcccagactcaggcatgatggtggtctgaactaagtcacagaagggctagaaagaaggaaacagttgacattttggttggaaatggaatgtgtaatgaagtatgaaatcaataatctatctcaggttaatgttgggtagaaaaagatgctggtgccattccctragacagaggttacasagcaggttttggaggaaggtttcaaagagcccttaaaagtacagataaaaggctaaggatgttcagagactctttctagttattaaagaacctaagaaggcttcatggaaggggtgacattgaaagtgaagaggtggacgggcgtggtggctcacrcctgtaatcccagcactttgcaaggccgaggcgggaggatcacgaggtcaggagatcgagaccatcaaggctgaggcagragaatagcgtgaacccgggaggcagaggttgcagctccattgcactccagcctgggmgacagagyraaactccgtctcaaaaaaaaaaaaaaagaaaagaaagtgcagagccaacgatgcccactctggtcttatacatgtgtctctccatttacctatgtcaacaggtatgtgcggtcaaggacaaaacacgatgttgacatgaggattggaatccactccggctcggtgctgtgcggtgttttgggactamggaagtggcagtttgatgtctggtcttgggatgtggatattgcaaacaaactcgaatctggaggaatcccygggtaagataaagcaaagcccttttcatgcttaacggttgtcattggcttattttgtgacagtgggtttcctgtgtacagaaattcagggttagatctaggaagcaattatttggaaggagaccagacactgaaacatcatacaactattagcttccaaaatctagtaaaatgcatcagaggcaayaaggatgtggaataacactgaggtgttcgggtctctgccctgcacagcattggtccttagacttggctgcacattcgaatctccaaaggaacatttaaaaaatactagtgtccagaccccatgccagtttatttaaagcagaatctgtgcagaatctattttaagttcttcagtgaattgtaatgggcagccaggattaagacctactgactttccatgcatgatctaggactcagtgaggaaatcaggctcttccttagaaactcaacatttcaaatttggctgtcaaggttggttgacataggatccccaaaggtgctagtggtctgcaaaggccactgcaactaatgtaagtcttgaaaagttgtatcaagattctgtttacacagattggacctaataagatctcagatatatgtgagccagtgtgattttctgcagcctctctttcttaaagatgatggatggatggatggatggatggatggatggatggatggagatagagaaagagagagagagagagagagagagagcacttccacatattccttttcctaccccctagaactgcccttggagtcacagatttctctggtatgtgccatcactccttgcaaactatgtttaatatcaagtaatatgttatcatgggggaaacagacaacaagaggtggaatcagagtaactaggattcccactctgccccttgctaaactctattatcttcagcaagttatgtaaagcatgcacagcacctggcgtgtgattttagtgtgaacttggcttgcatcactctacctgtgtgatctcaggccagtgcttaacttctgagtccaactttcttcactgcaggaagagagataatactacttatgatttgctaccttgtgaacttattttcctcctccatgagagtttgttctctcatctgctataatggcataatccacctcacaggtctcctctgaagattatctcaggcaatgggtatgaagcgcttttttttgtacactgtgcagggacaccccaggtcagttactattcttatggggatccttcactctatgtggtgtgtcatggctgtttgccagacaggtttagaattgaggaaggtctgatgtgtcactgctgggtttcttaaatctttccattctttaggattttcccacaagtaactacctgctgaatttagacaaacaagttagccaattcatctgtgtttccaggcctgtatcttaaaagcatcaccaaatggggaattgcccatatactcaatagattccttttgcaaaccttagaggatgctttgggggtttgtaagatactgctttgatatctggaagccagtttagctattgttctcaataacattaagaaacagaagagtgaccaagtttaaatcagcacatcaccatgcaatactacaaagccataaaaaggaatgacatcatgtcctttgcagcaacatggatgcagctgaaagaaattatcttaatttaaataatgcagaaacagaaaacccaacaccacatgttctcacttctaagtgggagctaaacattgagtacatatggacataaagacgagaatagacactggggcctgctagagggagaagggagagagtgggacaagggacgagaaactacctgttgggtagtatgttcactacctgtgtgagggttccttcttaccccgaacctcagcatcatacaatatgctttgtaacaaagctgcacatataccacctgattctaaaataaaagttgaaaaaggaaagaaacgaataaaataatttgtaaaaagaaacagaaaagtgactgagtttaaatcatctttcacacccttatttttcatatcatgagtcatgagtctgaaccgtgggtttactacttaccagttatgaagtctggaagattgtggcaagtacttcatgcccttcccagtttcttcactgtaattttggactgaaaacattatccgccttaaaaatgtagtttcaaatatgatagtgcttataaagcacgtagtctagtcttctattcagtatccatctctgcttagccatggcatgttgtcaatgtgcaaaatgcaggaatgtcaaaacgggaccccagactcaccatggtttgatattgttttatatttttccacttttttattgtcttcttctttaacaccactgagccttgggtttctagaagaacggttctcaaacctcagccttggaattacccgagagtttattaaaccatagcttgctgggccccactgccgagtttctggttcagtatgtctggcatggaactcaagatgatgctttctaccagttcctggtaggaactgctggccttagtaccacaccatgaagatcaccatttttgaacttgtgttaaatgaaataatgcatataaagtcctttgtcctgtactcagtaaatatttattgtggttgtgctggtagtagttaccatataatacagttccagggtggtagagagacgctgaaagtaaaagttcttgtctcaatccagcactgccactaaccactaatatgatttggggccaaatatgtacttgttacttctgggccagtttcagcatctgcaaaaggagacaaagaaatgtctaatacctaaggttgttgaaagaacggaaattatatgagataatccatggggcacacagtaacacctttggctactagataacatttatgcaaaacaagagttacacaattgttaggtcttaatttagtatcatgactacttttattatatcctagcattaaaatttatcagaaaatgccaagtttacttgactcatttccttagaaagaaatgcctgaaaactgacacatttccttagaaagaaatgcaatcttcagaatctcatctgcaaatgtcttaccccaaagctcaagttagtaacaaggatgaaaagaaacatctaaaacccagtttctaccaaaacatttaagtgcatattgattagcacttcagcagaagaatcagtgaaggcaaggatctctttcactagtgaaaacataatattgatttaatacatggaagtatttgtccccttgcatactgacagcagaataataaaaatagaatccagagaaatgctaaaaggggttgatatgtaacttaattatcttaaaagaaaatcaaccatggtactttagaaaaccctcctaccaggttcattttgtctaggagaaaaggtaagcttccagtcttaactcagattcatctgagaaagcggatggggacttccatttcatggaaggtcaaacgatctgttattctcccaggtcaatattattgagttcatrtgtattaacaaaatgcatcttgggaatattttgtatttattcagcacatttctcaagagagtgaaaacatctttcacacatttatttttaacatcttgcacttgaaatcaatcaagatatttatgtggaagatgtggagaacatgaagtatcagaaatgatttgtttgtagtttctggtttttcacatgttctttgcaatgaactattctttctgtaaggagggatttagcagaatgggttagaaggatgagagggagtagcagagctaatactaaaagtaaactgcattttatttaattaatgaatttatttattttttctaagacagggtctcactttgtcctccagaatgaagtgcagtggcatgatctcggctcactatagcttcaactgtctgggctcaagcgatcttcccacctcagcctctcaagtagctgggactacaggcatgcaccaccacgcccagctaacttttgtatttttttgtagagatggtgttttgtcatgttgcccaggctggtctcaaactcctgagctccagcaattcaccagtctcggcttcctcagcatgagccactacagtgcatttttaaaagccactctaaattttttttaaaaacttttctgtttacttggatatattgttcttagcattccaaaagccaatcaaaatattaagcattctttcattcaaatgaacactaaagtaaacttaggaagatgacttttgagcagaattggacagtaggarattgttagtaagcaccaaatagtacgttgaatctggagaattgccaattacttgaatagctggagagagcrtaggagagctatattagaggagtgtcagaaaatgagctttgaagtgacagagccagagaatgaaagcttggaggccttattcagaaggcctgacaatagtcttctgcaagccttgagaaggcatggaatacacaacagtaatatgatgacaatggcattttttagaatactcttaataacttacatatttgcttttatagtgtatatgttgtaccatgcactgttttgactaccttacacaaatcaactcgtagaataatcacaataatagtcagagataggtgttattatgtttcccatattatgggtaagaaaatggactgatagaaaggctaagtaatttgcccaagatctctcagctggcaagtggcagagctacggtttgaatctaggagatctagcaatgaagtccatgtttgtaaccaccttaccttgctagtctacccagaccacactataacgcaataagtagtatgattgagttagacagttacgaggacagaaaaactcttccccagaagaatttaccatgtgaaatttccatgaatcaagtttgatcctcaaggccctgatgtcatatgttattttgctaaaaaagaagcctgagtcatgagccacagtggctgacaattgtgcagccatgagtcacttcacttgtgagtgagcccagccagctgccagcctgcacatgtccacagctttgttctttgctccttataatatacatgttataggggaaattgtaccctacagtggttttcccaaaggaccctcagtgcagccctatggacttatcagaatcacccttgagaagaatatagacaagttggagaaacaagttacaaatacatgaagattgaaatgataggacaggttccaagacgaagaaagaactgtttttgcatggtgatttggataatgattgccactggggttcagaaacatttgcagcacttgtttttccaatataatcaacacgactgaaaaaaaaatcactgttttgtaaagtttgctgggatcaggctgacaatcataagaaaagccaaaagatgtgcttaggtgtggctcagaagggctgtattttatcagaggcagcagtgtctcttgggacgatgtccgtgatactgtgctcatgaatttatgcttctattttcttttattctttctactttttaggaagacaagtattgtccctgaggacatgtcctaataatacccttgtgtaacctggtgttggttttgtacaggtcaaaaaaatatagcctttgcaggcaacatcaggagygtgtaatgacctatgccttctacacacaggaggattcacatttccaaagccacgctggactgtctcaacggtgactataacrtggaagagggccatggtaaagagaggaatgaattcctgaggaagcataatatcgaaacttacttaattaagcagcctgaggacagtctgctgtccttgcctgaagatatcgtcaaggagtcagtgagctcctcagaccggagaaacagtggggccacattcactgaaggatcctggagccctgaactgccctttgataatatcgtggggaaacagaatgtaagtcctctcttcctccttctgcttggccatgaatgcatgctcgtgtgcatctccaatccagacacctcagagaaaactgattcatctttaaccttttctccaatgaacaccataattgcaaatgatcaaactatctctctgtctcctcaggacagaattaacctcgtatgcaatttcaggaaatgccagaaatgccagagggttcctaacaccctctctctctctctttttttttttttgtaacctagctaaaaataaatattatgtgaagctgaattgtaattttaccaaaaaaaaaaaaaaaccactcatgttggaaaaaataaaccctytgttattaaactaaaggggaggatcaagtacatgggaatgcccctttttcggtagctggccatcatcagttctgtgtcaccctctgagattcaaaatcaggggggcactgcwgatttggaaataggaaaggagcaccaagtgatgcctagagttagggagttcaggaggagcatgcaatttcaaagccacccacatgattctatttttatatagcatggatttgcatcttctatgaaggacagggctactaagtcagtacataaggagtagatcaccaataaccaaaattctttttaaattatttattcaaatattgaaatcacagtaaacccaatgagatgctcagactccaagaggcacttagagaactgaggctgagccaggtcgagaaccaaggtggacacagagattctgttctcccagaatgcttgcttggagccatggcaaaattacctgctctaatatggattttccctttaacctcttagacacagcacatttagttgaattcacataagttcaatgatgtgactgtactatacatttttagagaaagaaataaaaatagccaatatataacacttatctgacagttatctgacagtttctgataagatcctcgaccaagcagaagctgagagtaccatgaagtacccagccaatagtgtctggagttttatgaagacatataagggttaatttttaaattccatagacctcaacatttctcattaacttatagataagaaaaatctgtctgcctaaaaaaattttaaatggaaaggttaaaatgctgaaagtctcccctcttttttctgcatttgaaagtttgatggggcactctgagactaggctgtctttggtttctttctggatctgtgggggaaaaactatgagaaaatgcatgggccagattccactgggaaaagctgcaggttgaacctaggctgcatgccttgcaagagttgacccttaggtcttcgacagctcttttgtgagtgtttaatttcccccaaaaattattatgcmcacamaagtcataactgattgcaatgcctaggttctttccatctctgagttggtgtgcatggtacagtttgctgttttataaaataatggtgttatatacttcctggagtgggtgcatgaccagctgacagtgccctctctgctgcttttgcctattgttagcttgggtctgtatgctgattatttaaagagaaagaaatgcatgcctcatcctgaatacctcagcataaagttctctctctcagttttagtttttgttttgtctttatttttgaaaaatctctctccagttatgctgattgtaggaattaagataattccttaatgttctaatctgtattgtacatgaacttgctactaataactgagagccaagaagagggaggtggaggttcttggttttattctatagttgattgatgtggttaaaytgtataggaatgcttgaaatatttatttgctgatttcctaaagatatttcctgatgtcaccaaatacctattataagagatgtcattattagctagagattgttagtgttgtttaaccataccgtgtatttttttaatgcccaagttttgcctggatgtaacccatctgtgccatctttagcacgaaaaatctgaattcattttgatgccttcagactgaagagcaagtgaatgtgtgctgatattcatgaataaccgcgtgccaccaataatattttggaaattactgagccaattaaaaccgtcacaagtattcaatgtttgtacttatgcctaactctagaagtcagtgagccatatgtgcaattcagagacataatttgtccctggaagagatcaagactggtctggctgagcctatgctttgccaaaacacccagtcaattccacggaagccccgaccatctgagtgtttgcataacacagataaagcatgctaatgcttcactgggggtattccagctaaattggccagatgttttggcttctattcattcataatatgtgcttagaaatatgtttaatggcatcaaattgctgtgtcatattctgtgctatgtagatagcagatgttcagatagttacatcctcatgtattcattcattcaataaggattaattgagcatctattacaagccaactactgctagtaaaaaaaaaaaaaaaaaaaaaagaggagggatggggaaaaaaaatcactttagagacaaagtcagccagtggtttatattcttaatgaagatagaaattatatccgtttcacttaccacaatttagcccacaattagaacaatacctggcaaatcacagggcttgattaaagtttgttgaataagtgaattaaatgatagatatgggtagtgagggagaggaatcagtcaagtttgaattctagattttttgcttggaactgcgtsgatgatagaacttccaactaaaataagcagtactggaataggagattgtgtgaggaagactaggaattctctttgggacatgtggagcttgaagtgtctgggaaaaatccagggagagtgatcacacatttctgaaactcaggcataaaagaactgtgcaagggatgtgaatttggtattcatagtcacgagaattttggtgttagtagaagacatggcagtgaaagagatcactgttgagaatctgtaaaattaaggaacaagaagacacaagcagaccttgaggagcacaagttggaaggtgaaagattcgtattccttggcagagacagagaagaaacagtcaaagttgtcagaagagaactagggaatgtggtgtcacagaagcctagagtatggcattttaagaaggaaggggccatcagcaaagtcaaatggagacaagaggcccaggaagatgaagactgatagctgcctattggaactggattgaaggacatcattggcaagaggcagatctggtgagatggtagagtcagaagccaggtcatcataattggtaagaggtggctctgggtttccaagaactccagttccacccctgttcccttccctctacccatttcagtagtttgtaaatggcttggaggagcaatgaaaatcactaataattatctgtggccccttatgtgagtcttccagtttctgtctgcctgaccatactcccttggttttgatgctgtgtcttgtctgcccctgtatctgtatccatttgggttaaaattgttggtttgaccccattctggtatccaagttttgctcttggacatcctgaacacccatgcccttttatatccctggcccttgacaagtgcagatgttctgcctcttaatttgatgccttggtttcctgaaccctgactcagatcccagtgagactccccatgccttgagtttccaggtgaaatgaaagtaaggaaactagaaggcaagaagtttatgatcacaggtggactattggaacttaagatttaaaaagtagaaggagatgattgaagtagatcaaaagtgaaaaatttcacatatgggggagaatatccaggaagttcaaggctagattattaaatgagttatcaacatggacattgaatctctcagttgaaagacaacattgcaaatgaaaggaagataasaacaggatccttatcataaaggttatattttccttttctgctgcatgctctgagtaaaatctatatctgggcttgagctattgttcattctgttatttaacagatactcaagtgtactacatactgaggatccagtaatgaatgaatcctgtcctccaggagcttatgtttcttttcttttctccttttttttttttattgagatggaatttcactctgtcgcccaggctggagtgcaatggcacgatctcggctcactgcaacctccgcctcccgggttccagcgattcttcyaactcagcctcttargtagctgagattaccggcgcgtgccagcacccttggctaatttttgtatttttagtagagatgggatttcaccatgttggccaggctggtcacgaactcctgacctcaaatgatgcactcgcctcagactcccaaagttctgggattacaggcttgagccactgcacccagcccaggagcttacatttcaaaggagtgaggaatgcagacaattaatcaaaacatataagtgtaatgaaggaaatagagagatatgaccagggagtatatagcatacagaaggcattgtcagagaaagtctctctaaagatttaatatgagtgctaaaaggactctcatgcaaataagcaggaaaagagcattctaaacagaggaaaagcagtgcagacaccctgaggtagaaaggagtttagtgtgttagaacagcaaaaagtcccaagtggctagagcatagtgagcagggaaaaggagtaacagatggagctgaaggggctgggacctccgtcctgcaagctttgttgatgtattttattccagaagtgatagaaagggtaaaagcggggcagtgatgtgatctcaattagatttttaagggatcactttggctgcctgtgaagaatggactgtcgggacaagagtagacttagcagaaaaaagatccgtcttagacttcagattttcaagaagataccaaaggtttttatgtagctataaaaatgtattgtgtgtaggatattaatcattttaactggatttttatgacaagtgatatgccaagagaactgaggctactctttgagaagcaaggccccttttcagagcctggaatttgtttccgtatgttgtggaatcatcttcatcccatccatccctttcacatttattacagcctgagaatccaggcatgtttctgttactccgctaggccttttgaaagagtcatatggagaaaagtacacaactggtacctccactgtatgttttagtcatttctatgcaatagactgatttgaggcatttttgttatcttgaaattaatgtgtttaccatgaggattataaacacagatggaatttctatctccatgtaacaaatggagagcaaacacacttcattgcctggaatatagataaacatccacaaggtcaccaacactgacaggagtagagagcttygggacaggtagcatgtcgggagtggtgtgcccatgtttttccacctaattctcacaccaaccttacagggtaagtgtgatgtgcctacttcacaaatgggaaaattgggattcagagagaattgattaattccctgaaggacacatagctggtaaataacagagatggaattagagccccatatatctgactcaaaaagccccatgctttccatcagttcacactgcttccrtctttgtggcctgaagatatatgctgggtgtcatcttctaccttgttttcaggtcatctgtcagtctcagaaggtgagtgagtatttatgtgtgttgtgtgtgtagtgtgtgtgaatatgtgtgtggtgtggtgtggtgtgtgttatgtgtatttgtacatggtgtgtatatgtgtagtgtgcatgtatatgtgtgtacggtatgtatgtggtgtatgtgtgtggtgtttatatgtgtattatgtatgtttgctgtgtatgtggtgtgatatatgtatatatgtgtggtatggtgtgtgtgagatgtgtgtatatatggatgtatgtgtggtatgtatgtatatgttgcatgtgttgtatgtgtgtgatgtgtgtatgtgcatatgatgtgaggtgtgtgtatgtgagtggtgtgtatatgtgtgtgtgatgtgtataggtgtggggtgtgtataaacatgtgtaaagctctctactcctgtcagtgttggtgacctcgtggatgtttatctgtattccaggcaatgaagcatatttgctttccatgtgtggctgtgtgtgttgtgtacaagtatatgtctatgtgtggtaggaatgtggtgtgtgtgtggtgtatatatgtgtggtatgtgtatatatgtatgatatgtgtgcatggtgtgtatgtgtgtgatgtgtgtatacgtgtaggtatgtgtgatgtggtgtatgtgtgtagtgtgtatatgtgtgtggtgtgtatgtatatgtgtatgtatgtgtggtgtggtgtgtctgtgtgtagtgtgtatatatgtgtgtgtgctgtgtatatatatgtgtatgtatgtgtggtgtggtgtgtcgtgtgtagcgtgtatatatgtgtgtgtgtggtgtgtatgtatatgtgtatgtatgtgtggggtacgtatgtatatgtgtgtggtgtgtgtgagtatgtgtgtggtgtgtatgtatatgtgtatgtatgtgtgaggtgtgtatgtgtgtgtacatgtattcaccctctcatatatgtgggtcacttgctcaccacggctatttagaaattttaaatgaaaacatcaggaaatgaccagattctgctccagctaaattttggaaatcctacccaaccaagaaggatctcattgcctgagtgtcctcgcatgatgattgtttgcctggaacaaggcaacactaggcagcctctcacatgtgcctagtagtaaaaacaaacaaacaacaatttgatttagtcccacttgagttggcaaatgttgataccagaagaaaaggaaatgtgaagtcagtgggggctggctgggctggtgaacatggtcaaagaatatatttaggttactatatcttcaccaattccagctgggacttttcttagatcttgttctctgtatttattagaagaaaaggaagaattctcatctgattgccgtcctgattgaaacctccttgtggatccaatgctgagcctcaggctcctcagagtgaactggttaattctgtagactgtgagtcttgtgatctttgagtaaatctctgcaggaattgaaatttgcacatatgatagtggaagggcctgaatagaaactaagcagaactgagttggagtcagatttgtccagttgctactaagagaccttgggcaaccacttctcccctccaaggctcggtgtcctcatttgaacaatagcaaaactggactggatgatcsaacaattcctttcagctctgacattgccctattcagtttccctacctcagacacaggctccaagactgtggccatactggtgagccacatacacttcagaattctaccatccataaataatttaccaggaagccatggggacatccactgtttacagttatcttactgtagggtaacagctacacttatcctggtgaaccgtcttaaaacatgaataccaaattcagcaacaggagttaaagaaaaaaaaattaaaaagtatttgaggtaaaatcttacctaactagggaatgagatttacccttttctctaagcataacttatgattttrtgtagataaacacccaaacatcattacagacatcatcacactttgcctgctttcaaggtcctgttttcaccatggtcattatgttctcttattgagtgatattgttscctgggatttgatttctttccttcttctttctgcccctaaagggtggattcaaactaaggggcaagcctctttttygtgaatatgaaggcgtgcaaaaaaatgcattytttaaattcaaactcatcttacttttatcattcagcttaagaaaggcaatcctatcaagatgcttatttgttcattcattcattcagccatgcatttatcaacagcttactgagaaactacaatttgccagtaaagttctaggatctggggatagagacgaaggtggggcaagcactccggagcttagtttgatggtgctactaagaggtcagcaggctcactgtgaacattgttacaattatggcaggacagagtagtagagtagtagatgagggaaaattgatctgagttaatcaggaaataccttaagctgagatctacaggcaagcaggaattaagccaagaatgagggaacaagaccttagaacgggagaaaaagcaagtccaccatctcagcctgagtttctttgctcaagaccaaagcacagatttctctttccctacagggaattctgacctgaaattcctccccctaaaaacacctgaaatattgaatcttgatctttagaaaggtgtgttttcagaggtaactgcttctgtgataagttacaggacatctaattgtccatattcaatataaatatgcagagaatcacaggcatatttttccccacaggtaatttttttaaccattttaacatcagattaagttttgatgcttattagataagacatctgcagacttagggtcaagaacatggaaatctttggaaattttcctgaagtcaagctgcattcttccagtaacatggctttttctgacaataaaactccccaggctgtcctgagctctgaatctgaggatagctgctgagttcagccagggagaatcattagtggggtctgctttttcactctgtttcaaaagacaagtggatttgaagscttccagagaacattgaatggattaagtaggcaattggatccatttgctttgactcatcatccttcctttctctgaagttcctggggtagactaaggaagaagagataaaggtagagataggactgaggcttatgtagaaccacagacatgaaaaatacacatttaggttgtcaagcatacatcatgcagccacggttactcccattgctgataacctgctaaaacttttctacacaaacgaattggactcttcttttatgagatattgagtcattgtttggggagtcataaaactgagggctgacaaacaagacccaataaatgtatagcactttaaatatgtcaaggtggaaatgtatgatattttaaatatgagaagataggtaggaagagtaaaagcaaaaatctggattcttttcccctgacttatttcctcaatttgaaaacaaagaagtgggatttattttctatcattcttggtgttcactttgccaaggactgggctcagatccttcagtgtaaaatctcttcattgagctacaccaggattgctctcatctctttgccaccaagtataacttttattgtttgacacagcgcagttcatatcgaggaaggtttttctttccaagcaaaattgcatttgatgtgagtgaatttttattcccatttttcaagtaattttatatgtgccctgacccaccagttttcctgctctacacaaacacaagggtcttcccattctaaggtgactgaattctagccagagaaaagataacggatatttttgttggcctgaacagccacggtacttatatatgtacttctttttacttccccttgtgtcaaaagagacttacagtggcttatcttcagtaagcatacagtatggatggaagtttttgcaaggtcctcttctatctcaaggattcccaaactactgttgtgaatttcaggttatgcaccactagatttggcagtgtctcttcccactgtgtgacttttatgttacctttagtcccctaaagaatcatgtcacactgtgagatagtaaggactttggatacattgtatgaagtatcacccactctggacttcatgtctggggaaaacttaaacacaggaccactsataagkgataagcctggaaataaacacrcgggataataaaaaaccagaaaagctaaaccaattacaccattcttatagaaatgtgtgtgttgggaaagttagggtaaaaggaagtagcaggcacaaccccaaagaggtagcaatgtagctctaacatagaccgtttcttcttttcccagttttgccctgacacaactggtgaaaagtaagagatgctggattcttgaaggtcagtaatttgttgctccattggaattaaattaaggaaagcatcaataactacatgtgattagtaaattgtataagagtggtctgaaaaaactcatactgagaaatttaaaacaccaaacatgagcaatttatcagcaacccaagatgtgtaagtttttcatctgcctaaattaaaagttacttctgaaccttcaaagctaaacatttaaataattctatttcaattttctcaaaatttctattaagaaaacacaacsacaaccacacacacaaacatgcacacccgcaaacacacacataaacatgcacaccccaaaacacacaaacatgcacacccacaaacacacacacgcataaacatgcacacacacaaacatgcacacccacaaacacacacacataaacatgcacacacacataaacttgcacacccacaaacacacacataaacatgcacacacacacatataaacatgcacacacacacacacacacacacacacacaccttcttctccccatggtattgacacctctaaaaaatccacatctttgatgttcacaagaaaatggagtaacttaggtctggatatatgtttgtttattcatttcctgagctaaaattctccaggttgccaacccaaggtcattcagtcaatgggatagtggtcatctcaccaactacagccaatgacatttcaacccagctaattcagtgctargagatatttcaattcacacctaccctgtggccctatgaacaaaccaccaatgtttcagtttctctctcccctacttgtgagtcccatgtgaatcctggcagaaatcttgcctccattcctagatcgtaccttatcccagcacttacaccatccctaatctcgagatgaagtccgtgctggagtttgcatatctgttccacacattactacggatgtgatacttaaaaagctaaaaattcaattcaattgacaatttgcctcaaatcatgtggcgtcaaagtggtcggatctaaatgagtgtgccaagttctgtttccgccaattctgcagaagtttaacaacattttttgattttataaaaatgacccaagtgtgtaatgtctcagacataatcacatttcccaaactgagatgagaatcttctttttaaggagctcaaagaataatatcagaggcaagcatctaggattagctaatagattggtggaatagagtcaggyaagcttctcaggcaggagggaatcattgtcagaccccacttgacccaagttaacctggctggattccttaggccagctctaagggacaaaatctagaatgttggtaattccctctgtgaggtctcagtcttcttatcctgagaactctgcccaatcacggggaattgtggttgaacctggagagaagccacagcggaccacttgcccacatcacayctcaagagaaccaggagagtacatctgtgtctaaagccatgacccaggagtaggttgaactgaagcaagaggtgaggcatttaatgccaggcaaagcacaccaggaagacagcccaggattgtgcttggatatcctgggacctaaacccccaaatgattaaactgttttcatgctccagtttaccaatattagttgaaaggccaagagtgaggttgtggggttccaatgagtagcaaatgagtaagtgcctagtgtggtatcagccagagtcrgggcacctgccttgtcattgttttattttcttcatcatagactgaaatttcaggacaccraggaacaaaagtcaatcaaaggatgtcacagatcccttcatccctatcaaagttagcatccagacaatagtcggaaacttccaattctgcctaaagatgggaagcaacgatttcccaaatgacctgakccccagactgacattgtttactcataactgggaaaccagacaacagaggggtgctgaaatcctacagtaggcttatagaaatgtctaggctattattgcaacagaatggacattctgacccctgttatatcgtttcctggggcagaagctatgagactattatgaaaattatttaaaccgctttccatagcagaatcccacagaccttctcccacaataagatctcgttaaacattcatttgcttttcttggaaaacagattacagtgacataaatattcaaaaaataaaaggaaaagtaagcatgatttctaactaaaaaagcatcaaacagatcatttggctgtactgtttcattttctcttagtatagacaagaaaagttgcaacaatcttaactaagataccttgcttatgggaaatgttcctattcactagcacctccactcccataagaaggaaaacttgttataagacagggtcttggagatctcatgtggatattttatcaagggctccccaagtcaatgtttactcaaataccacttagcattttcttactaggaaaatatttcatctcatatctccccattcccagatttgagggaaaaaaattgtgccattttcaaacataacaagcattctcctccctgaggtcctcaatgcaaaccattgtagactagatcaccttgaagctttcccaaggtatgagctttcttaagaagaataaatgataagtatttaagatgatgggtatattaactagattaatctaatcattgtacaacatattcgtatatcatatcacaatgtaccacataattgtatattattataatctgtcaaaaaaagaacacaaaatgactctttttaaagtagaagccttctcttccaggggttgggttggcattttaacaaacagtagagaaagaatcgctgtaatgtgcactgttgaggtactcttacttaggctcactgtttttcctgtgtcttgtaggacataggaagttcataagaactgaaaggtggaacctctgccttttccacaacccaaaggctgcaggcatcargtttaaaatagaggtacagaggcttccaagttaggcacagaaacatgctgccacaggggtaatggaagcgtgctcccagaataggttggggaaactactggccctacctacttctgaatgaagattccagcctgaaactgaaaataagcagagtctttgggaaaggttaggacatctcagcatgaaagacagaagctgyacagctgtgccttgagattgctgagcctggcgttctcgctaggtcttttccatatcagcaatgagttggcccacactgtgagacctcagtcacaactactatagctaaatcyaaagactaccacatctgccttgtccaggagctaataaagaataaagtgctttcactagtgaccttaacctccttccacaactggctcatggagaacacacaaactgaagttagcccaggtgctggtcccagaaaaggctcaaggttaccccttgccagcctgtggtctctggtgctctagcagccagcactgggaagtagtaatgggagtgacattctctgggtcccaaaagtctgaataaaacctcacattgacaagcgtcactaggctgcctttaaaggcccttgctcttggctggaatattaactgcattggtagtgccttttatctcatgctgagaaaaactaggcatttgatcaaatagcaggaaaataaactacttcttatttaatacagtttggtaaacagaatctttccaaaatttgaagtccatttgggagagaacagaaaaaaactaaagggacttttgcagtgaaagaccagaaacactgccctagggacaatcttcttatttttttatttttagttttatgttttattatactttaagttttagggtacatgtgcacaacgtgcaggttagttacatatgtatacatgtgccatgttggtgtgctgcacccattaactcgtcatttacattaggtatatctccaaatgctatccctccccmctccccygaccccacaacaggccccggtgtgtgatgttccccaccctgtgtccatgtgttcgacaatcttcttataaaggcacttgacctttcrtctatccactcatccattccttcctttcatatacacttattatgaacctagcagatataccaggtgccggagactcagttatagataaaacacagtgcctggcctcaaggagatcatagtctagagaaacaatcacctaattaggcaattacaatgaatcatagtaatggtgataaggacaattgcagcctcagagtaggcttactggaggaggtgatgtcttatttgttttttatagtagcagtaggatacatgcctagatgctacatgtttcaatgcataaaatgagtaattacttaataggtcagattatgttaggtgtccatgttccaccacaaggtcagatgccacgtgcactgggtctgatactctgtgaagtagtrcccacaaggcaaggacaaactaagaagaattatgcaatatgtagaaactatatcacctatggaacaactggggaaatacatttcatgtgcctggtgaagaaagctaaggacactggaaagcagccacatgaagggagatggatgtagatcttgttcagaaatcggaaacaggtctagtgtgtggaaattctgaataaaagcagggaagaactttaaagcactgtttcccaaatagcattccatgaaacatatagaggcaattcaagaaaagggggatttgtggtcaaaaaagtttggaagatgcagagtttaaaagtcttatttctgtggaacttatcagtgcctttatctcaataaagtgtattgagataggaagatataagaaatttttcattcagtaaacacatttattgtggttacaaagtacttaagtgactacaaagtatcaggcattgtcataggccctggggacaaagacatgaacaaaagagacaaaattaaggtaaggagaaatggcagtaaacaaataatggatctacattttctaaactgattggtccacagaaccactttgtaatgaaacatctcatcattcttgtgcttcttgaaacacatttttgagaaagagtgaattaggaggatctaacaacgaaatagatcactccagtgctgtaactatgtaagctgatttgcagtgtctgtaaggatgctttaaagggtcttttgagatttgagcgtatgatccctaagacctgaaatggttttgactcaacaaaactggatgtttctagacagtacaccttcagcctgcagtcttgctgggaagaattatttgctgtgacaaactgattaatgaataccaarttttatgacaatccatgaagtgataggatctgcaagaaaagtaggattttactgggaacacagataaaagacaagtcctaaagaagagtcttctgatcataaaccaaatgatgagcttaagaggatttgtgacttcccccagcccattcaaatgcaatttacaaagggctacctgaccctctcattataattttcaccagaacccccaaactgtcaagcaagatcctatcatcagagactcagttcagaaggaactctggttctcatttgcactttgatctatctcaagcacctgtgagggaggaaacatttatggaaatacctgaggagagcacgaatctccattaggataaatctagggaattcaacatcattttgggaaaaaactcagtcatgagaggccatctcagctgcaaactctgccatttctgctgctccaactgacttcccaaatacctaaaacaccagctaaagtaaatgaatagcattatttatttataacatcatttataacattattacattgctgcttcaatctgacatcccaaatatcaaaaacaccagctaagtatacacatatacatatattatatataaatacaatgtatacttcaatcatacattgaagcatacgttcaaatatatgtattctawtatatatatattatattatagtcaagtattatggcattttccattttattccattttgtccatttgtttttcctattctttagccaattgtttagagtgtttatgtgaaagaaccgtctcaacattttggaggtccatttaatactggaatcacatttggaagcttatgctatttttaaacatgatctcagtctagctcgcactggtgctgtaagtcttaaaaagagaaagccctattctattaaaaatagctcattccagtatgactctaatgactctaaatagacaaataagacaagttatacctgtctccactactgattacaaatgaatcactgtgaatatagtgaatatatcagtgtatggattttttatgttggtaacattatcccactgaaggtgacatcttagtggtcattactaatgactaatgagatagaggggtatcacagataatcccaaatcatagtcacccccaaagacatgtagcctttgcagtgtactgagggttaaatgaaagcagatgatttcctgatgtccctctctagtttcaatttgcttgccttcttgagttaatgatggtcttcccttaagcacatatactcctaaggagtaaggtaggtgctagagaggttgctggccaaacagcatttgtaattgtcatatgtaattgacagaggaaataatcagaaaaaacatcactgaaaattgactacctgcataaaatgctaggaaaacacttgcaaagaataaaaataactacatgggcaagaaaagaattctccaccacattattgacattttgatgaaaggagctccttcccaactattacctataacttggtggtggtgatgaaagaaagaagaatgcctctaaatttctctctcatttgaagcaaccacatagacagccaatagaatgtggagaggagcaggggagtttcgaaaggaggagatttcattggtctgtatcctacagaagtggccaatggcagcagaatccttctctgaatggacggctgaatacagcacaggcaaccaggaagcaatgtctattcctaatttccaaatgtcctctacataccagtatcaattcctgctaacattttcaccagttcacattaatatgagaaaaataaggacaaagtagatagttatttattaaattaaatgtattcaatgtaaaggactgtcttttattctgagactacatcattcctgttaaggaaaaaaaaaaacgccctttcttctattacataatggtcatattaaagarctgtggttgctactgctgctgctgctactgaaatttaaagaaatcaatccccaaactattttttgaaacttctctcctctgtgaaatccaaaagtcttagagtcactgaaggcacaagggactggtagagtggataagctcaatttagttaatagaaggaaaaccatatacaaataaaaatatcagacagtgagagatgcctaactatgaatgtgctcagatgttgtagcagatttcctctccagctgttagaccccagctccaagcacttacgagggcaccctggcatcccaaggtcagaatgtatggtcagacgaggacagctggactgtcatttccatctcttctccaagayggaaaatggagttttatcactttccatgccatatgaaaaaaayttctgaccaaaaaaccaatgagaaatccaccaagtggctgacagttcagcttcctttgctctctgggatgctgcactaatagcatttaattccagggactaaactctctggccccgcatgtatcctgcttttcaattctccagaacattggttctggcctccttgtctctgctccagcccttctcctaacatgccaccccctaacatctatttttttctctatagtagtctctttggtactcagagctgaaattacatgcttcagtgccctaagagcatgtactttgctttctcatgttggcacaggcagctctattctttattctagggctggagaagagggtttcagtaaagtctagccgtgatgagccctgctatagaatgctttagaagctttgaatttatgttacattgattaccttcatgaaggttaaaatgaagggttcaataacaccatagggagaatccttatggggtgggctggatggcttcacagaggtcaaagctcctgactccagctgtggtcctggagtcagcagatctggcttggcrgcaaatgagcaagtctctctgaggctcatcgatatctgaaggtttggcaagaggatctgcaaggtcctatgtcacctctcacaggctgccatttgatgactccataatcttatcttcatctagcctgtgttctaaacatagccaagctgagaggctggcagagaaaagcaaatgcagtgagtgtgtataaaggcagagaattttcacttccttactcactctacagatgcgtggcatcctctactttccttcaagaagatctattggaaggatgggttgggcttccttgtccctatatatcccttcaggtccaactcacacttttttttttgttttttggtctaagaagctgccttaaattggtgctgtgagtgaacactgcatttggctagatacagccagttaatcttatcctggctactgaatcaccaggaggaaaggtctccttgccaaacctggtgtgtcttcgtaagccaatgcagtttctgcatccatgtatccatatccagtgaccaaccrtggtggttatgcctttccccgtctcgtgctgtgtaaccctgtgaaatggtgggaggctgcaagttgcttgcattttttacctaaaagraattacacacatatatctatatgaatatatagatatataatggcctatgctgagggagggacatattagcgaagtaaaaaatttagcaatctttatcaagtttaaggagcagatcctggcatatttggctgtctttctatgagtaatgctaaaaaaamaaaatgcaagccataagaccccaagtctctccaccaccattaaatgaaaggtcacacgaaaatgtggaatctactcagttggagatgatcatttttggggacttttaacatatatttactttctgttatttttttggttctctttctctcatacccaggttgtgcctggttagagaaagggtcttgattaacatttctaagccaacaactctccaaatacctcaaccaaaggaattcagtgtgcctacatagagaaaaaggaagtgtccctctggatgtgatattttgccaggttgtatttctctgcaccaaatgctatcagatcaacttctgtaggtttcactgaatacaactgcatggaatgctattactgtttgcaatgcaacatgatytaaaaacattgcatttctgttttatctaaaggggactagcaggtttattgtgtttgcatgtgctttccccctagactctggctgccctaacaagaaattcaataaatctgcttccaaaccatcttgcacaagctttgcatgtccagtctgggcctgaggaaattaacaagagaatagaacataccatcgacttgcggagtggcgataaattgagaagagagcatatcaagccattctcactgatgtttaaagactccagcctggagcacaaggtagagctgggtctccacagcggctctttttctgagtaaattgtggtagatgttcatgggactagagagagagcccaggggctgtggttttggtttctttgtttgtttgctttggtttggtttggtactgtctttcatttttctccttgaaaatcatgagtagactgaaggtcatgaaaggagatgagagttagattaagagaacatcagcttgctctttaaggaaaagaagactcaaagaacaaagactcctttaactcagtaagcatcaagagtttcttccactttcagattattaagccaagtggcattaacagccacttamctttgcttttagatgaattcacatcagctgcaaccattttaacataataaatgagggcacccaataacttgatgtaagcggtcagtgataaacactgtctttcttagattttagatatctattctcccctttccccagttgtctgctgcctcagagtcttctgacctaggcatagtagaaagaagatgggttgtggattcagagtcaaatttgaattccacctctgccactttcttgctatgtgaacttagataagtaaagtaacctctctgagcgtgagttcccctctgtrtgatgaggataatgaatgcacctacctcacagttaatatgaaagtcttcagggcaacaccttgattaggtaaagtgttcaaggatggcagctatcaccacattaatgatgactttttccattcccctcccccacctcagctttgaactggagaagggagtgggcagatggggtgccgaccttgcttaactgggttgctcctttgtgctgatagaagctgacagaccttccttgactgagcataagaggtgcctggcatctgcaggagcctcgggcaggaacagcagggaatctacaagcaaatttcaggagtttgattcaatactctgtaaagctccagtgagcaatttttttgtaagtttgttcagctgcctgggagatttgctttccttagtttagagaattcacaattctgtgcacatacagcattcccaatgagcttctttgatagctacctaaggattgcagactccaaaattaataccttcacctacagttcccaatttgagatggattgtgtctatgtactaacaaaacaaaaggaaaagaaacattttgcctcactcaacccacacaaaaaaagtaaaagacacacttctcttattcatcatataattaagggcttaaggtccaaattaaatacattttctttcccggttactgcattgaagaagctaggatgaagagcagattgctttacaaagaaacttctcaattagcttgtgtaaatacctgtgtccagagctatacaaaacgcttttatttatttttgctaaagatgtacttgcttcactaataacctaacccgtgcatactacagatagtttctagtgtgttttatttaatagcattcacatctaagggaggaacagcatgcctgaggttgatttctgtgaccagggaagattmttctagaagagccagagtacagcaccctgaacaaacatgggacttgcccattgacagtctagccacagaccacctagcctgtgctatgcattgcatgggttccccagtggtgatggcaacaggacacatcagcaaacgatcactcctctcctgtcaccgagatattcttcactgactcttaccgagatactcttcattgactcttgctctgagaccatctctagggactgtgttactgctgagcagagaatatatcacaagtaacattcattgggtatttaccaagtaccaggcactatttctaagctgtctgcataaatcaactgacaaaaacagtaataaaaagtagatgttattatgagcttcattttatacttggtgaaasgtgacatggagaaactaytatgaagcttttccaaagtcaaactgtcagagagggactggaatctgagcctaccatgatgccatagccactgctcttgtctgttgactatgctgcctctgccaggagtccccaggacttgatttcccagggtttcgtacgaagaagacaatcccgtgctgtcttcattttccttttgtcaaactttggatgcagtgggaggcacagagagggagtttacaggagaggctaagtaggaaagggttctagagccataacaaaattaaaacaaggctttcaaatacataggattccagaatcagaaaatagcattaatatgcagttcctctgtgcttgctgttagatacatcagtttactattccacttacaaaagagaaaactgaacctccaagaggttaagtggagatcttagatctcaaaatccagctactatatttcattgactctaaggtgtcatcaactgtgagatgctgtattttctatgcagctctcaraaaggraaaaaaaaaaaaaaaaacctcaatatgggtttctaagaggaaacacacacacatacacacacacactaataaactgggcttacaccctccgggtaaggatatggggggctgaggggctagtgggacaacccccttagacaagggtagtgaggaaacccatatgcctataccctggtattgatttaataaagggaagaagctccccaagaatttaaactccgaaatggaatctgcataggtttgctgcatgaattcacactttgaatgtggacaaaaaaaaaaaaaaattatcagagaatttaatttaaaatgatcctgggttgatattgccacctggtgaccacagaagcaattgcaaacctccctggaaagaactcaagattttaggattcccctgataataaggtgcatgctgatttcagagatgtyaaggtgtacattttaaggaaaattgaayatttttattaagaatatatgtcttagaattttttaaatacatacaatatttatgattctaaagccttttctcttsccactgccctacctttcttcttgggaacaagtctggaccataaaagtatgttttctgaaaggaaaaatggaaatggaaaaataattgttcctttgcaatctttgtaggaaaggaaaggctttattccgtttgaacaataagaagacaaatgaatataggaacccgtttgcctttccacctttatgaaaacactgaaatgttcaaacaccgaaatgaacaaagctccatcgaaatgtacagaaatatcattcasacattccctggtcacgtttgcctataataattggygtgcctatccacaacattatgtgaaacaggacttttatataattcatggtattgcataaatacttgttgaatgaataaggaaatgaataaagactcagtttaagaaggttagataagactgcctcaccccctgtagctgttttcaggatattttttgtgaactctaagagccgaaaggcatgggtcaattttgatctgactctttttagtggagtttcagcagagaacaaaagttctgtgtactccctgccatggaatttcaaaggtggctcactccctgctccctcacaggagtcttttgagttaagcttcagaacagtatgctcatgactcatgtagcttagcgaacatatctttccttctctagtccttggattctttatctgtgaaatgaggacgttggacagctgctgaccacttcagcagttaatgctataaatctgtgaatttcctatgatcatggtggccatatgtcctggtttgcccaggagagtagtagatgtctatttttacaatgtgaaattagtatcacctcccttcactctaaaaaatcacccagtgtggatgatatgtaacaagtcatgtgacccaaggcttgggcctcagccaggttagaattagtgactcaacatcttccttcactacccagccartcatcaggactttctaagcagaactctggataggggagaggagacctattgcagttgccaaaggccttcttcagctcttcccacatttcccagatgaatcatttgcccttctttagtcaggctagatatttcctaagtgggcttacagatctcatgggcaagcacaaatcagaactatggtaaagakatgtagaaaacttaatgtgtctgtcagatgctaccaatcacattggtatttccttattgaatatttcttattggatattttcttattaaaagaagaatgcattttcaccagtaaaagttgatactaagtataaggcaaaaagaaaaaaatgaaatctctttggatctttcaacccagggtaaccactgttaccattctggcatctgtcattctggtcttacatgagtgtgaatctatagacttatgtacacaacygtattagtccattttcatgctgctgaaaaagacatacctaagatggggcaatttacaaaagaaagaggtttattggacttacagttacacatggctggggaggcctcacaatcatggcagaaggtgaaggaggagcaagtcacatcttatgtggctggcagcaggcaaagagagagcttgtgcagggaaactcccattttaaaaaccattagatctcacgagacccattcactatcacgagaatcgcataggaaagacccacccccatgattcagtcatcgccccactgggtccctcccacaacatgtgggaattatgggagctacaagatgagatttgggtggggacagagagccaaaccatatcaaaaatttttataaaaatagaccattgtatgcacagggcttcgtaacayagtgttaaacattctttgcttgagcttttttccycattattaaatattcacttacacagtaattttagtatttacatactatctcattgcacatttaactatttcaggcttttaaaaaaagtttttcactattataaattacaaattatgttgtaatgactattctcatagttaaattatgcacttttgcttatttatttttaggataaaatcctaggggtgggtgaaagagaattcacatttaaaaatacttaatagtcattttgaagttgccctcaaaaattgtgcttacacttttaaaaacttgtcaatttggtaagaagtaaaaagcagcacctgcctggcatttctgtttttatttttaaaattattattgcagtagaaggtttgtcagtacatattttggcctttataattctccttttgtgacttgcacatttcttataccttgatggtatgatttacacatttgtcttcattgccaatcttttatcgcagtgctcacctttgtcttttttatttgtgagccttctttacacactgaggaacttaaccttttgtgggatcacttatcttgggcccttccattttcagagcacttacaagaaggtgatgtttctcagcctctggtcctcacttctcttctgggaaatggctctgaatgaggcttaggatagggaagacaattaattacatttacttatggatgtttccaagccagagtagccaacccaaaactttagcatcttaagagagcttaataacacaggaacacttatttggaattatttcattaagctaagtgttccaaaaacaatattatcaccttataataaggtgacttcctcatcttgaataaagattaagacatgtttaatatatacttcaaaattgattgcatatttatgctttggatatgggcatttttgtgggtaaactgtgataatcaagccatatcaaggaagattaaagttccttccttcttttaatgctgatatttttcctcttgattcttaattgctttgagaaaaggcatcctttgtccttgtgacaaatttatgtactaaaactctctttgtctcaggctaatagttttcaaacttaagaatcatctggggatcttgtttgaaatgcaggtaccatcccatcactctgcccccaagattctgattttgcaagaagacctgcattttggtaaatactcttttttggattttgttattcttggttgttggccatctttctctgtccttgattgagcatgagactcgggctggtcacttgccccacatcttcagagatcagcttacatcaaaaagtccccgggtcctaactcaagggtaatatggcttttaacaagtctagaggagatgtctccaagagactaataatggcttcaggaccacagtctttgggatcagctagacctcagttcaagtcccactttggaaatagaagtgagcataaaggacagttgattagtttactgatcaataatgggtaatgacaagttgatatctttctgtcactcaaatggatacacacacacacgtataaaatcctcatttcgctcaccagtatttagtcttcgttgaaagacagaggaaagaacatagactggattctgacttgaacccagttccaaccagttaccggttgggtgatacaaagcaaggggcttgatctcatcgaaatgagtatgattgtctgcccctaggggttgttgtgaaaattaaatggcacaatattcatataacagaagtttgtataaatgcaatagtctttcttttcccttgtccttctaattaatcctcttctaacccaaacctgcacaaggcaagaccctctttaagataaatctcatatgggccaatcttaatgygtcttgtatcccagggtaccagggttccaaccgtcattaatctaagcaagtacagccttgtagctcattggaagaggtgcttccaacaatctcccaggatcactggagcacaagcagtgaccaccttggcctctgagatgtgtttaaatttgtaggtgtcatttgcttgtattttctctaaatgatttgattattctaagatccttattatcactattttccaaaaaaagataaggattgtttctctcttcaaggatgatagatgttttatcattcccaaaggccatgcttttcttcctgtgaggacaagccagccaaggattagatatttcacgcatgggtttctttatgctcctgcaaaagattgtctttctgtccacacttcttgtgattccttgggagtccatcaggcatggctcagagtgttcactctagtgattcttgggaagtgcctccagcagagctcagagcattcatgctattgattcttgggaagtccatyaggaacagctcagagcattcagtatgcttggtttggattctgtttgtgtccactccattgggcatcttatactgagatgatataggaagacataaagccacagcttctgtgccctgggaacttacactctggcttgtgatctgggaacttcccatcctaaaattgggcatgataatggccactttgcaaggtggtgcagatgaaatgcagataatacttaagtgccttggaggctgcaatgaattgcaactgaggcagcaatgtgacaaggaaactggtatttgctgatcacttactaccatatcaggccctatcatgactattttaaatgttttacctcattttacttaagtgtcacaacttcctttatggaggtactaattgtactatttgacaggtaagggagtctcaaagagtttgagcagcttttccaaggcccacagtaatagaaggcagcagagtggggattcaagtagagttcactgtgtctcccaagctattctaccacttctgccacaccttgaaaaatcctgtctttctcctaagcacctgattttcatatagtttgaaattcaagaaggatgcagccagtgggttgcaagggaggagttatacagtaatgcatatggcaaatataccatagagaccaaaaaaaagttaaaaccatgaacatttcttttatcctctattcattcccccctgcccccctacacacacacaaatatccacacatgtcacacatgtacacatacataggcacacacatatacaaacaatccacctcttgtttctggcaacagacacaatcttgataaaggtagcctgaaaacaaaggcaactctatcaccctaactatgcatgaacacgtaagaatcaaataagtgaatacatgaacacatgaaacattttttcttaggccagtgggagaaggaatgatgagtcctcgaaccaccgttgaactgtgtatcccaaaaaaggctgattagcttgagcaatcaaggaggtagttttgtgacaagatggctcaagagaagacaaagccagaaatagcctcccagaacaatcaaacccggccgggagtggtcacttatgcctgtaatcctagcattttggragaatgaggcgggtggatcacttgaggtcaggagttcaagaccagcctggccaacatggcaaaaccctgcccctactaaaaatacaaatattakccaggtgtggtggcacacacctgtaatcccagctactcgggaggctgaggcacaagaatcgcttgaacctgggaggcagaggttgcagtgaactgagatcgcaccactgcactccagcctgggtgacagagcaagactccatctcaaaaaaaaaaagatcaaattcatattaaacaaaactgaagttgaatgagcttygtttgctacacacaactaagcttttgccagttttatattatgataactattgtaaatagtgcttactatgaaccaagttctgtgctgagtattttcaaaaacattcatttaatgttatttcttttttcggttagcagccacataaaaccaaggatttgccacacaagagaatctttagataattatttggctcagtacaattggttcttmgctatgtccagaatgtctctcagtttttttctgtcatttataaagaaaatcaaagttaaatggaggctttaaaaacttcaagaaaaatgaatcataaactctaaaatgtttcttacttcatcccatcaacttttattggagttgtaatgattagtataaaataataaaggagaaatctgggcaaagaaaagaaggctaagcaaatgaatgaattttctgatgggttatgatgttggactctggaattaggtaacgagcaaaatgcacatttttgtcttggggacattcagaatttgttgaaccactccatgtcttatttagatgaacagaaatgggaacatgaagcatgaaccaaatggtctcagcttttctctttcatttttctaaatcacatatctcctagtcattttcatgatcttattgttaaaatgatttttaaagatttattctgttatagyatcaggctgctcttgagtttttactgctctagtaagtcccaacatagtatgaatatcttggcctcctccttcagatgtgaaggacaggtttcaaagaggcttcgggaagaaatccatcccttaatgagacagtagmcttataagactcctttattgtcttgatattatcttgcaaaattacagctgtttctaccaccctctaggtagtcaaatgatatcaagtaccatttcgtgtgtattttttaatcagatcaattagccagttccagtcccataaagccagcattttcagagtcagaagtgccaatttcacctataayagtgtaatatagaattacagaattatgaggccattgacctggtcactgaagcaattgtaacgcttcatgggtagacatcattatcatctacaaccagggacttctaggtaaagaatatagcaatagttaccactctcttggcttctccatggctgggggtgtgggtggggggctggaccagtgaagaaaggaagagttcttcctcccaaggatgaaagatgttggggagggtgagctggaagaatggtggtatggaaggtttttaaaagtttttcttgaaattctcatgtgcccagtctaaccccgctatcaaggaaggacataacattaggaaatgtattaccaacctagggtcttctgtcacccctgggcaggtgtcctcccagccttgcacttctsaagcccatcaatcttaaacgcatgttagcatgtttccttgtgagtcaacttaacatgattaaatccacatttgttcagaggtcagtttgcttgggaagaagtatgtcagtgagacattctgcacactcacctgtcactcatagaattaattgctcttaataataattttattggtgtaggaaccaagatagagaagatggcctattttgaaattcaaaaattactgaaaattagtctcattgcaattatgccttgtatccaaatggtgtattttatttatttatttatttatttatttatttatttatttatttattttttaagtcagagtctcgctttgtcttccaggctgaagtgcagtggtgccatctcggctcactgcaacctccacctcctgggttcaagtgattctcctgcctcagcctcctgagtagctgggactacaggtgcacaccaccacacccagctaatttttgtatttttagcagagacaggatttcaccatgttggccaggatggtctcgaactcctgaccccagatgatccacccacctcggcctcccaaagcactgggattacaggcatgagccaccgctcccagcccaaatggtctattttaaggatgctctatgctactgccatgctacagaatgcatgaatttaacaacagaacagtggttaaatttcttcatccactaatgcaaaatgaacaggttatcccagttgagaattttcttttacaactatattaatatatactaataaaagatgtgctagaaaattttctttaatcaaactaaatttatccaaaaatgaaatgggctcccaattgaggacttgatttcccccaacactggaaatattcaagcaggagttaacagcttatacctgagagatattagtgagttaaactggcattagtaaagattggagcaagatgacaaatacaattcattccacctagaagattctgtaatctcacctacaatctttgataaaaagacagagtggccaggcgtagtggctcatgcctgtaagcccagcactttggaaggctgaggcgagcagatcacctgaggttgggagttcaagaccagcctgaccaacatggagaaaccccgtctctactaaaaatacaaaaaattagctgggtgtggtggcgcatgcctgtaatcccagctgcataagaggctgaggcaggagaatcacttgaacctgcaaggtggaggttgcgctgagccgagatcacaccattgcattgcagcctgggcaagaagagtgaaactcgtgtctcaaaaaaaaaaaagacagagtacagttacagtttaggcaattaactagataattgttttagttataagcatcttctacatcttgtagaaatgtaagaatctttcagtgccttttascttacagtcaaaatggagagtctaggaaagcactgtggttttcctccccctcacctaggaagagttcttaggactatcccaggcatggaaacatggaaggctggaagctctgtccatcacctctgtaaacgaacttccctgatcatctctctgtggataagaaatctgaaatagatttgttttgcatgtgatcagactggggtttctcagcttctttgtggtggatctaaaaacccattgaccctcatgactatgatttcatttctgaatatgtctttcaagataattcagggccagaatccccagacatgaacaaaatgaaacacaagtttatcctgctccacttccttggaaggaatgggtctgaacttcatcaaatcaaacaggaattttcatttttgaaatgatttgtttatcatttgaagattgtggtcactctccttctgttgcatttaaataaaatctactgtcttttgttttcttccctattatcagttcacccatcctggcctaaaaaggggctcattattttgcattgcattgtgatgaggatccattcatcaatcaggaaaatatagcrgtggcattttattaaactaatttttaggctgtttctaatgtccattstttgcccatatgctttactttcattctaaccaagatttacataggcttaaatttttaacacattccctttctgtatatcwtaaattgcatcactgaaatatacccaagaaatctgatcatgcacctatgaacaagatagccttactctgaaaatagcaaggaagcagtagccagtgagtccctgcattctagwgcaaaactcactggattctctatttgcaayctgtgaaggtgtggttgagttactcagttattcaaaccctcagtttctttatctacaaagtgaggatattataaacaagaccttcttcaagagttgcaatagttaaatgagaacattcatgtaaagcgtgtatcacagcaccagycttgcactagatattagtccttattattcaaattccttatcctagattttgacctttttttgaatcaactaagaccctaaagattgagaaataataatattccaaatcctaatctaagatctccgaagaagtatttgtaatttgttccaagtgtctgaattttgccaccaactgactatgacaagctctttcacatctctgatcctcaagtttcctatctgaaaaaaatatatatctatatacatatgtgtgtgtgtgtgcacgtgcgtgtgtgtgtgtgtgattgccaagttctcttgtagaccaagggctcagtaaattacaagggttcacaggtcatttccaagaacacttttcctaaggatcctagaaaagttaagaattctacccggtggtgggtaatctttcaagaagcaaggggaataatgagagtggggtcttcttccaagttaaaaaacacacaggaggtcataatttctttagaagaatcttttataacatggtggaaaaatcagtcaacacttttggggtcaccgctgagtgcaaggtacaatactgtacagaggaatagaagacagcatcctgcaaggcaacamcattgaaaaggcaagcttcacatagawgaaagtatagaaataaaataagtataattaattgattgacagtaggtaacatttatataggrttatcgtggaaggcactgttctaagcatcttatatatattacctcatttcattctcccagtaacccttatgagataattcctattattgtatccattttctagataaggaaactgagacatagaaagcttaaagattttgtccaaggttgcataggtgttagagctgggattcaaatccasttaatctagctcttgattagttcatgytcacaactgagatataaaaggataagtggggccaggtgaggacagaacagagatgagacaaggagtccttaactttggcaggcaataagcacacaactaacttaataaagctatgagccagagtgttcagacctttacaagtcaagaggaagttaaatgaatcactaatcaatctcagtactctatcattctgagccaattaggaattttcttttcgaagtcctgctctccttgcatttccagagtaacaatgcaccacattctgaaacacagcattttatatttgatgatgtcaacttcacaattataagattcttcttttatgtgattatgctargcactgaagttcaaacaggaaaataatagaatgcttcaaacttatkaactacattaacgccaaacttatgaactatattaatgttcccatttgacagataagaaaagtgaggttcaaagaaattggctttgctcacaataaaatagtgacaaatctaaaagcaaagtacgtctcygtactttgtctccacccaatttgccatctgaagaaaattgaaaatataatatcttacgcaactttagtctggacaaatgatgattatgtcacattttttaagtcatcagtaaaaaaccttcataaaagtagtcacagagactcaggcttgggatctataggaagggatcttttcataggatcatgggccaataatggaaaggaagcctttgcaaagcaatgagctctcaggctcaggatctgagtgttcaacttgagggtgtttagaatcctgagatgccctgcttaggaccagagaaaagaaacccactttcccagataaagcagagaaggtcatcggatgataatcaacagacatttgaggagacatcaagaatgttatgaaaaggatttctgaattgggaaggcaatggtcaattacagctccaggatgctgtgatgatgatagtgatgatgacaggtggtgatgttcatgatgatgatgggtggatgacataaaagaagaaaagagccaggcacggtgactcatgcctgtaatcccagcactttaggaggccgaggtgggcggatcacaaggtcaggagtttgagaccagcctggtcaacatggtgaaaccccatctctactaaaaatacaaaaattagccaggcatggtggtgggcacctgtaatcccagctattcaggaggctgagggaggagaatcacttgaacccaggagacagaggttgcagtgagccgagattgcaccactgcactccagcctgggtgacaagagcaagactccatcaaaaaaaaaaaaaaggaagaagaaagaagaggaagaggagaggaggaggaggaggaggaagaaggagaaggaagaaggaagaaggaagaagaagaagaagaagaggaggaggaggaggaggaggaattttagtgtactgattaactacactaaaatgattattactgctgtttttaaattttcattatcaaatctacgcaaccatgctggtttgaaattaaccagtagccggccgggtgcagtggctcacgcctgtaatcccagccctttgggaggccgaggcaggtggatcaccaggtcaggatatcgagaccatcctggctaacatggtgaaaccccatctctactaaaaatacaaaaaaatagccaggcgtggtggcaggcgcctgtagtcccagctactcgggaggctgaggcaggagaatggagtgaacctgggaggcagagcttgcagtgaaccgagatcacaccactgcactccagcctgggcgacagagcgagactctgtctcaaaaaaaaacaaaaaacaaaaaaaaaaaaacaaaataaaaaaaaaacagtaagccaaggatgaataattagatcctctgtaattggttgttagaaggaattcaaacatttatctttctttgaattaactgctttgtggctaattaattttcaagctgctctgtgtaggcctctatgattgtgacctgttcttgggtagcactattggtaactattaataatattaataatatgggctttctgtggttttatcagggttgaggatggcttaaagtgattcttcagagccatgttcctggtttccctccagataacaagcaggttgccagcaagtggacagaggcctcaatactggagagtagaaaaagcattgccctgcaaaagcaataactgtgcagtctctgaacagcattgtgcttcatccagagagctcaacaactacaggatattctccaaaccttagctatgacactaagaagtggggttcagtctaaaacccagaccacmccaagaagtcagaaaagaataaaaatcatgtaactgtttattgcaaacaccataccaacaacagattggactgattttattatttcttgacctgactgaaaccttgtcttggtattgtggacatagagcctaagatgttgtgagacctctatttgccagcttcttgtttgaagtaaccatgaaatgcaaatcagagattacaaagttccaaagtgacacttagttttctatcccccaaaaataaaataacctgcctgctactagtcctctctctcattaaggtcaaatgtggggcttggtttaggctaattctaaggtctttttcagttttaaaaactttcccaccttctggaggaagtagatattccccagcttagtaactccaagatagttcaagagagtaggcagaagtaaggcaaatacacattgagtgctgaccttctagaagcttttaaagctagacaatgaaattactgagtactctggataatcaaaataaagttaccaccattccccagggctgccttgagcagacacgaagggcatcaagcatattggtctattagtcttggtttctcttctgtgaaatgaaaaggctacactagctggagatctcttaggctattttctattttaagagcctgagaatttatttttaataaaaaaaaggaggcagaaagacttcctggtaaaacatttccctgtgttcccaaacttaacacgaaacagtgcaagatccttaaatgacttaagtttactcatgaagaaagtcaatgcaaatttgatttgctgcatatatggatgtgcgctcttctgttctgttaaaataatgttagttcagagggaggggaagaactggataagctcatgcaaagtatccctcccattgtatttactcctgggctctcactggaaagttggcaggagggatggggataatgctctgtgaaggttttattaagrtatgaattattcttaatttwaaaaaaatctaattgccttgtttcttcttgatgtttccctcaacctcaaacactgcactctgctgcaaagtaactcattctctcttttyttaattacagtattctcaaatgagggatgaagtgttcaagtcaaacttggtctgtgcatttatcgttcttctatttatcacggcaatacaaagtttgcttccttcttcaaggtaaatgtaaaagaactaattgatctggtgaaatatctttgtgagattcctcatgtggagtcagccagctgacttttcaaagaatcagaatttaaaataactgagtccaggacgcataccaaaatgtttgacagtatcaatgtctattccggttgtcttactctgctaataatctcaaaactctgtccagacaataatctttttcccaatcttaataaaaacaacaaccaaaattaaaataggccccactcttatttgacatgacactcatgaatgcagaaaataggtataagaacctcaacaccatttacttgtgcttttgttagtataattcattcacagatacagcatcgtagctccttgggtccgcaaaatcaacactttaataataatgcaaacacctgtttgtggccagccactgttctactttacrtacaaaaacttctggaatccccatgacaaccttatgaggtaggtgccatgattatcctcattttaaagaggagggaactgaggctcataatagttaaataaattccctaagatcccatagttcaagatgttactgcctagattcaacccaggaagactagctctagagtctgggttcttaaccctctattaaacacatattgtccaggttatagatgctctagccaggatttgaacctagttctggattagtccaatagctatgctttttyctctcctctaaactataagctagctcctgcctcttttctcagctaaattgccttctccctatacttactatgagttttcccctttcacatgattaaaaataatatcaacaaatattttttaaatacttaatataggctaaggaacattatagcccctgaggatgacacagttttggaagaagaggttctgtaacctctaagacataatttagtaggtgacaaagacattaacaatggctcccagttactgagcacttatacatgccaggaaagtactacatcttttccatggattgtctcaaaaagcctcaaaaataactgatgagtgaggcagcattccaattcccattcgtagatgaggatttatcccaggtcacatgtctgtgtaatatcygagctgaaatttgaacccagagaccaagtctgtgcttttagttactagactgctttgcatcaaaattagtgattcattctgaccacatgactcaaggaaaaatttgcagaaaaggttttgatttcactaagatgagagaggaaaaagtaggagagtattccatttggaaaactgctctggcaaggccatacaagtgagaaaggccttgtgtttatagaatagtgattaaatgtaagagccaatagcaaagggcttgtgcaagaatatagtagacactatggctgaaaaagaagagaaccagcagaagttcaatgttcataactatgttaaagactttggaattgattctgagggtgagaaggggccccaggagatttttaggaagattgtagcatgatgctgtggaagaaagatgttcaagttaactaatatgcaagggcaggccatgcttgaccttccccctaattagcagaggacattagaaagagagaggggattccgggaagatgatgggacagatggtatatttcttaatctctcagaattcttacgaatctgaccaactagatagcaaaaccaaaaacctcatggactatatttataataaacaagggtgatagacccatacattccaatatagaagtgggtagcaacaatcccccaatagccccaaaatctgtgtgatatcagtacctgtatgggagaaagcasaaagaagtactgggcatgtcacaccggggaacaaaaggatctcaatacagccaacagatatgcactgagaagtgctgtgagccaaattaagaaagcaaatgaaagtgggaaggagtttgcccaatccaataaccttttgaaaggcatgaagagctggaaccatcaagacactatgaactcgtgaaactgatcatctaatctccctctcatgataaaggcctgaaaggaactgtgtgagtgaaatcaaaatcacttacaataagggctatacaggttaaagtgggaaggaattckagctatsatgttttgaaacactgcatgaaagcaaccaaagagaaagctctatagagttaaaaaaataaataaacaacccatgctctttctagaactctgaaccatgctctttctaaaagttcagggaagtgttttacacaaaaatgagcaacaaaatatattgatggcaatactatactattataaaaaataagagaataacaagtagaataatcttcttatagtcattgaaagtgctccagaaagacatgctcacaaaatatatcaaaactttaacctattcttttaaaagaagctgaagcacttaatgttgttcaagacatgaaataacaacctaaccaaaattagaaaaacttagaaatttggaaagacagctcaagaaataaataaaaattttaaaatatatatatttcagaaatgaagacagcaaaagagaacaaacagcacataaacgcagcaaaaattacttaagaaatatagaaagtgaaagaaagaacatcattttttaagtcaaaaagaaaatttaaaagattgacagagccttcttccccacacyttaatgtcacaccaacaaggaccctgtatactaaccacggatactaacagctgaaagaactgcaagacacagattctttctgaggaagagtacttagggaagcccatatcaagaggggaaactaatacactagaggaatttgaagctactggaacatacaactatagcaaaccttaaccatagcttaaytcccagccagagtgatataaatcctcacagaaaatatctatttacttcattttctattacctgatacaatatgaacagttttcaacagaaaattacaaggcacaccaaaaaaaagaagaggcaaagcaatcatcagaatcaaactcagatataacagtgttaaaattatcatacagggaatttttaataacttattaatatattaaaggttctaatagaagtaggcaatgtgcaagaaaaaatgggcaatataaacagagagatggaaactctaagaaaatcaaaggaaataaaaggaaaggataaaaatttaaaaacacctaacagaaataatgaatgccttcaatgggctcaatagtaggctcagaaaggccaaggaaataatcagtaggcttgaagacaggtcaatagaaacttccctaactgaaatgcaaagacaaaagtgaatgggggttgggcaggggacacgggtcaaagcatccaagaactctgggatgatttcaaaagaagaaatatacacataattagattaccaaaaggagaagaaaggagagctaagcaaaataaatatttaaagtaataatggctaagaatgttccaaaattaataatagacaacaaaccacagaatcacagaaacacagaattttaaaggttaaatactttggttaaataaaaataaccaaccaggataaacatcaaaaaaagatattgtattcagactgcagaaaatgcaagacaaagggaaaatcttagaggataccacagtgaaggacatcatcttaccagaaggaaggacactgccttacctgtagaggaacaaggataagaattacatcagactttttgtcagaaaccatgtaagcaagaagagcgtggagtcaagcatttaaagtattaaaagaaaaaccatcaacctagaattctatatcctttataagcagagaaaaaatactttctcagaaaaacaaaaactacatttttagccaacattccctgcaagaaatgtgaaaaatttcttcaaacagcaggaaaataatgtagattagaaacttggatctccataaagaaagagcatcagagaaaaaataaatgaagttaagtaaaatgtttttatcttaatcttaattgatctaaaacattattttttgtttaaagcaacaatattaacaatgtatttggtggttataaatatggataaaagtgagatgaacaatagcaatgtcacaagggacataaggaaggaattggtaatgctttattttaaggtaactgcattatacatgaagtggtatgaaggctgagttacattaatttaaaatgcatattttaagctcttgagcaaacactaaaaaaacgtttttaaagagagaaatataattgatatgctaggaaaaaataaaattaaatcatataaaatgctcaatcaaaatcagagagaatgttaaacaaggtgaacaaacaaagaataaatgcaatggatgaaaaagatagttacaaagatgatggatgttaaaccaagcacaaaaatattactctttgatgttaatggtctcaagataccaattacaaagcacagcttgtcagagtagataaaaaaaaaaaggccccaatagatgttgtatacaagaagcccactataggtatagactcaaataagttaaagaaatgaagaaatataccatgctaacattaatgaaaaaaaaacttaagtagctatatcaatttcacaccaaatagactcagaacaaggaaaattatcagagataaaaatggaaattacatagtgattaaaaaatcaattctctaagaagaacgagcaatatgaacatttatgtgcctaacaagagaatgtcaaactacataaggcaaaaacagatagaattgaaaagaaaaataartaaacccactattatagttggagacttcaacatccctctgtcagtaattaatacatcatgtaggcaggaaatcattagagatatagataacctgaatttacctaatcaatattaatagactattccacccaatggaagaatacagattcttctcaagctcacatgaacagtaaccaaggtagaccccattctgggccataatacaccttcataaatttaaaagaagaaaaataacacaaagtatgttctcagatcatagtagagttaaactaaaattcaataatagaaagatagctagaaaatcccaaaacacttggagattaaataacacactcttcaatcacacgtgagtgaaagatttcaagagacatttaaaaatattttgggccaggcgcggtggctcacgcctgtaatcccagcactttgggaggccgaggcgggcagatcacgaggtcaggagatcgagaccatcctggctaacacggtgaaaccccgtctctactaaaaaatacaaaaaattagccaggcgtggtggccggcgtctgtagtcccaactacttgggaggctgaggcaggagaatggcgtgaacctgggaggcggagcttgcagwgagccaagattgcgccgctgcaattcagcctgggagagtgagactcggtctaaaaaaacaaaacaaaacaaaacaaaattgaactaaatgaaaatgaaaacacaacttaccaaatttgtgggatgccatgaaagcagtgcttagaagaaaatttacattaaatgcatatattataaaagaaaagagatctaaaattaataacaatctaagcttctaccttgggaaactacagaacaaaaagcaatttaatcttgtaacaaaaaggagaaaataaattctaccaattagggcaaaaatcaataaaactgaaaacaggaaaacaataaagaaaattaacaaaattaaaatctagttactaccgaccaatatctcataaacataaacataaaacctctcaacaaaatattagcaaatgaaatctaacaatgtataaaaagaagcatacgccatgctccaacagaacttctcccaggtatataaagtttattcaacattctaaaatcaaacaatagtggttaactatattagtaagttaaagaaggamaatcatatgatcttatcaattgccaaataaatgcattggataaacttcaacgtccatttatgttaaaaactctcagaaaactagcagcagaagggaacttctacaacttgataaagaatatctcccaaaaaaaaaagctatagataacatcatctttagtggaaaaagactgcagcttccccccaatatcagaaacaaaacaaaaatacactctcaccacctgtatttaatatcatgttggaagtcctagctattgaaacaaaacaacaaaaagaaataaaaggcatacatatcagaaaggaagaaataaaactatgtttatctaccaatgacataactttctatacagaaaatcccaaaggacccaccaaaacatttctaagactaataaacaaataagtcacagaatacaatgtcaatatacaaaagtcaattgttttcctttatatcagccatctaacgttgaaatttgaaattaaagaaacaatattatttacaayagcaccaaaaatgaaatacttaaatataaatttaacaaaatttgtacaagaaatcttcaaaacactgatgaaataaatcaaagatgtaaataaatgaagagatattctgtgttcatggattggaagacttgctattgttaaaatgttaatttttcccaacttgatctataggtcaatgcattgtcaatcaaaacttcagcaagctgttttataatatcaacaaaccaatgctaaaggttgtatgaaaagacaaagaatatagcatagccaacacaataccataaaagaataacaacaaagctagaggattaatactacctgatttcaaaacttactataaagctacagtatgatgctaaagaaagaataaacacatcgctcaatagaacagaaagaaaagccccaaaatacasccacacaaatataatcaattgatttgtagcaaagatgttaagaaaattccatggagaaaggatattctttttaactaatggtactgataaaattggatgcccaattctcagcaaactaatacgggaacagaaaaccaaacaccgcatgttgtcactcataagtgggagttgaacaatgagaacacatgggcacagggagggacacatcacacaccggggcctgttgggggtggggggcaagggaagggagagctttaggacaaatacctaatgcatgcagggcttaaaacctagacgatggattgataggtgctccaaaccaccatggcagatgtatacctatgtaacaaacctgcacgttctgcaaatgtgtcccagaacttaaagtaaaataaaaaaataaattaagaaattgggtatccatatgcaaaaacttgaacctatacacagaccttaaaccttcacaaaaattaacacaaaatggtttatatacccaaatgcaaaactataaaatttctggaagaaaacacaaataaaattttggttttgaatttggtgatgagttttaagacacaccaccaaaattatgatccatgaaagaaaaaaattgtaagtcagactttactgaaatttaaaatgtctgatctgtggaagacactgtttgagaatgaaaacacaaaccacagaccagaagaaaatatttgtaaaacatgtgtctgggaaaagatttccacccaaaatattcaaagaactcccaaaactcaacaactagaaaacaacccaattttttaaatggacaaaagatttaaacaaacaactcaccaaacaagatatacagataccaaataggcatgtgaaaaatgctcaacatcattggccataagggaaatttaaattaaaacaatgacctaccactacatacctagtacaatgactaatatataaataaataaataactgtcaataccatttgctggagaaaacaacaacaacaacaaaaactctgtggcatatccagacaatgaagtaagattccattttaagaaggaataagatatcagccacacaaagacatcaatgaaccttaaatgcatattcctaagtgaaagaaaccgtctgaaaggctttatatatattattccatttatataatgttctggaaaagacaaaactatagaaatggtaaatagatcgttaggtgagaggagcttggggaatgagggaaaggagaataaaagagatgaagtccagcatattttttagggtagtgcattcagtatactgtaatggtatatacctgacacyatgcatttatcaaaacttataaaactttacagcacagagaatgaactttaatatatacaggctttaaaacattttatttaggagtttaggggatcccatgatggaatcagactgtgacaaaagaatctaactgtattaaaagtgtatgaagcaacctccctgaaggggatgtggggagtaaaatggtgtactaagtagctttgaaaatgagagaagtctgtaggattaaaggcaagagaaactgcacttaagcactgtgctgtagttgatataggaatttcccattgaggcatgggttaagaatttgcaacacctatataggtatactggaactaaacaattgtgtaagtggatggcagatggtgggagtcagttttctcattgttggaatggaagtttacatgcaaatgaagggagaaagttagaaatatcctggtggtaatggattagagttggagacatccatatgaactcatgtatagcttaatatagatagagatggttacatgtaggaatatttatagatatgtttatatgcacaggttagaatrtatacatacatttccttcctctgtcagtggagagggcctggaagcaatgacacctcagtggtaatgagcacatctaccactcacatcttggtttctaatgccgatatccaataaaaggaaccagggctccttggagaactgtctgagtctaacagtgagacaggaaatatacaagattagccttggcgatcttgtagggccagaaaataagaatgtgctaaaacatacatacatacacatgcatacacacacacacacacacacacacacacatatacatgataatgggagtatttcaaagggacacaggaaccaacaaaagagcccccgagggccaaagctggaataaattgagcaacaaaataaacaatgtaatatttatttataatccacaatataaaataaatatccacaagttcatactaatataaattaatgatatgtctcccatgcagagaaagtctacatattttatgaagataattcatcctcagtgaggaggaatttaattccccactccttaagtatgggcaacagcaaaagtgactttcttccaaagagtaaactatgtacagggggcaaatatggagaaacctcacaagcactacctcagccaggggataaagattaataccaacagtgataagttatgttaatgggatctagtaagtatggcatataacctctgtggtcttcctccccaaacccgtaatgtaatcatgaagaaaatttcagacaaatctcaattgagggacagtctacaaaacacctcaccagtattcctcaaacctgtcaaagtcatgtaaaacaagggaagtctgagaaaatgtcacagcaaggaggcacctraggagacataacaactaaatggaagatgatatcctggactggagaaacacctatggggagatttagaaagaatgaccaactcagcatccatgagcatacctcagggctagattatggtcttgaagtaacatatctgttttttaaaaaacaattttggagatatggctaattttagggctggaacaggaaatgtgctagatgagcctagaacatcttgtcctacaagaaagcaaggatgccatcaaacactattaggatcatatcaaaagaatgcaggagccacattatagaagttcccactgtccaaagatggaataatttgagctgcaatggggataattattaaaatacttatcaaaacccagcaaatatatttagctttatgagtttgtaatgatttttttaagtttgtagtgtttagtggatgatagggaaatggttgattatctggaaaacttgtaaaaaagtgagagaaaccagtggcttttcaccataagatcactaaatagtaagtgagggaaatatcataaaagtatcctagctataacattttaaagaaataaaagaattaaartatcatcatattccaacccataatgatttaatgaatctacaaattgagcatcagaggatgctatcaacacaaacaagagagacagccatacctcctggtgggggcgcacaccacctatggtcttgccaatgggatcaaacctaaatttggtcaggcctttgattccagcttccaattttcaggaattatagaggacagagaatgttgactaagtacacaccagtaaaatccagacagtgagaaatgctacgggtcagaggcatgtgtttttcgataaatacgttgtaaggaagataaaaggataaagagacaagttacagattttaagatttaaaagacaaatcagatttaataaaaatggatgagactaaactgtagtgtctataaagaaaggataaaactataaagaaatggaaatggaaagtgattaatgggggttgacagagaggattatcattgggacagggctcatggatgggcttttgtttttatttttatttttattttattattatactttaagttttagggtacatgtgcacaatgtgcaggttagtaacatgtgtatacatgtgccatgctggtgtgctgcacccattaactcgtcatttagcattaggtatatctcctaatgctatccctccccccatcccccaccccacaaatggatgggcttttggtgtgcactgcaaagttctatttcaggaattaatggtcatgaaaaaccaacacacggcagaacaaataaccaagagatacttttgtgtggttttctttatttatgcttcgttttaccatttttaaaaagttactaatgacttttgccaaatgtgggataggagtcctcccaccaacagccattggtggttattatgttccagacttattccaaacactaggaataaatctcaagacaaaaaaaaaagatgacaagaacaaaatccctgccctcctggaatgtataatctggaggaaggagactaagacataaggaatatataagtatctgtccaggtgtatatactatatatgtagctacttatagcatacgaaggtagacacatatgtagatatgaatatgccagccacggcgatagttatgtgttatccaagtaataaatcagaagaagggtaccagagaataccaggaaagaatgagtttcttgactacytaagagacaatgaggactagggtcctgaccgaaggcacctcggggtggcgagctgtgagtgttggtggggcctggcaggattcagccaaacctgctgggctcctctagtcactcttgtcaatgggaaggtggtagccaagaagggcccggccgtgtctgttgcttcctctggactcctagagctcaaggtgttaacattcctggcaaacactcaacaaacatcagtgtgacagtttgtgctggatagtgatggggatatacagtcagggtctctgccatcataaagctgaccatctagtagggctaaaagacaattagctgaacagctatcatatggggtgatgactattgtgataggaaaggtgtaagctgggattcgatgtgtgggagttggggtgaggcaaaagtagtccttttgcctctggggcaggcttcccagaggagatgacagtgacagctcacctggctcctaaaggagctcaccaggtcatggaaaaagactgagaaggattaaggggaggaagggctggaaatagagcattctgaaggataggagttgtgaagttcattgaggcgttgtgactggttggcagaggagtcttcattaaagcattttaatgaaagagatgatgtgatcagattcatgtttagaaggatcatactgaacggggatgatggagaggtgggagtgaaatctggatttgggatgaccaattaggaggcaactgcaaataaaaaatctggcacaaaataataaggagaagagagtggcagaagggtggacaggagaggaagaatttttaagatatttagggcagagagttgacggttcacagtgactggctggatgtgggggatgagagagatggagaagaccaggatgagcccgcggatctggacttggcactggacaggagaaggggccactgtcctccacgagaagcgagcctcacacttcccagcgggcctgggctggatttctttctaggtggtgtgacggggtgggggaggggagcaagccttgatgccctggttcctggggttcagggggaagagacctggaccctcacccagcagctagtcataaggagtctccaactctagaattcaaggtgaagcccataactgaaatacagcccacaccccaaccttacctagcgaggagaaaaatcctgacaaggaaggaaactgaactctgaccagacaatccatatgctgtgggaattgggtagcccatttaccccagacacagcaaaagctttctttaatatgtgctggttccctctccaactcattttgtttctgtttgatgctttgaaactaaacagatggtgggtgcttttcactcgcatttcttctgtcatggattttttttggcagatgagggagtttctactcatatgaccacagctaattcttagcccccaaagcaaaaattaatggactctggaaaaaaaaaaaaagagagagagagagagagacagtgcttacccagctctttcctttaatttccacatgcccacagatgttcctctccaagaagggtaaacgaaggaaagactagaaaatacttcttgggactatagaacaatgtatctggtctgcatgtgatgatgagaaagagacaaagacacagaaagagagagggggaggcagaaagggggaaaagaaaagggggagggagggagggaaagggaaaagaaagagaggtagtgacctacagagggagggagggaaggaagggagggagggagggagggagggagggagggagggacggagggaaagaggcaggcactgggtcttattattttctgtgcattatactacctatatgtatgtatttaacctctctgaaacctctgtttcctcatctgtaaaatgggaatgataatgcccacttgccaagactgcagtaaaaattaaattaaccaagcctatttctggcaaattcccttttggagtcacagtattttcatctgttgaaagggcttagaatatctttcttcagggttgctgcaaggatcaaagacactattgtacccatagagtctgtagattctaaagtgttgtccaggtgccatctttcagtataatctgagtttttgtttcctattgcaccacaagctgctataggctgttcactcatccccactgattcctgccttcccagcaaatgtcaaatcacaatatcaatacaaaccattttaaagacagactgcagagaataattaggacttaatgtctagaaatgatttggatagagctttgcaaaactagtcattctttttgagactcgatttcagaaatgaaaggtttccttgcctcttatgtgcaccaacaatgcaaaagcaaattcagaacccctggatgcctgagtggctctataattagataaaatgtacaatctgatgttataatgtttacatgtaaagaaataaatgaatgctgaggaactgctgcagagatttccagagaaatgtaatayacagtgtcagtacttttgcttaaaaagctaatcttgtaattaatacccttgccatagaactttaaagtgcttttggtttcctgaatttcatgatgaatagagaaagagaactaacatttctttaaatttttattatactactttatgactttgtttaatctcagagcctcctttaaaaggtaggcttaaaaaatccctgttttacagattaaaaagtaattctcagaggaatcaattaccttgcccatgaccacactactagttatgcttcagaactacaggttcaaacatataagactttgctcttgccactggaccacatggcctgtctttcacctccctttcccttttacagcaaacccagaagaaagccatttaaaactgggtcagggactcaggtgagttctgtgtgcaaatcctcccacacagccctatagataccctgatgaactccccgccatgccaaagattacacataagttcaatcgctaaatgagaaaaaaaaaaacatcaattttacaaatttccaaacaattgcccatttagcctatgcaaaactgtgataaaagctggaatacagaatgtggctyaagtcaagagaccacatggcctccatcctgaatctcttctctgctggccctcatatcccacagttaaactctggtgtgagatcctaccactatgatgctgcaaaagattaaaccaacgcactccaccagtgtcaaaggtgaatgaggcagacctgagacggtgccatctgtggccagagccagggttaagccaacctgggctttcttccttaaaggcagagatgccctggccaaagagaagagatggccagccctcctcccatagggtagatcaaggctctggcttccctgtcatctcagtggatcgaagaggaggagaatataagtgtctgaactgtgcatatatactgacctttaacaatggccctgccctccaaggaaaatgaggtccactgagcacccccgatagtttctggattagcccttcctccttccttggagagatatagtgagcaggcagggagatagtctgggcatgtaggtggaagtcttcttccctgtgaaggctgctgaggggaggagcagagtcttctcttcccagaaaaagcataagtcaatgaatacttattgagcaccttctgtatactcagccctatgccaggtgtcatggaagaatccaaaggaaagctgagccttgcaggaataacaggacacaccatgttaagtgcccataaggcagaaagtgcatagcactggcgacagactgcacatagttcagcattgyccagaccatggggtgcagaagggtgagggaggaaaaaaaaaaggcaggagagagagccaagagcagacactcaaggccctgtatgccatgtggaggtccacaggcagtggtggccatgtaagaatttgaggctccaactcagcgtctttcaaagctgcctttccctggtttgcttctgtctcacactttgaaaagagacatttttatactcgttggtttcctcatgtgaatgagccacatgagccttgcaattggccccctctctcatgggacttcctgacaaagcgatccgcctgcattctctttcatttatctccccctggtgcccasaaataatggtgtgttgtcagggagtgtttttccagcctgtttggagggaagtttcccatctgcctagagccctctgggaactcactgatgcaccaaccttctgttcttatatagaactcctacagagatttcttgtcaaggtgatccataaaatcaaaactttgctagtcaaaaacaaacaaaaaaaacctctaccaacaatagctgaggctgtgggaggagtcactttccagccttaaagtagcctcatcatgcagaggaaattgacattcttggttactctttccttgtgaatttcttatcccccctgctgccatgatgccatgcactcctgctctcctgcttatctaaccacacttcataaactccctttgctgtcttctcttcttccagcccattagcatcccccacagctcatcttgggtcctcttgattcttgctgtacacactatccttgggcaaatgcttccattccttgatctcaatcaccacctattccctccagcctcagagttcctcaattgtccctcactgcctggacatctagatatctgtaactgaatgatctacaagtaccaaacatgcattgtgtccaaaatcaactttatcaacttatctcctgtacagactagcttcttttcctgcatttaccagttacaataaaaaacattaatgtcatcgttaatgacttccctctctcaaataccctctacacatacatacaaaacacagattaatatacctccacatctttccctgcaccccccaattatcatactgttcccctgtgttcctccctcattaactcatgccttaactatttaactcttctgaacacgtttcctcttcacttcatcctccacctcccaccacagttgtctttcaaacacgcagatctgattacttccttctgcacattgcctacaggacaaagctcctgagcacagccacactgcctgggttactgggaaactctgaagacactggtcactcccattcttctgatgttttgctcatgctccccactctttcctacctgcaagccttctctttaaccttcacagcctaacccaatgtcacctcttttatgaagcctcccttgattccctttcctatttttcagttgatgtttgtttagaactctttatagatcccggaatattatataatagttcatcatttgcatgtttatattcctctctcaattataatcacctagatgaggaagatgtgtctttggccccagtaccctgatgcctgccactgtatacctgggaagaagacttgttgaataaataaatattatgatgaaaccataaaagcaaaaaagatgattgcaaacatgggagatctattactcaccaaagtgattagaatatcagaacggtataacagagtggactttaaattctggctctaacactgaccaactgtatgatgcctgggaagtttcttccctctgagccttgaatcttcatctggaaaaaaagagataaaaagacctctttggttcattctaaggaatggaaattagatattatatataaaatgctcagcatagtggctaacacataatcagatctcgatacattatttatactagtgttattaataatacataagaagtttaaggaggaggatagtaagagatggtgttaggaaaagaaggtgagttcaactttatttgctgaacacacatttatttagcactggccaatggaagatattaatgccagatgaataaacctcaatttatagaaaaaggagcagatataaaatttccctccacttctatcaaggtaccctttaacacctgcatcagtttgctgcctgaaatagagatggaaaaattagagctgccagtgtagracatgaatggctacacagagttgagaacaaagaattaattcccaaggagaagcagattgcatggtgataaataggttgatagsggagacaggagttaaagatgcctccagagatggagttttagatcacagactgactaagcatcctgacaccgagcacaggtgtccaactgacacaggctaccatgggacagagttttgatgagagtttgaaactcragatgtaaactcgagagtgatgctgatgccttggacaaggatgagttctccttacccatgtctcaaataacttatggtatagtccatgaaaaccacaaaaccaggaaccaacctgagcaacttaaaaccaatgccaaatccagttcttggtatcaggataggtggagggggaaatcttcayaaaacccaccttgaagggaaaagggtatgtgggttcatcccacagccagagtgttgatatcaaactagagtggtgtgttgccatgacagcaattgcctagtgacaaaaattaatargagggaaaaaatgggcaggagcaataaatcaagccaaatattctgtttttttgcaaagtttctcaatagagagagtgctctagggatgcatgtaatttttaaaaatctctcctgctaataacctttttcttggacaaacagaactttcaaagaagtatccgatgcaagggatgggaaaggaagaccaggaatagaatttcagtgttgctcagacaattgatgccaatgacccaacattctgtgtttccctgcagagtgatgccaatgaccatccagttctccattctgattatgctgcactcggctctggtcctcatcaccacagcagaggattataaatgtttgcccctcatcctccggaaaacttgctgttggattaatgagacctatttggcccggaacgtcatcatctttgcatccattttgattaatttcctgggtgccatcttaaatatcgtaagcatcccacatccaccaaccctctggtgtctagtgtgcagttgagcatgaagtttatggagcctgcagcttcctgcattacccttccttggtaccagttacctttatgtgcctggtccagccccaagcttagggacagataacaaagatgtggctactgccaaaactgtgcattttactgttggaaaactgtctatttcccagtgggataggttattttctccaaaggagttccaaaagcccttcaatttccatattgtcagtagccaattacatcataaataagagttaccatgtatcaagtaccagtacctacctgctatgtgccatgcactgaaggaggacctttacatatttttcatatttaatcctcacataaaccccgtgaggtaagtttaattatccccactttatggctgaggaaactgaggctcagagacatgaaataacttgataataaggtctgtctgactccatgacccacgcccctctaatatgctaaattgtatctctgggagtgggagtggggtgggggaaatggaaatgaaatagctgccatttattgagcacctactatgtgctacaggtaggtattattgtccccatttaatggatgaggaaactgcatttcaggaaagctgagtatctcacctatactttctaaaagtttgtatttcacgtgacacatagaactcagatgaatttccaactgccatgatatttatcactgtttaatttgctgacccacattgtcatggtttcattttttctcaagaattgtaccatggtagctataggtattttctgtgcttttacaagtagtctgtgttgtccatgactcargcagctagatttttgaggtgatttgtttggttccaggtcttaaacttggcttgttgagagaggctagttgaggcattgtcatgtggttgaatccatcactgtgccctttgggcctgarggagggtccccaagtgtgcagggacccaagctatagactcccacaattgttggcctgtgacttggagccctmgactrcctgaaatcactgtccaatttggcccagtaattaccttacttaagttctgtggttgtccttctagtgaaggctctgtggataaaggaaaagaggaaaaggaaaattatcatctaatttagttcatcatctaatgaatattttatagattatgataactgaaatggaagtacatgggatcaattgatcacaggctgcagagaagcagccaggaccttaaattaagtcttgataacaaattagatatttctggggtgcagaatttgtaagtaagcccaatgactgtaggtcagggttacctctgaggccaacygtgcctcagtgagtagtgtggtaggaagatcagaggctttggagtcagatagacctgtgttcaaatctcagatccaccagtcaccagctcagtgacactggacaagttactttacttctcagagtttcgtatttttcaattgtaaaatggggattaaaaatagcagctacatcacaaggtggttgtgaggcttttttgtacaaagtgtctggcacagaggaggcatttggccaatggtagttattcttttcctaataccacaaaatctcctgcagcaacttctgtcctaggaaatgcccatcaccccagtgctaagagtctttctggaaaatgtaccccttcagattcttcaagtcctcccagctgttgatctggagacaggctatgagtttacccaagacctcttctcctgccatctggctttctcttctgagctccacaagcacactccagtgaccttaaatgatggggccaacagagcagtctaaacttagtttcatgactggcttacaaaaggtctttctgagcaagcacttgttttttaaataaaagaaatcaaagctggcactttggcacttccattctgacttcaagtcccctctagggttcagtctacccaggctcgtgctgaagcccagccactgatagcacactgctccatttccagcactcacactgactttgttgttcctgtttttgtttttgttgttcttttttttttttttttaatccgcagctgtggtgtgattttgacaagtcgatacccttgaagaacctgactttcaattcctcagctgtgtttacagatatctgctcctacccagaggtatttatttatgagctccccttggtgagagttggacatagatatrtctctaccagctccaaataaacaagactggctgaagggccatagaaaatactcaagaggcctgttttccttcttctgcctcttcttctttcctttcttcttctttcccttttctgcctttccttctccccttatattttctgtttcccagtcctctttcctgtcccctcctctgcctctttttcatcttcaccccttcctcatttctttctccctctttctcttccttttcttccttttcacctttccttctatccattttccatttgcccttatctcttccttctctatgcatttctcctagcttatttgtaaaatcctgtagcagaatgcactgttatctctattagcaggcagagttctttctcaaacagtatttgctgcagaaggaaagagggagggagggagggaattaaggaacaaaggaaggaaggaaggagaaggaaggaaggaaggaaggaaggaaggaaggaaggaaggaaggaagggaagggaagggaagggaagggargggaggggaggggaggaaggaaggaaggggaggggagggaaggaaggaaagggaggggagggaaggaaggaaggagaaggaaggaaggagaaggaaggaaggggaaggaaggacagaaggtaggaaggggaaggaaggaaggaaggggaaggaaggacggaaggtagtaaggggaagaaaggaaggggaaggaaagaaagaaggaaggaaggggaaggaaggagggaaggaaggagaaggaaggaaggaaaaggaaggaagggagggaggaaggaagggagggaggggaagaaggggaaggaaggaaggaatgaaggaakgaaggaaggaaggaagggagggagggagggagagagggaagaaggaagagagggaggaagggaattacaaaggcagaaaattagaactaaacttaactgatacaaagagtgccagaagcaccatgtgttctgtaggcatcccaacaggccacctatgatcataatatgtgtatcttactctatgtttaccacagagccagtggtctgtttctgggccttggggtcagcctatggggtctgttattcacaacccagaactttacatattagggtagacattctgggtcataaagtagaacagttaacatgtcccagcagaccccagccaaccccatacctaggactctgggtagattcttgttctctaagaggctgmcacactcagaaggccctccaacatatgaatggagaaaaggctccctgtagtctcttctaggcctaagaattggtcccagaaacattccaacaaggagaccaagcctcctctccgtccgtccatttgcatagagcacctgcttgatatgcataacatcatcaaatccttcagatgtctggggtagaggctattactgtctccgtcttatagataataaaactagagctcagaaagcagcttgctcagtgctggttagggccacacctgcctgatcttatttcttcctcacttctttccctcccttcttctttctatccttccttccttcttttattaattcaattatcaaggcttgatactataatttgaaccatatctaccttattctttatcttccctggtccctagaggagaaagtagactctactaatggatgtgcaggacaggatgggactaggtcccatttaggagctgcatgggccagaccatgtgccctgggactcccttctacctaggaatgagtggagtcccagcttagtgtactctgtgggacaatggctccctgagaaattcttggtttgaggggcttagggaatgtctcaacttttggagagagtaagtggcccagaattggatggtcagagctaggcgaaagctggttttcgtttccaatcaagccccctcacttgctagaagtggaaccttgaatcagttcttaccctctctggacctcagtttcctcatctgtaaaatgagaaaattaataccttctttacatggctactgtggagttaaacaatgtgttctcatggtgcctgcctagatgggttagcaaatatttagctcttcacatggcatctgacatgaagcagctatttatctgtgcccacacatcactttgaattaatattgtatacccttgacctaacacctgaaccsccaaacacaagaccacagcactcagagattagcmaaatcctaagaaagtggtgggtaagatttttgatcacacagctttgtttcagtgcctcagtttccttatctgtaaaacggggataaaagtagggccttccttattggttaattacaagaattaagtgaattaatccatataaagtgtttagaagccacacctggcacaatgtatctgctcattaaatgtctgctatgatttatgtattattttcaacaaaagggctttgagcatgtaatgccaatgtatgttatcgtcaaacacctgtacatacccgaaccactgtgcgtaatatacccgtgtatgttatgatacaactcaacaacagaaatgtttaaaagtaagataaaatgaatatggattgatgttaccattttctccacaatgaaayggtcatcttgttcaggaggtcagcaaactacagccacaggccaaattcaccagctgcaacaaccacctgatctgacccaccagttgacattctgatacatgtatgtatgtgtgtgtgcatatacgtgtgcatgtgtatgtgcgcacacatgcttcactgactaggcattgccaaactaaaatggattagatattcagaccttctgaaagagttaatccaactccccagcactcatatactcacaagtatgtgtccccaagcaaatcgcttcatctttgtgatcctcagtttcttcaaatgtatacctgacatttctgcctcaccctatgagaaataatatccagtccaaaaacatgttatcaaactggatgatgtaatacaaaaaatgaggcttttacaatgtatgatataaagtataacttggttctaaattcgaagcttgtcagatgctaaaaaagagtgaagatgccaggaatgaaagtaaagaaagctatattccagtcatggttggagagtagtcaaggagaaagaaaggcacaggtttgtgaaatgaatgcaaatcacatgcacaaacccagagtgtcattatctcaaacatctggatgtggttctcaggagattcggtgggaagaccctcactttagaattacgcccctttattatatgctctggcacatctgaataaacagttcactgtatctgcaagagcagtcagagcttgctatggttttaaagggtcctgaagagcccatttttccatagagatgtgatcatctgtgtcttggcatgctggcatttccttccctttcttctccatttattcaggtcctacccagccttcaagcatccctttttccataatgtggtttgacaggcccaactccttcaggtcactctccttcctgccatctcacatacccttatggtgtcatcttagcattcacactccatccttcctacagttgatttatttatctaggacaycctttccatcctgtcaaatttattgacgtaaggagtgaagataatattgtatagctattaaagattgactaaagggcccagcacaggacaaggcccacaatctaygttttaaaatatttaaagagaaaggaagcattcttccaatagactaacaggaacaagatttacctttccatctgaaataactaaaaacaaacaaaatatatgaagcaatagttttcaaggcactgggcatcagtcagtaaaggacaataatcctgaaagacaggaagcaagtgattgcctgagctttattattgctttaagagaatttttagactatggctcaggaagaggaaaccaaggyggactccctgayttgagaatactaagctgagagtcctgggagaccaaggtggctacagtctgcagaacatactactctggagagttgcatagagagaaaaacctagagatctgaaaagggttcaatcagtgcatgcatgtgaggaaactgacatgggaaaagaaccatctggaaggatcagtacctggaactcacacagagctgagaataatttttgttcccaccagtcagactgagaaagattcatggggtagtaggttagagtattcagaaaagtcttgcttcagcagagtaaaatcactgtttctacatcatatgctgctctgatccttcctttaaaatcttaaaagttagatccaaagagatcaaaccttttaaaataatttaatatgtgtcctagaataaatttcaagaatatgtataggaatacaaaaatatctaggatttaacaaggtaaatacacaatgtctggcacccaatcaaagattactggcatcaaaaggaggaggaaaatatgactgataatgagggraaaaaatcaaccaaagaagaccaactcagatttgactgagtatatttgaattaactttttttttttttttttttgagacagagtgtcactctgttgctcaggctgaaatgcagtggtgcaatctcggctcactacaacatccacttcccaggttcaagcaattcctgtgcctccacctcccaagtagctgggactacaggcatgcaccaacacaccgagctaagttttttattattattattttcagtagagatggggttggccagtctggtctcaaactcctggccacaagtgacccacctgcctgggcctcccaaagtgttgggattataggcatgagccactgcacccagccaggcaaataattgctataactgtattcatgatagacaaatattagatagtgcagaagaaaaaaagtgaaactgataacatagcaatataaagtatccaaaataaaacacaaaaattaaaaaataataaaataaaagcagtactggggacaacttcaagcagcatactatatgtgtaattggagtcctagctgctaacctaaaagaaagactaagagaaagatgaggagattgaaaagctatttaaagaaatggtggcatgagtttttccacatttgttgaaaaccatacatccacaggttcaaaacctcaatataaacacacacacaggcacacaaaggcacatcataatcaaattactcaagccataataaagacaaaatcataaaatgggtggggggaacatattgcatagtaaaagacaatgatatgaataacagcagatttttcaaaaatacaaccatggaaaaccagcatcttgaatgaatcaaaggaccactaggagtgtactagagcaccaaccacatacaaaattttcttttcccctaattaacacaacccagtgaacaccctggagagtcagaccagccatcttcccatcaccytgtggtggtccccaggtttatgatgccctccttgctcgacattctgcagagtctaggctggtctcagaagaagcagagcagcttctgtcatttgcctggacacacttcactgtgttgcttatgccaagagctacagttgctaagaatcagattttgtgtaaagcaataagtccagatgatttctttaaactatagtgacttttgaaaattgtctgcttgatttcttttcttcttgtctcatgagttcatgatgttatgggattttggcagcaaccagatagctccagggagtccagtttgtctgacttatgtgggtagatgctcaattccctcgtcagttatcattgtctaaaataattcttcttcctcctcttctaagagtaaattgtgcatatattgccaaggcaattcatggtgcattgacaatgtccttccagcctggcacagtttttggtgtgtagtgggttctcagtcaacaattgtgggaaaatgcatgatttagtttgtaaactgtttgtttcatggaaacaggttcagttgttgctgcccttaacaccttgtcatatcatgagattccaattttttcagtacagacattgaagaaattgatctcccaagccagaatatctatctgagagaagaaaaccttgtatattcagaagaagaaaagtgttacatatacttcctctcttctttaaagtggacccaagaataatacctgtccttgggtcatttaaggagttaaatgagatgaaacacataaagtcattcaaagwcattcacagaatacgtgcccaataaatatttaggtttaattgttwcatctactttccaccaacttaatcrctgatttacagacatccccaacccagctggtccctccaccaatcttacctggagttcatctaatgtaagatgaatctggtctctttcacacctccacgtctgtaggggttttttgtcttctcctgtctacattttattttacctattgaaatgcctttgacttctttttcctaaccaattttttttaacggtaaaaactgaggtgtcattatatactttcccaaggcaaaggtgatgcacttacaatgcatagcttgtctgcttcctgtatcagagrttgctgggaactttgctcactacctaacatttctcatacaaatcttggcattattattttttatcattaaaaggtctgggaaaaaacagagaaccccattactatatgggagtcagagttctctggagtacagggatttaccccaaaacactgtattcaacctactgtttcatttgatattgcacattaaaataaaactaaaggacattacaaaaggaaataatccactcaaaagccatgtcatgtctgtgtagacatattttgcattcttgtaatcatagtatatatataattttacaccctgctttccagtttaaaattattttgaaaactctttgttgtcatttaaaaggctcctctgaaaactcttgtwtatagagctctttattcttcgggcacatgtttcttcactattgtcttctagttctcctcctcacatccccaaaaatgcctaatcaatattcttatttctcttcttccacagtccttcaaacatggtaggctctcaatgttagtctctgtatcttctgtctttacttgtattctgcttgagtggtttcttccacacctgtaagttcagctgaatgatgctaaatgtgtgtctccagaccccatctgccttctgaaccccagcctcatttatgtcattgctcactaaacatccttcctgaatcaccccttctatacctaaagcttgataggcctaaaaaaagaactcactgccttttcctcatactttaagttttttcttacttaatagattaatacaaagtggaaatattagtgctacctctgactcctctctctttcttacctccccataaaactagacaatgttgtccaacttttatatcttgctaagtttattgggtatatttgccaagatcttgtctttaagtcctcagcttttctcaattaatcctgatacatcgtatattctaccctaccgcaatttatttcttaggcactgacctaatgaatccattacaagcaagaaactcatccgtggttccttacggactgcagaataaagtacagatttccatactagaggattttttacagtgtggttttgccccttaactctgtcctactatacctatgagccccttatacccaggatccatttaggggacactttaggagctgtgggccttctaagttcctggagtaatataacacaaaaattgcttgttttttgacagaaactaagtaattgcattgagcccagtttcttcccaagttacaggacacatgcaatttatgggtccagacccagcaaaagagaaatgttttcacaaagctttcacaaagccataatacttctgtagcttcctgttgttctcccatttcctggtcccaccccccactattcactcaaggtataaaaagcacagaggagattcctctgatgttgtccaggggcctcattctgtttgatgtcccacggttcatatcacctccaaaaggttcacctttctactttaaagtaaaaagttacctaaaccatgcaaggcagtgggtgattcctttagatggaatgggggataggagtaaagaaggcaagagcatgctgccacaattgattgaggcaacaaaacgagaaagacccatcaacacattgtgcaaatgtacaattatatttgcctattataccttcagcagccttgttagagaaaggaggagggcaacaccttcaaatcttttcttctgcttgtgttactagttctctttatgagtagttgtatgattctctaatatgacctaaggaatcaatcctcctgacaccttgttcctttacacttttgcattcatgttattctgtcttcctaaaatgcccgtycctttccattttctactgtgtgaaatcctctctgtccttcaaggtccagttcaaactcatgtcccctgtatagccttcttcagatgtgcctgcagaatgcacaacgctttgtccttcctctgtacccacattgcatttggtcacattgctggcaaagcactttccaccatgattattgtttgtatttttatgtctgctttacattttagaccacgacttcctttaggcctgggccatctcttactctcctttgaatttccagtgcctagcaccatgtcttgattgtaataggcactcaataaatgcttattacattttataaattaactgttgtgaccacataagtttttgttccaaggacacaatcatttcaatggctttttatccaataaatgattcataatttgcaaaaagccatgcaccgccccttgttgtgatacaggcaacaatgaaacaggacccctcagatctagtcctctttctttggcctttgtcaaactggagggccttagagtttctctggagcagaaaatgagctctggagaatgaacttcttattgcccagtcacttcagacacagcttcctatacagaggcatcaaaatgaattacctaaaaatcttccccaagatcttaaaggatagctgaagaaagcctatcatcccatttgagaccagaaaataattggatttcttggaaaaggaaaagacagaagtaaaggagacactagacactaggctcctaatggcaaggaaatgcctttttcacttatgagtccaccccatgtaccacaaaggcatggggcctttgccctctgagagaacacagtcaggacactctccacacttgtcaatgtcaacatttgttgaaaggatgcataaattagccagctaggcttagaaatctgtaaacaatcttcagtaattacttagacatttttggaaattcttacccaacacccctgcccatacaaaaattgtctatgtaatagaaaagacaagttgttacaaacagccatgtataacaagaccaaaaagaattttagaaattatcaagtccaatattttaactagagtcccatttacgtgaattggttatatcctggtgacctagatgccactttatagccaagagatcttggacaatttacttaagctctatgaacctcagtttcttaacctataaaataggaattatgactcccatcttgaccagttactttgaatgttacaagtgaaaatgtgtatagagatcacaatattgccacaaaatgggcctttgataatgcaagttttattctttttgttttttgttcctgatagtcagagtctgaacccaccatccagaatgatatattaggatacttctctaagggaaggaataggctggggagcttcccataaaaggctgaaatctggtggggtagactgacacctaagggctactctaatattccagctcttggctaattccaaatttgcaatttaagcagttacttctaatacagggtgataggtgttatgctggtctatgcagggtgctgtggaggaatgaagcaagatccaaacgtagctggagatattgaggaagtcttcttagaggagagaacacctaagctgacatttgccagaagagtaagccctaggcatatggatgagagtcgagcaacagggccctgggacttgggagaagggtttagagaatgaaaggaaatctgatatatgatggccttgtgagctttactattcagaaaggagaatataatttgagatagtggagagccatgaaagaacttcaagttaagaggtgacatgatcagatctgtgctttagaaatatggagtagagaacgatatgggtgtggggtggggactggggactaactgcagacagagctgccaaaaagctattctagagctgttggtgagaactaagacagaaacagtgtggaagaaggctggctgaagggaagatctattaaagaagaatcagccaggcatggaggctcatgcctgtaatcccagcactttaggaggtcaaggtgggtggatcatctgaggtcaggagttcaagaccagcctggccaacatggtgaaactccatctttactaaaaatagaaaagttagccaggtgtggtggcatgtgcctgtaatcccagctattggggaagctgaggtgggagaattgcttgaacctgggaggaggaggttgcagtaagccgagatgataccactgccctccagcctgggtgacagaatgagaccccatctcaaacaaacaaaaaaaagtagaatctaccaacttaggatggcctgtgtagggaagaaggcaacaaagatgaaaccaaagttattggcttgggaaatgctatgaatagtgatgccattcagagaagtagggcttggcagtaggcaaatgaagagtttgatttgggacctgttgaatttcaggagrccttgagacctccaaatggaaactctctgcaaatgtgtgtaagacctactagcatccatggctaggagagggaactgctgcccccattgaatctgaccacctgcattctctgtttccagtactttgtcttcacgggggtgttggccatggtgacctgtgcagttttcctccggctgaactccgtcctgaagctggcagtgctgctgatcatgattgccatctatgccctgctcactgagaccgtctacgcaggcctctttctgcgttatgacaacctcaaccacagtggagagtaagtgcccaccaccgtgagtccaaagtgtgctcaacttcctgtgggaagtggaatygttgggaaaatgatgcccgctgcattactaaaacttaaggcctgattggatattgacttatatctcaaatcaggcattctgtagttyacaagtccaagcaaaaatcctgacttttcagtggtatcatttatatgaattacagatgaattaatcaaagtttggactgaatagtagctcaggtctcctccaagtctgatcacttatgatttcttcaaatttagtggcttcaacacttgtaggatctgtttgtaatttggctgtagcaatattaataatagcagccactgtgtattaagccctcatgctctcccattgcatcgtacagttggacctccatatccacagcattgtggattcaactaacttcagattgaaaatactttaaaaaaaattaaaaatattacaaacaaaaacagtatagtttaacaactatttacatagcatttacattgtattaggttttataagtaatctaaggatgatttaaagcatgggggggatatgtataggttatatgcaaaattatgacattttatataagggacttgaacatgcatggattttggtatccacagggctgataccaagggacaaacgtattactgctgaaatatagaaaagtacaaaaaagaatatcttacccagactccttagagaaaaacagcccaaggcaaggctaatgaaaccccaaggcagtgaaagtgagggaaaagagaagtgaggaagaaaaggatgagaggcgaatgcaagctaccactacattttgctggcaacatgggctctgaagagattcagctggtgccttggaaaatccactcgcagagccatttgaaatgcctctgggcaggctctaaggtgggaaaaagtgtctcaggacagaggaaggcagaaaaatatgtctgctggctccttccctgtctctcccattggcaagagttccctttttgcatgcactttctgatgacatcacttggaccctttcacagctgctggggtaaacagaccccacacaagaagtgatggaaggagccagtccaggctgattggtctcaggtattggaagcacacaggactagctgaggccagaataagtggccaacagtcaaaggaaaagaataaggccaagataatccaagaaggctaagaaaatatgcccagaactaataatatgaatgtccatgaaccaagccctggaagtaaacaatgctaacaactagtcatattttcttatgcatttttaaaaggataatgtgtttcagatgttgaaattcctttctctagtattattctcctctctgtctcctcaaatccaacttctaatgtactgaatatatatccttcccatccatgttatatatataatgtatacatacacacatatatacacacgcacatataaacacacacatatatttacatatacatatagctaggtctgtatctataaattatttataatatttactattttgttgtgatgtaatattatctttctagatccatctaggttgatatatatggatttcattttagttgttgtctgtacatatgaaataacacaaacatcaaaatatgtttatcctttgacctattaatagagacatttaggttgttaccagttttccctattataaaaaatgctttaattaccatcattgatcatatcttctggggtgtagacataaaagcactcttgttggattgtagggtatctgcgttttccactttttaaaatattgccaaattgctctccaatgtgactgacacgattttcctcttacaagcagtggtcctgttgctctcattcccacctacactgttagatttttaaaatatttgtttggttgagtgtgtgttttattgcactgtttacacttgtgcttctctgattatgtgtaagcttgctcatctttttgtttatttgttggctatttgggttttattttatgtgaattgccagctcatatcctttacccagttttctgttgggttattcatcattttcttgttgaatttgtaagagttatttttgtttttaattaacaaataattgtatatacttatggtataaaacatgattttttgacctatgtatatgtggtagaatggctacatcaagctaattaacatatgyattacttcacatgctttttttgtaggtggtgacagcacrtaagatctactctcttagcaattttcaagtatacaatacattgctattagctatagttgccatgttttacaatcgatctcttgaatttatttctcytgtctaactaaaattttgtatcctttgactaaaagctcctcaatttcatgtcacacacacacacctcaagtctctggtaaccataattttactatctgcttctatgagttcaaaattcttagactccatatataaatgataacatgcagttttgtcaacaagagtaggcctaccagtagtgaccctgtgctcagtttgctcataggtaaagtgacatatatatcatctgtctatattagtcagctcagttggccaataaccaaaataccacagactagtataaatatcagaaatttatttcccacagttctggaggctgggaagtcccagatccagattctagcctggctcatttcattaacataatgtcatccaggttcatccatgtggtagcaagtggcagggtttccttctgttttaatgctaaatagtattccattgtgttcgtataccacattttctttttccatttatccactgaagaataatttcagattgctctctcatgttcattgcagcattattcacaatagccaggatgtaagagttctttataaacttcagatactaatgtctaatttacatgtatatcaagcattttgtgtgctttatttaatcttcagagtaacattctgaagaacaaaggctaagaaaagttagcaattacccaggttcacacggccagtaaataacagatccgtattcaaacttgggtctttttgactccaaagtccactttttaagtactgtgtgcaccgcttttaaatcatactgaataacattccaccatattccaagggttcaaagaaactcaaaacattttcaaattaggtaagatggttagtggccatggatatatcatggccatgcaaaaatgaacacaaaagagggcaaagatatgtatgaacaaaataagccacctttagagtaaaaataaaagtaaaaccatctacaatttatggaattaaaggcagacacaacattaacggaataagctgggtctttggcttcaaatctagactctgttgcatatgcaaagtcatatgaatttgaggggagacaattcatttcatagcattgccctagggctgctgtgaggctgttatttgcctggcacatagcaggtactcaatatatgttgattcctattccctctctccttcttatgagagaagcttagttctggattctgtttggaggtcttcaggaagagtttgtaatcaaattaactaagatcatgaaagtaaatataactccaggttcattgctgctggcgatcaagtgcttttttcagctttttcctgacttgagaacaatcattggctagtcttctattgccttactctttgctatcaatggaatgaaatcaataagaaatgaaggaactcagccagccttccatctcagctgtattataaatctacaggtcgatagtcactcggtagtgaattggcagtcgtaggctactcacgctgtttggatttaaccaacactttaggagttcacaatagttcaagaatagtttttgctggttgttcctatacattaggtatctggggaaaacagataaaatgtaaaaggtagcacagaaaaccctggacacaacaacctggccgcatcttcattgggatggccctgaatacttcacactgacatctcccaatctgctcgtcaaactrcctgtcccacaacaaccctctgatttagttcatgatgcccagcccaaaacaggagaggcacccttacccctaacatcttagcmgtcactagagacccatcttcctcagcatttcttgtagggaagcactatatctcaatacttgtgagtacaagtttaggacttaaaccaactgaattgaaatcccagctgttccatcaaccagatatgtgatcttgatcaaattratttaaaatgatttaacttctctaagccctgtttttctcatcagtaaggagggaataataatagtccctatgctgtagaaatataaaaggaaacaagtgtgataatagaagcttagcacaggtctggcatatgataagcacttgatatgtgctaatgtttgttattagacatcacccctccatatcacaaatgctgccactctggaaagatcctcactctcatctctggactgatgtcctctaactgatctcttaaactccactctcaattccccctcctcaaaggcatgtggtgaactcatattctttctaaaaaccctttaagagcttcttgttacctctaagaagttaaattttcaaaccagtttacttaggatttttaaatctctccttcatctggaccacactgactccttactacacaggtcaacatttataggctgtattcgaaccatgggaaatcacgtcttttctcaaatgagcttctgcacatatatccccctgcctgatatgtccatctccctgaatgattccaacctatcattctctagacccaatttaaggacactctccttggcaaaaccatctttggccattcctcattttccaatctgtgtacttaagtgtttattattgcatttacctcactgtgttgaagtaactaattttcatgtcttcctcttccattaaaataggaaattttgaagacaaggaccattactcatgttcatatagtaagcacttagggttatctggcaaggtgtccaattaaatatttgcagaatgaaatattaaatgattgagtgactgaaagaagcattagctcatttggaatcatattacatcattgattcacacacagtaagccaactatcattcacaacccttaagattttttctcattattgcccttataatatgtgctcctcaacctataagcacaatttgcttttggatttgtgtcatacttcacatttaatgtggtttttttctatttgcccaagccttctggcttgttccaaagcayttagtgttttgtcctctcatagtctytattacttatgtattctaactgatcaccagaagatactatttccacactacctacaccttgttgacttcttaaaacataggcaaaatactggaatgcattaatgcattgtaattcaggttagaaaacctagaattgagttctggcacctgtttccactcatcagtgggcatgtttttaattcagggaggcaacaaaatagacttaataagagcatcagttttgctggtcctaacagcaccttgtaggtgatgtgctgggagggagtctccctcacaaacccaccctctttttagtctaaagtttggaagaggcaatgacagtgaagtggctatgttgtctggggtagatacccaaggttcatcacctcatgccaggaaaatttaggatatggacacacatgaggggtgtaggagtggagatttaataggcaaaagaaagagaaaggaaaacagctctctctctattgagagagaggggactcctgagaggaaagaatgatcagggacagatgcatcagattttataatcaggtttgaggaaacagtgtctgatttacatagggctcacagattaattcaatcaggtatgacatcatatcatrtggggaaagctgacccctccaccctaatattattatgaaaatgggctttccagttgactggtgccatcttatctgctccttactgtacacgtggctgacaaagagaagggaagatggagccaccattttgaacatgattgtcacaatgtcagcatctatgtctgcagcttgatttttacaggctttcctttgttagaaaggaaaataatttggggctgcttttcaattagaggaaaaccttactgaagacttccatgccctcactatctgcctaagtaatttcttcttaactcctgtatcgttcctccctctggattggtaaccctaagtgctgttaggggtgttggatgacaaagstttctggctacttcctgctgaaaagggcattgtgtgaagaacagcagctagggctcstcctggggtaaatctaagggtccttggaagaaaggcatgttcatgcatggttctgtctacagcaccatttggagtttgattgctgtcagccattccagtgggttgtaaaactggtttacctccaccagatgttgctgaaatgtcaatatagaagtaacattccttttaggataagtggcattggatttgggtggctagagtaactttagtgttaaccttggctaaatctttcctgcaattattaatcctttcatgactaccatagaccatgtaagacatgcttaaactttccaacttgtcccaaacatccttctttttaaacaaccaactattctttttaggacaagtatttaccttccttataatcctttcatgacttccatgaaccatctacaacatgtttaraccttctgacttgtcctaaacatgcttcttttaaacaaccaactattgtctttaggacaagtatttatcatacaagatcctttcttacataaaatctctttcctttataaacttcttttcaaagccagggtgtgacatattaccaaacccaataaraagtttacagttcacaatctaaaacaaagatgataccagccccttcctaagatatacttccctcttacctgggaaccagaccaagaaactagccacaagattagaaaccatggcttaggagtcacacagctagaggctacaagattttgaccctctctaaactgctctcaagatcagtgcttaagatattttataaaccctgcccttgatggatcagcttgcctacccagatcgataaactggcttatccaggcacggtgttgaatgtgccacccatggttgcaggcgtgacctcggccatggaaccagaggaactaggtaattgggatttgtcacgctcacccatgcaactctagtgctctgcctgtgacttccctttgactatctagacttttgtgacctgcctggctcccccagccaaaaagaaatggatctcaggagagactacgtgacatttgcacttgggcaactgttacacttccctcctttataaaggaagtgtgctggtttgagctctataccctgccattatcacctgtgctaaagtgttcaccctccaagaatggttctggttaacttccaaacttaaaatccccttactaagtaagtaccattctaactggaggcagaataggtgccttaaaaaatgtaaggaccaaatggccatttacctactgatgggacagtattgagactaaaatttggtttcagaagatattttactcctaattgttgaagacagaattttcccattcaccaaagcagcataaagcctggtttttagtagaggggcacaaaaagggagaattgggaagctagggtgtttcagaaaaagaccaacaatctgcctcatggaaaggatccctattccactaggtggcactgttaaccttgaaacaccatgcggtttccagtccaagggcagagagagacctggaaatgccatgtggtctccaggccaagggcagagagagacctggaaatgccatgtgctctccagaccaagggcacagagtgacttggaagtgccatgtgccctccaggccaagggcagagagagacactcactgtgggtgggggggaccctctgttcctcaaaaatcacaagtacgccttcccttgagctatatgcctagttactatgacattgcctaatcttgccaaacaagattacttttgtaaaatttcccccacattgcatacacagagaggataggagacatggctgtctcagacaggaaaggaggaaactacaataggaaagttggagatcctgttgccaacaccccatcaggcagttggaggctggcgtcagttcagaagcctttggataaccccgggggttagccccagctggaaatcctcagttgctccagaacctcttccagccccacacgaaggctaagtcctccttgaaaggaagccggttcaaacacagccaacatgcccagtaaccaggattctccatgttctccccagtaatgatcgtatctgagtctttaagaacagcagcaacactaaccatatttttaactggctgacagatgcctgttattgatttgattttatttagttctaaaatggaggctgagagctccaaaatgaaaggatagagttggagtccactcctctatttaccatttcaatgaatgttgtaccttggtatcccagatgaggtccccaatatgaagcagctacattgtctggggtagacacctgggcttgtcatcttgtgccaggaaaatttaggacacagacatacacaagtggtttaggagtggggtttaatagacaaaagaaagagaaaggaagagaaaggaaactagctctctctttagtgaaaagaggggacttccaagagaaaagactggccagcagcagatgtgccagattttatagtcaggtttgaggaggtggtgtctgatttacataggctcacagattggttcgatcaggtatgatgtttacatagagcatggggaaagctggctgccccaccctaatcttattatgcaaatgggctttccagttgaccagtgccatcttgtctgctccttactgtacacttggatgacaaagagaagagaagatggagccaccatcttgaacatgattggcacaacttgccagcatctgtgtctgcagctggattttacaggctgcccttgttagaaaggaaaataatttggggatgctcttcattaaaagggaaaccttaatgaagacttccataccctcactatctacctaagaaatttcttcttaactcctatatcaacatactcatactactcatctgcttccgcagaacatcaagaacatatattttaattcaacaaaacatcttttttttatactttaagttctggggtacatgtgcacaatgtgcaggtttgttacatatgtatacatgtgccgtgttggtttgctgcacccattaactcgtcatttacattaggtatttctcctaatgctatccctcccccaaccccccaccccacgacaggccctggtgtgtgatgttcaacaaaatatcttaagatctactgtgcacctgttgttacaaagaagatgcttacaaaagcaacaaataccacctctgccttttgttttggtatctagctgcctcccaccccatcccaccccaaatacccaccgctttattcatgacactgctgtttccgctttctggcatctggaggctaacagcatgtgtaggggcttctcagaggtctccaggctgcagataagccatggttaccaaaataatcattgcaagattataccaataatgttagatgttgaaggcatttcagacataaaatgtactaccagatgagacataaaatgtactaccattctcatgaatgagaatgagttagaatagatagtatctaggaaaaacacttatctaaaagcattkggagggaattaaagaaaattggcacaggcagaatctagaagccatgtggtggagaaaagattttttctgacctaaaattgttttagtttgatccccatttgtttattacatcggaaakgttcatttgtccacacagtcctcataaataaccagaattgtaaagactgatgatagtggccatatatcaattttctctcatatatatacaatacttaatagttcatatgtctctttctaatttatcatctcatttaaacatcttgataaccttttgatgtgagtgccatcttcctcttttcaaacataggaagattcagtcttcttttaatgatagggaaactatgaactactagtatatgacaaagccagttctggaatgccattctttatgccaaccatgttcaatgtacttttcactgaaccatttccaattctactctcatgtttatacgagaatattcatcaaagtgaaaataaccctaggaggtctccaactttgttgccatgcccagtactgtggctgaaagatcctgcggaagtagtcctccaggataatttcagtccatgcagctgagtctctttagtgtctcaggatgaccgcctgtgtggccactatgctgatggatcaataatgaggcagagagacagaaagaccaggcacagaccacaccagagtaaatcaatcaaggtctgctcaattaaaaagtaaaaattaggtcagtataggcaggacacagcgaagaggttagccacattcttcaaggaagatttaagatttccatcctcaagtgcctcatcagtgaccatactgttgcagaaaacaatgtctgcataaagacacatcagactttttagaagcagaactgatcttctctaggcccagccttaaaacaggaacttttccaggtttatgatggaaactacttcacttgggccaagtgcacctcatcagtctgagttacacaacacaaaatatgaatacaaatcacagggcacagtacacttgaacttgggcacacttcccattcatcatcttcagcctttcaaggcaaatgccacaaaagtagaattaagataagtgatgcagatcttgctacccaatcatgaaaacagacacctgcaacatttcagcgttgtataacacatcagtccttcctacagagaggggttggttaatagatacaaaattcaactagataagaggagtatgtttagtgttctatagcactgcagggtgactataattgacaataatttactgtatgtttttaaatagctagaagagaggattttgagtgttcccaaagaaatgataaatatgtgaggtagtgaatatgctaattaacctgctttgatcattacacatagtacacatgtattgaaacatcgctctgtgccctataaatatgtacaattgttacacatcaattaaaaataaaattaaaaagaatcaagaaggttttgggatgcacaaaaggattttaaccaatgagaagttggggtaattcaaaagaacactgtctgctacaactaaaggactagatggggacaagaatggatgcagaaagactatttgggaggcaactgtaatggccagcttcatggatatgtggcctgtgcattcacatagggctctgcactcagaagggccttgctttgtttaatgccctgctttcaccatcttgaaattctctaaaaaaaaatttcaagaaacccctgcattttcattttacagtgggtccacaaattattgaaccagttctagctattgcactaatccacatgaaacagcagggtcaataggaggaatgaacaaccaggaaataatccacgtgtagagtcaaagccaaataacatttgtccaacatcacacgaccttcgtgaattcgtccatgtatccattcaatacacattacattgttttctgtgggtttttactaggccctgcaggttcatagatgaataaggcattatttttatcctttaggaccttaagggcaagcaattrtaagtaggtacacagaggagggcattgtagctactgaaaaataccactgagatctgaattgatagctagtcttcactgttcgctagctaattaagttaaattttttaacawctcagtcttggattttttttctagaatgggaataatagtatcttgattgttgatatgacaattaaagtaggcagaatatgtaaagtggttattagagtatggcataaaattagcacttacagtcattattatgacaacagaataaaagataaattcaagctgaatggtttattatgagtgtcatagaagcaattgggaactaataataaactaaaaattcggggtcaaatgtgctataatgaacatgctgaatttggtgcctgagmtatgagttctcatcctggctctgacacaaatgagctatgtgaccttgggaaaatgactactcctccgtgggcctcagtctctacctgtaaaataaaaggcttcaagggatattacattatgtgtggtgcacataatatgaactagaataaatctgctaagtgcacaaaaggtacttaattacttgaaattattttcataatttttagtaagtctgaagtagcttacgaaacartatgagagctatgcaatcctaaatttgtaaacatacttttttgtatggggtaaaaggaaatgacatttagttaactccaaaattttaaccattgtcttctctgggtggtaggcttaagggcaatttttatttttttatatgtgcatctttattagtttccaaactcactataattagcataaatatttctgtaatgaatarcactcaaatattaatttttgtgatacatcagataagatgatctctaaagattgttatagccctgaaaattacattatgctacatgggttttcacttaagaatgttcctttctattagcataaagagatgacagtattaactcagtgattttattaatacaaataaattagttcaacatgttcttggttttaagtccctggcaaccaatattaagcaaaacattataatacagtacagatttcagtcatttggctctctttggaagttctttaaggaatcattgaaactacaaaaataaaaactttctaatttcaaaccacagttctgatgctcctcagcctrgctgacttactgtgcatattctgcagtctgtgctcaggctgttttttccatctgcaatacagtgaatgactcaaaaattgttcataatttttactttttcttctgagttttgtctagtcatctttctatttttggtcaatcactgctttcaaaataattcaagaggtatttgtgttttctcttgaaaatgtgtttcaaatgataaatttctgggcttaaagtcttctgtatggcaaagcaaaggatatccaaagtgccrggcagagcagggatttgggaagaagtcacaaggaggagctgaacgcaggacatgctcattcaaactaagcaatgtgaacaagtgactttttaaagctccaccaccatgagcaagatgatgtgtcaggtgcttcacagggtggcaagggggaaatgtgggccaggcactgtgccaagcacataaccatgattaactmatttaatcctcacaattatagaggtatacactattaaatacattcaactgaggctcagagatgttaartgacctttccaaggtcaaacaactggtcagtagaaaagctgacattggaacctggatcttcacgagtccaaacctcatgtctttaatcttttttcaggggtccacaaacttcagaggctagagaattgagtgacatgaaagaataaaaggatggtactggaatgtgtctatgtcctcaaaataagcctgatggtgatggtggatggctggawggatggatggatggatggatggatggatggatggatggatggatggatggdttcatggattcatggattcatggattcatgaatggatggatgactcctcagccctaaaatgcaggatgacaatgtgtggctcacagtccagccctcttcactttagcactcacagtggacagctctgttagcactctctcctcctgagtctacatatggcttcaaacatgatatatgacatttattttttatccccatactggagacctataaaccacctagctaagcaaaatagatgtcctgtacctagagaacccatcccactttttccttgtgaagycttatcttttaggattcagctcttcagccttccctgaacacccagcctgggttgctttttttcccgtgtattcctatggcaacaaggatgtatcctttccacggagtttatcatattataaaattatctgtgtatttatttctcttacttaatgtttcaaggacaaagacaacatgccttcttcatctctatatcccagaatattatgcctggcacacagtagatgctcaataattatgtgcttctctgggtctatagaagcataataattagtatcatctattgttaacatcttttctccaaggtattcacagatttgactcttgtcccagcccacagagttatttggtcctcttaatcctcatatgcaaaatacctccctaagaatgtacattttcactcctaagtctaagtccctgtccaatcctgatgagttgaactgtgcctggcccagtataagctgggaaggtttttttagcataaagctagattccatcttcacatggattttgataggaaagtataaaggctgtttaaaatctataaaatgtgttctgcacatagaaaacattattattaatgtgagtgtaccatctagacactagactctagaatctctttcaccatatgtgttctgggtcacctcatacccttgggggtcaattgatttttgaattagscaatgtgcaaacccttagagcagccactatcacataataggtgctgaaaagatrtgtgtttttttctwtttataccactcctttctgaacctcagttttctcataggtctccttgaagtccccccatggttatcagttccttttttcttccaacagagatttcctggggaccaaggaggtatcactgctactgatggccatgttcctcctggctgtgttctaccatggacagcaggtaatctaacatttcgctctgactgctctgttacctgacatttcttgttaccatcaaactggcctctgctgctctttgcagcaaataacttttagctgcctgtggcaagttgtggttcttaaagaatcaattcctaataaagaccacctaatgaaaaacaaagctggagaagatctggtaaacaatgtggttttaatgacctttggatacatctctttcaaaatatcatcctagtgaaagagctttcaatttctgcctaagacaaactgggatccctcccaattctgttgcctggatgaaattattactactacaaaagttgtgtgctatattaggtaaacatgtgggttcagctgagcctggattctaatcacagttcttactctcagcagtgtatgattttgggcaagttacttatctccatgagcctcagtttcctcaactctaaaataaattagtaatacctaaatagggctgtcttgaggaagcgttgcagattactgtgtgtagaattttgtgcactgacttgcattgtttataataaagacttcrttacagatctgtcctaattagataaaatgcctgccatatggattatgctttccatgagcccctactctttaccagaatctggagtgggcactgtgggcagaactgtacaaaatcccagctctggtccagtctcctggagtagagctgaccccaaataatgcaaacatgttatgtgtggaacagacttagctagggacttcgagaaagaaaattattcttcataggaacatctaggcagggttctcaaagaccagtaggtcttctccaggtgaactccaacccatgaacgttcgtcgcttggggagattctcaccccctggtagaaatcaggcactgcctccctcactacccttctctggatcttggtccatctttctgtggtctgtgtgtacttcaaaaaccataaccagaaaaggaggaaagcacagcaaggagactgtcagccagaccagaaatagaagcacattgctgggaaatcaccatggaaatggaggtaacgaaccctgagaaaatagggatgaaacagcccaaaaccccaagaacacagagacacatawttaaagttatttgtaataaaggggattgtacagtgtagtcaagaaaaaaatagataatattaaaacttggcaagtgaaggaaatgaataaagaattaatatttattgagtccctactatgtgcctagcactttctctctattctcatttaatcctatcaacaacctggaatggaagttattattactcctgttttatggacgatgaaagtaaggctattcagctagtaagtaggaggaccagaattcaaatcctgatctgtcttcaaagcctcccctttctacttcactgggctgatcagagcagaacaaagatgctgtctgcatacgaacacagtgacccaggacactgcatcttgcaatatgctttgacttgttttcccattttggctaaaattatgatgaaacactaggccaaatgtcaaagtctagccatttctagaattcctgtttttaggtctttccagctatctgtgaggactggggtcttgtcttctgctacttgacagctttcatttctaggggagagtgccttagtctgacacacaaatgacaatccatttgagaactacaaaaacagatttagacaaggccatcaccctatagacaaacatatgctcactcaattacacaggttttaaattgacaagtgagaaatccctggaaatagctgagagaacaagttctgggtaagggtcgtcattccataaaaaggagaatggttctgtctcttctgtcaccttagggaattactttgtgccctgtcagtgccttcctcaaatggtaccctaataacattcagatttgatttatcctgtgctccatttgtcctgggaaagcagataacctaattgcattaagattataggtaaagtacgggtatgtaagtattcagtgagggtctgagtgactgggtttaagtgacatctgatatttttcccttttatttttaactttcaaaaggctttgaaattatataaccacatctcatcactatagcagttacaagtacaggctttggaattgggcagatagtattaaaaccccaactctgccacttagtagctatgtgactttcaacaatttacttaactttctgattttcagtttcctcacctgtaaaatgggtatgataataacaagttctacttcatcgggttgttagagtgttatatgagaatataattgtaatatacttatcccagtggctcgcacatataaattttcaaaattgatagctattaatattttactttaaaaataagctgatgacaaaaacaaggcaggtattgttagccatctggtcctaagacaagaacagagattgaagtcccctgaggtcacaaagcctgtaagaaacgccagactggagcgggaatccaaatgctcaarctcctagttccattctgtttccttcacatgccactgcctccctgtgataggggcggctttctgcagggttgtatcacttcaagtgtcttctatctgcagcatcgttttgggtcctgttaatctccgatcaagcctgcccactcctgggcttgctccctgcttctactggttttcccttgtgactcagaggccctctatttttaataggggctaaataatgcccactgatgcctggtacgcagaagcgtctggtgggggcatgtgtaattaaacatctccagagggacggaggtggttatgtaactgaataattggaaatttttatcttgcacatatgtggaaatgacatgccaaacacttcctcctctgaggcaggtgaacattctcaacattgaacagagacagcaaacaactgggtgcctcccacctggtgcctgattcactggtagccctggaggtttgggctttgcctgggamtcttcggttttagcagaggaagccacgcctccacaaggagaaagagaataatgaggtcctgtctccagtaacttccaggtgtgataatggcaggcacctgagattgtgtggctcagaaggaaagactcaagccttggaaccaaatattcttgcttgagtcctagcaattccacttcaagaataggtaaccttgagagactcaaccttccagggctgtcatttcttacagtttattgattgcattctctaaggcatttaagaaattcccctgtcctttgtttttgttttgttttgtttgtactgtatttctgtccagaagcttggtgagattcaggtttaatgatttctgcaaaacatttaattggttggttttatagactacaattagggggtgcataatgtctccttatctttttgtgatgttagcagctgcttatgataatcgcctatattcacttattttatacagtgatatgctaatcctatcagttctccataatttattagctggaatacgttactaaagagaaccatctcctcactatttgttacctggaagtacaattcataaagcaaagataaatgctgaattttttccctataagtttgtttaagtttccccataagttttttccctagcatcattcagaggtgaccatgaggttctggtttttaagtgtcattttgaatttacacattttaccatattctctgtgtttcaattcattgcaattattagtcttattaagctaaacgtgtcacatctttgactagtgggagttcattcaagttggcttttgcatcattttgacataaccctggtagtctctgatagactcctggtttcccgtattaaaaaatcttccaataaagtcatttacttaaaacaagacataattaaaagtacctaaaatttgggcacctctgaaaagaatgggaatttttttgtaggaactgatatttagaaaccacaatctggacactgggagttattactactaagttttcattgtttctagaacttgatttcagtgggcagagctagaaaatctatacatcatgagttcmcagtgtgatacttccacttcatartgaggaccacaagcttttgacttaacttcatcaatcttrtatctgcagctcctttttctcttccccaaaattccagttttaatgacaccaacacagttactcatttactttatcttgtgattyactataatagtctaagtatattaatacaattgttaccacctataatgtgattattgtaaacagttttgacattcttgttgagctctttttatccttagggtatttccctctggcagcatgtcatcaaattattgtgcaaaaggacatctgatatagttcctctctgtgtaggttcatttgttggtttgtctgcttggttatttgtttttacagagttttttgataatagatttagtttaataagtaaaatattggaattattctaaagttatttacttaaaacaagacataattaaagaaatttaaattctawccctattttcccacaccattcccttcctttgtcatttcatagattaaaatataaaccattttataaaatgtaaaatggtttatatgttaatgttttaataaattaattaagaaggccagtcacagtggctcatgcctgtaatcccagcactttgggaggcagaggcaggtggatcacgaggtcaggagatcaagaccatcctggctaacacggtgaaaccctgtctctactaaaaatacaaaaaattagctgggcgtggtggcaggcacctgtgatcccagctactcggggggctgaggcaggagaatggggtgaacccgaggggcggagcttgcagtgagctgagatagtgccactgcactccagcctgggcgacagagcgagactctgtctcaaaaaaaaaaaaaaaaaaagaaaaaaaaattaattaagaaatatgtgtgtgtgcatgcatgtggataaagagatcgatctttcttagataaatggtagcatactatatacasttttctcctcttggagaccagttcctcaaagtatggagagatagtcttcatttctttttaatagctgcatyatgttcaatgatatttctgtactaaagtttactcagccaacaaaatgaacatttggtttgtttccagcctttgttattaaaaattctgctgaatggataaccttttgcatatggtcttttcatacttttgccatccactgagactttaaaawttttttaaaaagaaaagaagctatctgaactgtctaagcccttgaattcagggcagctcaccatgtgtttascagggcagcatactgttcatgtcaacagttaaagactgaaataatgacatacgcagaactgcagtaaaaacgggctgtgagatcctttggaaaggacactgtgcaccttctcatgagaggggaggctaggacaagagggaaccaatgtgtattgagtgcctactatgtgccatgtgtttatctataacttcctataatgcctattccgcccctgcctggtcactgatgttcacatcaatttcagagatgaggaaactgagatgaagtaacttktccagggttaaagtgtgtaaatgtggaactagaactctaagctatatctgtctagcaactaaatctgtaatcctttcactaatgagttcattcatttattctatattacctagtggttaacaattcagattctatattctgatttttgaatcaagttcaaatcctggcttccactaactcatgtgtgatcttagtcaagttattaattcatgtttgctttgattttcttatctgtaaaataagaaatgacaataataccttcctattagggctattacatggattaaaggatttaatatrtgtatattgtttaaaaacattcctggtatatgataagcaccatgtaagtgttagctagttttattatgataacttatttaatragccatcaaatattaagtgcctgccctgtgccaaacstgttactaygtggtaagtgtattcgtatctccacctgtcgtacataacaatatgccatagactgagtgtatttaacaacagaaatttatcttctcatggttctggaggctgagaagtccaaggtcaagatctggaagggtttgttttctgatgagggctcttatytggcttgcagatggctggctacctgcttgctgtatcccaacctggcctttttttagtgtgtgcatgtggagagagaaagagcgagtgttctcatgtctcttcctacaagggcagtaatctcatcctgagggatacaccagcatgacctcatcaaccctaattacatcccaaagtttccatctctaaatgccatcacattgggggttagggctccaatatatgaatttgagagggacacagacattcagtctgtaacagtaaggatgtaaagtcgaacagatagaagcacctctgacsatatgatatrgtttggctgtgttcccacccaaatctcaccctgaattataataatccccatatgtcaargatgggtccaggtggagataactgagccatgggggcagtttcccccatactgttctcatggtagtgaatgactttcatgagatctgatggttttataaatgggagytcccctgcacaagctctcacttgcctgctgccatgtaagaggttcctttgctcttccttcatcttccaccatgattgtgaggcctcctcagccatgtggaactagaagtccattaaacatctttcctttataaattatccagtcttgggtgtattttgattagcaccacgagaatggactaatacaccatacaacactgacagtctagtagaggacaccaacattatcaggtaatcacacaaacaagtatgaaatyacagggggcaataatgctgtgaaaggcaggcgcacatccctgtgaaacctaatcattctctgatcacttggcttccaanaaaatgcctcccaaaatattcagatcaggctctgtttcatttgtgaagagttccagagaagcctttcctgcctcccagttgtctgtgcctgaagcctacacctcagaagtttacctcattctcctctttctctcacatgtactgcagctggagtacacagcccgcctggacttcctttggcgagtacaggccaaagaggagatcaatgagatgaaggagctgagggaacacaatgagaacatgctccggaatatcttacccagccatgtggcccgccatttcctagagaaggaccgagacaatgaggtgagccaggggctggtctagccagtgagaaagggtggtggtgggtgatgtgcagttgttcacattgatcccaaactctgggagaatttcactgtcatcatgtgagtgcatgagaatggagaaactcctaacactatgaaatttacacatggcctcccaacctcaggcacctcatctacaagatggatataataaggtctccattgaaagactacattggaattttaaagttgtatgtgcatatgcatgtgtgtgtgtatatatatgtatatatatgtatgtgtatgtacgtatgtatgtatatatacacaacaatttcacttctggttatatacccaaaataattgaaaaaagggtctcaaagacatatttgtatatctagaagcattatttacaatagtcaaaaagttgaagcagccccaagggtccaytgatggacgaatagataaacaaaatgtgatatatacataaagtggaatattattcaggctttaaaaagaagggaattctcacacatgctacagcaatggatgaattttgaatacattacgctaagtaaaatgggccattcgcaaaaamtaaatactatattattccacttatataaggtacctagagtggtcaaattcatagagatgaaaagtagaatggtggttgccaagggctggagggaggggagaattggagttattgtttcatgagtgcaaagaatttcagttttgcaagatcacaagagttccagagatagatggtkaagatggttgcacaacaatgtgactatacttaatgccactaaactatacacttaaaaatggtcaagatggccgggcrcagtggctcacgcctataatctcagcactttgggaggctcaggcgggtggaccatgaggtcaggagttgaagaccagcctggccaagatggtgaaaccccgtctctactaaaaattacaaaaattagccaagcgtgggggcaggcgcctgtaatcccagctacttgggaggctgaggcaggagtatcgtttgaacctggggggcagaggttgcagtgagttgagattgtgccactgcactccagcctgggcgacagactgagaatccatctcaaaaaaaaaaaaaaagatcaagatggtaaattgtatattatatgcattttaccacaattaaaaataataaaatatatgcatgtatatatacataaatgtatgtatgcatatatgtgtgatacatgtgtgtatatttatatatcaatatctatacacatatatgcacatatacatacatatgtgtgtatatatcttcttagcccattgcctagcatgtagcaaatgctcattaatgttctttttacttaaaactgttttttcttattacattatgaaggcagtctagaagtctgaaatcaaggtgctgggagtctcatgccctctccatagggtctgggggagaawctctccttggcttttccagcttctgttaggcccaggagtttcttggctgtggccacttggctctaatttctctctccattttcacacagcccttcttaaaaggacaagtgtactctccttttaacatcaccagtcatagatttagggctcaccctaattgagtatgacctcatcttaattacacctgcaaagaccctatttccaaatagtaccatgttggacatgactgttgaggggagcatgagtgttggtggcaggaggcactaggcactattcggaccactagaaggaggaagggttgtatggtgagagctgtgaagggaaaccctagacagagcctaatggtcaagctccatgggcgatggtcatttccacatacaatgggagcctttggaagttttaagtgtaacctagtcaattggctactgatagagagtggataggaggatcatgcaacamaaagccaggcaggagactctaaaagggcccaggcaagaccctggtgatgaggcctaggatggtggcagtggagatggagagaagaagatgaattacagacacctttaggayatagaatcaatagttcttgataatggagcagatgtgggaggtgagaaatgacaaaatcaaatgatttggttccccctctaaccttcaagggaaagtaactcaagagggaactgaaggtgtctttgaaagcccaaagtggcattattatgtgaatgggtttggtcttactctgtgagactcccaagggaaggtctagaaccatggactggcccacaggggacatctttgggtttcgtgttaggaggagccttacaaggacagagccatcaggccatctcatcctcctaacacagtkagatccacaaagcagggactacatcacccttggtcaccactgtgcctggctgtggcccctgctcttaaaatgcctgtggatgaactggagtagtgggctcccttgctgaggcatttaacttgggaaagctaaccccttgctgaggatgctacaaaggcaatatggattgtctgagaggcagggataataccgctcttccaggactakattttcagactgagctaaacaggaaatgaaaaacccttaggacaagaattacgaactctaagaccctgagacaaatctgaccaatgagccagttggcttggacagtgggttagttgattggtttatagttaatttatgaatggctcttcagtttacccatctgtaccctgccatttatgttacctgtagcgcccctaaaagcattggggtttgtgatccttgccttaggaccatagagggcagagctaggagagaatgatgaggtccatttttcatctgagccactgaagaaaaactagtggaagacaagccaagggaatgagtaatcagccactggaataatcagatcttgatgtactcaggtctttgagagtctcttgggtgcggagactccaccctcctcaacagatggagttccctgaaactgggctcaggcctggtttcctcaaggctccctaaggtcagtgtctttgttgcaagagcttcttgatgaagccatggaagcagagagaatatcagtgtgtatcaaccatgaccaccagatggagacaataaaaccccacatgtaaaatccaaagagaaatgagaaaaaaaaacagctttttaatcaagacaccgaaacagtgaggcacataggaccagtggagaagagcaaggacatactggttycatcctgaaaggaaggaaaccaaccagagacgcatgctgagactccaggtcatcagctgtcattcaggccaaagcaaaataaaggactgcttcagcattaatcgcatgtataagacatcttgtcaggattatttgagattttataaatatttaaacagttcacactggactaggattaaacaccaatcatggttacattgcctagagaattttcacattaggataaaacatcatttactgaacacctactccatgccagatactgaaataggcaattgagaaaattatctttcattctatttacaaccttgagagttccatcagcctcatagtattgatgaggaaactggggccctgaaaggtgcagggtatgccctactttctttatgcaaagccacaaggggagtccagtccctcagattgctttcttctgtgcccctctcccccttacaatgctgctacccataccacctctggagtatggcaagactagtgtgtgtgtgtgtgtgtgtgtgtgtgtgtgtgtgtgtgtagaaaaagagagaaagacagagtcatacaatatgtgaaagggtgacagggaaggggcaggactgtagtggccggcaagaactcccagtttcattctctgttaccgtaagaggcaaaggcatttttagtttctcctcttgctacagatctgaactgtgatacaaatttctgaacatctgactggggacatctgtgagtttcacggagccacaatagcacccaaagcaccaccttttcctcttatgccaggtatctcccaggtgtatccctgaggtggcagtgccttcatggctgatcttcagctgacctagaagagttgtgtgatgcacaaagcctccaactgacttgtttgcatcaatgtgggcctcacactttagaaaataattccacagaccgcactcaaagaggaaccgaatgtacagcctccagctggcaaagccagataacttcttagttgtaacttttgtgtatgtccctggccacagcagccagggrtatgctgaaagccatcagtgccatcattgctgcaagctcagactctcttttctctccctccttggattctaaccccttttgaggtgttccaaataaggccatgtgacctagtgggaaaatcccaacgtattaagccagaaggacatgtattcaaatcccagctcttccacttactagygtgtgatttggagcaagttagttaagttctctgagcctcagtttcttcaactgtaatatgattctaattcttaccctcctaggacccagatgttaatcagtcaaggaggtggaggaaaagaattccagacagacaggcccaaatggccaaaggcataaaaatgagatactataggatatttgctgagaaggactggggggrctacaagcacccaaatattttaagggaaagaacaggccagagcaaaggtatcataagtacaaagagacaagtcttgaagagcattgaagtagcttggatctgattcaatgtgtaataggaggtaggaactattatccccattttctagatgaagaaactgaggctcagggaaggaaagaaatttacccatggtcacaaagctagtgagtastgagctcaaatccaaacccaggtatgcgtaacaccaaagccagtgttctttcccctccacctcactgtaagtacatgcagagaagggaaactgtgacaaaggatgactcaaaccatccaaacacaggcggtggacagggcctcacacccagaagcattctgtccaaggcagtgttacccacaccaacattctggcagcttctgctattctgctgtgcttttggcttagaatagcactcacttcctctggtcaggaacattcttgcagataaagccagctggaggtccaggcctgagtatctcatcaatgtcaagcaggctagctctgagtcccgggaaacccrctggctcatcatggctttatgarttgttgaaaaracactagcaagggcagctgtcccaggtgctggagagtccacacagcataaatcccatctctgtcactaactagctgtgtgacctacgccaggttacccaactctttggagtccatttcctcatctgattaataggggaaataataccgaccttgctgaattggggtcagagctaaatcggataacaacacattaagtccccaatgcagcccrgtgccaggcagcttcattatagaaaggmcgtgtgtaggtgcattcaaaaccccagtgctgtgggtttagttctggttcctcctttcactacctttatgaccaatggcaaatgataataaccctttctggacctcattttcctcatgccccttgttgtgctacaaagggatcataaccatactctgcatcttcatctgattcattacatttacatgcgttatcaagcctaaagcacttacatggtgcttgacatattttaaacgcacactggttgttggctattgttttttatatatgtgagtcattgctattttttctactccttcccagtcacagccccatcccctatcccttcattcaaccattccttcctcaagtatttattgagggccaaccatgtgccaggtgctattctaaataccggggttaaaacagtgaaaaaacaacaaaggccttgatgctctgaaacatgtgtttctgtgggaagacaagacagtgaagcaaataaataaatatataacatagtgtcagagaatgatgaatttgatgaggatagaagtagctgaataatggaataaagtgttgaaagggtatttacaatggtatcttagtttgtttgtgctgttataaccaaatacttgatactggccaattttttttttttttttttttttttttttttttttttttgagacggagtctcgctctgtcrcccaggctggagtgcagtggcgggatctcggctcactgcaagctccgcctcccgggttcacgccattytcctgcctcagcctcccaagtagctgggactacaggcgcccgccactacgcccggctaattttttgtatttttagtagagacagggtttcaccgttttagccgggatggtctcgatctcctgacctcgtgatccgcccgcctcggcctcccaaagtgctgggattacaggcatgagccaccgcgcccggcgatactggccaatttttaaagaacagaaatgtctttcctcccaggtctggagaatggaaagtccaagatcaaagtgccagcaggtttcatgtctggtgtgggcccttgtttctgcttccacgatggcactttaaactctgtgcccccacatggtgtaagagccagaaagaagaaatccactccctcataccctttaacaagggccttaatgctattcatgagagctccacctttatcacttagtcacctcctaaagccctcacctcttaatactatcccactggcagtgaagtttcaacatatgaatttgggggacacattcagaaaagagcaagggtcatggaagctctctctaaggaggtgacatttgatcagagacctgaatgacatgaaaggatgctaataaggtttgcaagtctcagacatagtttctcccatgctgagaggtggcttaacttggtataagcaacgcaggacttggagttgcttgagcaggtgaaggaccagactatagttccccaggcagagagkacgtcmgtcctcatactgacatatgcaggtgtgcgacggagcgcatgcacatgttcaaaatcctctactaagtccataccttcgaccaaccagaggaagatcacaataaaccaataatagcttttctatattcatcaattcctccccagtttacaaagtgtttttatatttttgaagcccaaaatatcaagaaacagatggcacactcaaggctgttgactggagtgagttgagtgaagggactgtctyggaaggtgtatgtaggttgtccagagctcctccgtgtgcccctcaaaatcccttcacctcttctctctgctcttcctgaggggtcacgggtgagagggctcatctacatgggttacatctgtgacctgctmggccctcaggcacccaggtgagggatcatcaatggccggccctgggtaagagatgaggggaagtgaggaatgtgaggtgaggatgtttattcccttgcgattgcctgaggctggctatgtcacttcacagaaattaatatctcctcccaaggccactgctgtgctgcctccaatgtcaaacgagctcactccttttgggctcttctcatccctttgagcctagagggatgactgctctcccaccactagccttgggtttctgggagatttcttagggtttccctacttcctgccctcatctttctaattaagccctttatcagytaacccttcctgaatcatcttgatctgaatgtgtgccctcttttctgctgggtctctaattgaagcaatagggataaggaggagatgaatattccactgtgctcagcaattgtgggaagctgtgatggctcccaggctgaaagggacaaggagaaaaagcagttactggaaccagcgtgagtagccactgccagtcatggcacagaggagcaggcagacaactggagtggagcatctcagggccaccaagggcaaaagcagagcaagagctggcactgtcatcaactgctgagggacctgtggtcagaggagtcacctcacttgcccagagtcatgtgcccacagctgtgggggtcgagcgctcctctcttcccacgttcctgccttcaccagctgaggaggaaatccctctaacaccgtccaccctgtggggaaatgccggggagggagtctctccctctcttatggtgctttaccccaycagactggggaaagacagggtcactggacctcgagacaattgtggggcccgggtgctaaagacccacaaagacctcaatctgtcttgtatcctcatggacctgtttgtgcccaaggtgaacccaccttctcctcacatrtggcaagccacataacacaggtttccctttctgccccacaagaagctaaagacccaycattctccaggctccctgccagccactgaatagacaaattagctcagtcccactctgtctcacaggaaggagctaaaggttcccatttatgcctcagatccaagacacattgtccaatccatccttatctgagagtctgtgttgggggkttggtcttcaactgactgtcagacccctgtagccactccctccatcagttagcatcttatggaaaggaggggtgagtcccagcccaccctattcccacttctccaacctccagyaggrtaccacagaatcaagatctgaactcaggtcatatttcttcaagctctttcttacccctccactgtgaaacgaccacccaatcagatggacaaacctaaaccagttttcagtttccatgtcacttattcctgcttgtcattattattattactgctgttgttgttgctataattatagttattattagcagtacaaatttcagctctacgtcataacaactatggggctcgggtaaagtatttaatctctgtatcccccagtttccccatagatgaaataagggtcttacttgtatctgtctcatggggacatggtaaacattaaatgagatgatgtatgtgcaatcttttgcattgtgcttggcacatagtaagtgctcaaaaaagtagctaatattattatcacatttttatttaagcaatcagaatatttcaaatgatggaaagactgagaaataaaactaaggaaaagggcatgaggctgggggcagtagctcatgcctataatcccaacactttgggaggcctaggtgggtagatcgctggaggccaggagttcaagaccagcctggccaatgtgatgaaaccccatctctactaaaaatacaaaaattagcctggtatgatggcaggcgcctgtaaccccagctactcagggggttgagacatgagaatcacttgaacccaggaggtggaggttgcagtgagcatagatcctgccactgcactccagcctgggcaatagagtgagactctgtctcaaaaaacaaaaacaaaagagtgtgagaggagctggcattcattagaatattcagggagacaaacaatcgttaagacacccctggctgcctgccattttataccatggagrcatttacatcacagggcataaaccaaagtgggaagggatctggactgcataattacacaatgaattttagagggtaggatcttctcttttttctctatttctaagcagaaaataaaaatataggcataatggactgaattatgtctcccgaaaatttatatgttgaagtcctaaccccaaggatctcaaaatgtaactgtatttagagacagcatctttaaagaggtaattaagttaaactgaggtcattagggggacctaacccaacatgactggtgccctaatagaaagaggagactagaacctaagggaagaccaagtgaagacacagggaagacagcatctgyaaccatggggaaagccctctgacaacaccaacctgccaacaccttgaacttagacttccagcctctccaattgtgagaaaactaacatctgttgtttaagccacagagtctatggtcctttattacaacagccctagcaaacraatactataggtaatacagtaaacagagactttcccaccaaaccacagccattaggaggatgcacatttacttaagcaggatctctgactcctgctgcacagtcaggctccttcgtggcatcaccatattgttcaaagccaaggaaaacagaaatccacctttgaaagccatttacctttgctctgctccctgactgctatctgcactctttctaccctgcccagccctacctagccagtcatcagctgcctgtgctcttttggataaggactaaagaaggcatcagtttagattaatccatgcttaaagttcaagagaaattgatgatgaatcagtgacaccatctttctctgacctagggcatgcatgtggaggaggcacactcacatgtgtagtgcagggaaaggccttgggagtcctctgatcctctcttccactactagctgtgtgatccaaaacaatgacttaactcctctctgtctcatttcctgtatcagtaaagtgggaataattatcatatgacttcatagaattattgcaaggattaaatcactgaattcatatgaaagcaatttrtaaggtttcatgtttcctacgaaggtcaggaagtcattaatcaaccaacagttttgagtatttaccttggaccagactgtctagggtgtgcattatataggggcatctaaaaactactaatcgcatgatacataattggagtgcaataagatgaatggcatgtggtttttgccctcatggaatccacacttgaaggaagaaatggatgttaagacagtaatgcaggtggcaagggctayactgtagagtttttgaggtcactgcaaagcaccaagtgcagcctctaaaccccctctgtgacttgtggaagtcgtggtctctaaatggttagcggaggcagaaaacaagagttagcctggtaaaggaagctaactgcagggaaggaagaacatttcccacccagggacagacggtaggaataaaagcatttaagtgtgaaatagaacagggtttgtgtctttgtttgggttcttccagaagcaaaccttgagacaaggatttgaatgcaagtaatttactcagcggtggtcccagtaaacacaagtagcttggaaaatgaaaaggaaggcaaccgataaatgatgcatcatccrattagttacctctgtgggcgactggagcttaatccggctgggaaattcagggaaatggtgtgagagcatgcctcaaagttatcaggcccaaggggcgagggagccgggactctccagcagttcccactggcattggtcaagtgctgcttctgaggggtgttaatttcctggcacctcccaaggctgcgtgtcacttgggcagagtgccctctagtggccagacaaaaacaccatctagcggagaagaaacacaagggttgacacttgaacactgggtgagaggatgcaggcagagcacctacagcatcagacaccacatgcacacagaagtacaaatgcttccgtgttctggagcrcatatccaactggggagttgcagacaataaagctgaagagataggtggaggcaggggcatgcatatatgtcatgcttcagtgtgtgagctttatcctgagggcaatggtgagccattggagggatttaagatagggagaggcatggtcaatagtgtatctttaatagatcactctggctgctgtgtgaaggatgcctttgaatggaacaagactggagtcaggaaacccagtagaaggctctcattttagtgatcaagaaggaaaatgggaagagcccgatttttaaaaacacacacacagtggtaggagcaaatatgtttagaagacaaaaacaagcccagcagaacttgatgatttattgaagatggatacaatggggaaggagtcaggatgactctaagggtctctcattttgatgatttggcaatgctggtgccaccaagtgaattagagagcaatgcagtagacacaggcttagttggagagaagatgcactcagtttatggaatttgtgattggaggagggtgagggcaaccaagcatgagacatggtagcttgaagcccaagaaggataactaaccttaacacaggaatttagaaaccgtcagcacatgggtattgaaacgagatggaccaggtaagtgtgtaaagttgagccattcagtgggccaaggacagaaccatagcaatcaccaacatttaaggtgtaagagaagcaaaaaaaaaaaaaaaaaaaaaaaggcattctcaaaggggccaggcatgagaaaagcaaaggacatcactaaagcataaaaagtcaagagaatcaagatcttggggtgatcaataaaaacaccaatctgcaggtgtccagcaggatataaacttacatgtgtgcattgatttttccactttgactgcaggctagactgttcttagttcatttcattccagtctgagatgccagtgggcattaagagcrtgggaataggcagtgaaggtaactagtttgagaagtttggaaacaaggaggaagagaacctagttgatagccacaagtgtctgcaggatccagggcactttgttctttttcttagaagagactcttagaagatgaggaggagcagggagaggaggctaggagaaagaaatgrgaaagaaaaggatcactgaaaaagtaaattgctgaagaagttataaaatgatcaggtagaagtattgaccttcagcaagagaaggaaagacagacacatcatcatctggagttgaagtgaaagagragaaaatgaataacaggcaagtctatgaggattggaacagaggtaagtcaccaccaagagccaccaccatgttctcaatgaartagaaaggtaagatcatccactgagagaaatagagtagagggttaagtggagatctgaaggtttggactagccattgaggagaaaagaaaaggaagcttaccaagaatgaatgaactggcagtcagaactcaggccccagctgaggctggagaccatgaattttcagtcatcacattccatatggtgatgatgctgtgactgkggtgcaatggactgaatattcatgatcctccagaattcctatgttgaaaccctaactcacaaggtgatggtattaggaggtgggaaatttgggaggtgattagatcatgaaggtaaaacccctactggatgggattagtgccctcattttaaaaggccccaaagatttgcyttgcttcttccaccacttgaggacacagtgagaaatcaacatctctgaaccagaaagtgagtcctcaccagacatcatatctgccagtaccttgatcttggacttcttagcctccagaactgtgagaaataaatttctgttgtttataagccactcagtctaaggtattttgttatagcagcccacatggactaaaacacactgttgacataacgatatccaagcctcattttctgtctctctgtgggtgactgtgcacgtgtgtacmcacatgtgtgcacaggaagcatcactgcagaaccgacctctgatgaccatttctggtgccctctgtgtgtctctgtccaggagctgtattctcaatcctatgatgctgttggggtgatgtttgcctccatcccaggatttgcrgacttttactctcagactgaaatgaataaccagggagtggaatgcctgcgcttgctcaatgagatcattgctgacttcgatgaggtaaatctaagcctgagacatttacaatcacaaatkggcatcgttgtcaaagcgttgtgttattcattgtaggaattacttattttttttttttgcacttaacggaattccagcctgcattataaacacaaacatgtattatctgatttaattatcacaattatcacctgagttaaatgctattatttccctatttgggggatcaggaatataaggctcagggaggctaagtaacataacccagtgtcacacagctggcagatggcaaaggcaggacttgactagaggcctctatgaggccaatattactcaagcactgacaccacagaggctggacactgaagcaggcattgctccatcttctcaaagtgtcaaagataaaactgtccatttgcatttggtcagagaactaattgcaagtacaaacatactacagatagcggtttcttcctccaggctccatgagtctagtgaacacattctgtggggggaaatgctcacgctgcacttcagttccattcataaacttgacacaagtgggccttctactcccccattccccatcttgaaggacaccagtgtccatccagttacttaagcctgagctgggaagcaagtgattcactgagaaaatgctayggaataagccaaatccctgcctaactccagagggaactcaggcacataaatggtacaactgtctcacactgaggcagggggccaggcttttggatacccatattggtcagtcattattggtcatgggctgccctggtaggggtacctagcctcccaggcatttccagcaagggagttctcatgaggccaagcaaattctccaaaaggaggtgcagtaatgcattgtcagcagccagcactcatggcattttggaggatggccccacaaaggggcttggggcgggaaaaaaaaacaactactacatcactctaaacagcatcctgtccctccatccctacattcaatccagcttctgagtccagtgaagtccttctttccattgtatatatttatggtgcaaaatgtgatgttttgatatatgtgtacatcgtggaatgattaaattaagctaattaacaaatccatcacctcacatcttacaacgtttttgtgccagaaatatttaagatctactctcttggcaattttcaagtatgcaatacattattattcactatagtcactatgctgtgcaatagatctccagaaagtactcctcttgtctaactaaaactttataccctttaactaatatctccctcttcccaccccaccccccaggttctgaaaaccaccattccactatttgcttctgagtttsacgtttttagattccacgtataagtgatgtcatatgtacttgtttttctgtgcctggggtatttcacttagcatcatatcctccagacccatccatgttgttgcaaatgacaggtcttccttctttttgtggctgaatagtattccactgtgtgtgtgtatatgtgtatgtgtgtggtgtgtgcatgtgtgtgtgcatgcgtgtgtgtgtgtttccattcatttctcaatggaagtttaggctaattctgtattttgcctgttgtgaacatgctgagatgaacatgggcgtgcagacatctcatcaactttcttaatagctctcacacctgcctttttctcaccatcaatgctgcttttaccttgattcagaccatattatttctctcctagacaactgcagtcatgtcctatctgctctccctgcctgcatctcaccattagcaatcaccaaaggcaggagaattttgtcacatccctttgaagcctaaacccttcagtggctccccttcatcaactctagtaggtcttgcactcactgtccctgcctcctctcagccttacctcttactgcaggccacctggccagcaccacctaactacttacaagccaacaagcccacctggctctcacacactgcactttctgcctggaggccatgccatcctcgcccttaccccatcctctctccctcgactccatgaccagctgaaaagctaacattcatttaacagtcaattcaacgctacttctacagttgaaggcttttttctaacccccatctctatccaggtaaatgttgtcactccttttttaatgaaaaactcatactctgaaaaacctcctatcataaaggctgaaacccttcagtaccaccctgtttaccacccaatagccacttagttctagggtagaaacccatgttactaatctctataggtttttacaagtgttgccagaaatgcaaagcattttcaatatatatcatttaatagttatttatctctcatacaaacccttaggctaggaattattagccttcattttaaaaatgagcaaagctgagactagaaacaccaaaaatgaccagagtcacataccactaagtggcaaagccaagatttgaaccccagtctcccatactgctttgatttgtaatcatttgtgttgcactgtttctcacttacctggcatttcatggtaatgattttgaagtcataagctcaaacatggtcaccgtagttgccctgggatgggtgtggggggtcaagatggataagacgtgatcacttcttgcctcccaaggcttcaccatccagtgggaggcagggtgactatgagttgcccttacacaagaagtcactggtaagtgtactagtacagagggtcttgcaaggtggggaggggaaggcaattttgtgacaatagcacctttaactcctgtcctctatgctaggccataaggtcactaaggtagagaccatattcttgtatcttgttaagtctccagggcccagctctgtgtctagcacataagagatggacatggcagatgcttgctaagtacttgctaaaggaatgaattcattaatggggggacagaaacaagctggcagatagtaaggtgaagataggttaatgcaattcaaaacatacttccaatttttttaattaccctattaaaaatatctgactaaaggttaagacgtcaggctttgttgtattttaaactttatagcrggggtgtccagtgttttggcttccttgggctacaatgaaagaagaattgtcttgggctacctataaaatacactaacactaaggatagctgatgggctttaaaaaaattcgcaaaaaaaagtctcataatgttttaagacagtttacaaatttgtgttgggccacacattcaaagacrtcctgggccacatgtggccagtgggccgcaggttggacaagtttgctttatagcaacccatcttccaaaagtgctccctctcatattttaaaattgtagtgaataaagtatatttgaattacatttgcatctcagtgaaccaaattgttgacactctagagtcttggaaagcggagaaagagggcagtgcccctagtgattgaaatgggtgtttgcagagggaagttggaaaacagggaattggtctaggaggctgggttctttagaacatgggcattagaccaggaggaaaagtatgaataagaggagggggaggataagtagatggggaggaggggagagaggagagggaagagaggcagcgatgaagagaagaaggatgaaaagaggaggaaaggggaggaggtggaagagaaagggtgaggcggggggaaggtaggggagaatatagtcaacaggaaaaataaaaaagcggcctgaattgccagcccaaacactctcagttttgcctgtgtgtgggtccttgggtcactcagacctgccttttttgttttgttttgttttgttttggtcaagagaggtcctctagattctgcctggctgagttccagccagacscctgctgttcactttaatactgatgcttctcttcttgctgatataattaccacaggaacctgagatcatgcaaaattctttcctggctcagagaaaagctgaactttgcacagatcacatctccaagactgtgtttgcaataacccaactcaagggctcctcatcccacagcccctgcctcaataaagggctgaagagccctctcacatctgacttccacaaatgggctgatcagggaccactctatgcccccagacacttttagctatagagtaaataaatctgctggatggatattaaatgagataatgaagttcctttctgcctccaaattatcttctgagggggaggcttaccagagcctgaagctggctcttggccaaktgattctgaagagaagagaaggaaaagtacctgctctccacaggaccacatcagatcagtccaccaccagcagaaagctgggggaaagtagttacagggaggcagagggagggaggtgagtaattgaagatgttccaggatttttaagctgaaacattagcagctgaagggcgccaaaacaccaaatatgtttgattagtgtctgaaagcaaagatcagtcatgatccaaggctgaagacctktgtaccctgggcatgactggcagaatctctgtgacagcagaagaggggcttcactttagttcaagaaacaaaaataataaacaaaggctgcccctgctgtaaatcaggctatacatacacacaaacacacacacacacacaccaaagccaagcacctacctgtgttctccatgttcccagaagagttcctctcaaggaggaattttccaagtttcttagcccctgattaattttgagatgatgcctgaaacaagagagtctgtagagaacccatcttctgctccgtctgcctgtctgtccaccccaggatgacatgagacctggaggatattacaatcttaaatggaggcaaaagctagagaatcagaaattacatctaaatatctgccaagagtgggaataagaagacaaagtttagacttgggaatcagtgaggtttgagttttagcctaactctcccactcagggtcggcttcgcgagtgtgcagcttgtgcagtcccaaaaggaacccatgcttgttttaatgttctgctattgctctcatgtgtgtcttaatttttgaaaaaggtgttccacattttcattttgcactggaccctgcaaactatgygtggtcctgtctcccctttctcaccctgggaccttgggacacattattttaccgcatggagsctctgctgattcatctgcaaagtgaatactaagctcaaagtgccactcagagaaacagatgatcgacggaggcagagcccctagttctgtgccccagtatatgcggacatcgcctcttccagtctactttttaatctctttaaaatgtttaatttatgctttgtatactgtggggtttttatttttagtagagacagcgattttcaccacgttggccaggctggtctcgaactcctgaccttaggtgatctgcctgcctcagcctcccacagtgctgggattacagatgtgagccaccaccccagcctggaatttttaatctaaaagttacctgcaagggcattgaatttatgtaatttagccattttctcactctatgtccttaagcaagttatttaatccctctatgcacctcagttttcccatctacaaaatgagatacagtagggtcattgtaagttaaatgcagagattaaaaagcacttaagactgtatttgatgtgatggactgaatagcatctcctccctaaaattcatgtgctgtgagaaatgagtttctgttgtttgtttttattatggctgcttgagcagactaatacacttggcacataactatgatcattaaaagttcattttattattatgtgtatttgtttctagtgtggctgtaacaaagtaccacacatttggtgtctttaaacaacagaggctggccgtcgtggctcatgccttaatcccagcaccttggaaggccgaggcaggcggatcacgaggtcaggagttcgagaccagtctggccaacatagtgaaaccccatctctagtaaaaatacaaaaaatgagccaggcgtgctggtgggtgcctataatcctarctactcgggaggctgaggcaggagaatcacttgaacctgggaagtggaggttgcagtgagccgagatcgcaccactgcactccagcccaggcaacagtgcragactctgtctcaaaacaaacaaacgaacaaacaaacaaatccagaatgcattctttcacaattccggaagcaagaagagtgagatcaaggggtgagcagggccctgctccctctgaaggctctagggaaaactcctgccttgcctcttcccagcttctggtggtggctggctgaccgtggcagcatgattccaatttctttccatcctcacatgtctttgtccctgtgtgtgtctctgtgccctctcctcttcttattaggacaccagccataatggatttaaggctcaccctaatctaatatgacctcttcttagctttaaaaattactctgcaaaaaacttatttccaaagaagatcacattctgagagtctgtgaggacatgaatttttgagaggcactatttaacccagtatagtattcacaccctttttagaagtgcatagggataaaatgtaagtttgtttaaaaggaagggagaggtgcacttatgatcttctaaactaatatgttctacttctcatcattctgcaactaatactcttccaccctggaaatgcactgcgaatatgaagtccatgtgacagtgattaactgaatcttgcttcattgacaagagtgacactgaaagccagcctcagagaatttgctgtttatgggcttattgaaccagtatctagtgaagtcctgccctgggcgcacaagatataatgacaaactaaacaggcataaatcctgttctcatgaagcttatactctattgtgggtgaagaacaatcaaaaagaataacaagtaaatatgttgtacaatagacagagatacattcggtgggggaagataatgcagggaacatgggaaggaaggtttggagggaggggtgcaattagagtcacccactcatcgcttacccaggackttcctggtgttggcactaaaagttttgcatctcaaaaaatcccccgacctgggtgaaccgagatggttggacacccatagtgcaatttcagagagggttctgagaaagggcttactgagaggcctggaggagatgaggacgtggaactgatccatagaaacagcttggggggcatggcggcaggcaaggaaaagcccacgttctaagccctgaggagggtgtgtgcagcaggctttctcttgttctcttgagcaagtcaggtgatrgaacctgacttgtgctgccttaggggtgagccagctgcatcagcatgtcttgggtactttctatttagacagggaaagacttgggccgcagctcctggccacacaacatgcaagaagaaggctggagctggttcctgcctttaaaccagcgtggcagggtcagtggctgatggagagaagggccagagtgccaaatattacaggacctcatggaccagagcaaaggctttggcttttactctgagactgatggggatggctacgagggtttccagcagagaagggatgtaacgtaactttgattttaacagggttcctctcagctctgtgtgaagaacagggtcaagagtggaagaagggagccaattaagaggcttatttcaataaaagaaaatggatgagggtggctaggaccaaggaggtgatgagacagggtcagaacctgaatgtctttaaagatagggctaaggatctgctgatagattagatgtgggttatatgggttttattctgaagcaactggtaaaatggagacaccactaaccaagatgggggtcgatgaggaggaacaaggggccagctttgagaatggcagatctgagacacctgttagacctataatgaagacatcatgtaagcaattccatactgagtctgaaggtcaaggcagggcatgcagttaggagttttcagcaaagagattgtatttacagctgtaagacatgatgataccacaaggaaatgagytagatggaaaagaaaagaggtctgaggcctgagccctgaggctcacctatgatataagataatggtggaaagaaggaattaaccacagagactggtgaagcatcaccagtgaagtggaagtaaaatctgaagttggggaagctaagtaggaacaaaggtataaacaggagtagagccccatcagctgggtccagtgctgctggtagcccaagagaagcgaggctgaggacagccagcagcatgggacatggagggcctccaggacctgsaaaggagcagtttcagtggcatggcaggaccaggcttaggaaaaaatggggaggaggaaaatggaagcaatcagtctagacaactcttttcagaagttgtacagcaaaaaaaggagacaagtagaaaggaaagtgatgtcaagaaagactgctgtaggataagaaatttcacagcaggctgtatgctgatgggaaaaatctagcagagagggtgagatggatggagtcagggacaaaggagaatgctggagcagcatgcctacatgacaagggatggacctgtaaacacctgtggggctcggccctcactaggagcactgagagttcctcyccacacctggagagaggcacatgtgtgcacacaggtgcaggtaagtggagtgagctgtagaagcaggtgtgcactactataatctcctgccaaaggttcactccagacatgaggttaaagctgtgccctgtgcagccttggaggtgagccagccgcatcaccaagtctcaggtactttcttcttgtaataggaaaatacctatgccacagcccctgggcatacaacatgtaagaggaaggctagagctagtcctttgcctttaaatcagtatgtcgtaagcaatttcttaaaccagaggtcagcacagttttcctgtcttctccaggcacttctccagcccactccgcttaccggcacctgcccctgtgtgcacatatgtgccttttctccaggaatggggaggaactctcagggctcctggtgagggccgaggcccacaggcatgcataggtcccatcccttgtcacctaggcatgctgctccagcattctccccttttcccygactccacccatcaccctctctgctagatctttcccattggcatacagcctgctgtaaaatttctttttgattgtttcacccacaatagagtataagcttcatgagagagagcaggatttatgtctgtttatttttgactttgaagccaaaaagtaagtagtgtaaaagcagaggagacccaacccagctgtgctgaaccacacagaaccatgttctagccgttggcccatgctgttcccaagaatttgggaaagggcatgaaygtgtaaactgagtactacagatctggaaactacatcatcaagagattactctggggaaattcaaaggagatttgggaaataggagagatgtaagaaccacttctgagtaccgtcacttgaagggctggcccatggagaagagttcggctctttctatattgccccagagctgccatctcagcccaaaggtataatggatcgacggaggaaggatctctcattcagaggcttcccaacagtggcctgagctgaggtccccagggagtgaatccctaccagccagcatagatgggggtaaaatggatgacctggaactaaatcctgttcatctgtgacctgtctgtgccccaccaccaccaaaaatgtgaggcttgattctttgaaaagcctcaactgcaaactccaggttaaagtctcagcagagtagatatttagaaagttgaggagggtggcaaggcttcctgtgtaatcagaggtggagacatgctgtgtttcattaggcayggagcgaactttgacatgcaggtcacaaaaatagaacaggctactttataatgggattgtgtactatcatagcccctaccatacatgaacacttatagatattaaaaacaaggagataggaggctttgacgtttcaccctcctaaatcatttcaaactggggaaytcaaagccaacgcatcccatgggtctctctaataatcatatctgagaatgggaattgaaatgtgccatggcttattcagtgcttaggtagaagacaccacagaaccgtatagtttaagttcaaatctggaagagaagttcaaatccacattaactccarccctcaaagcagcatgcacttgtccatgatgtgtggggatgtgcaactcaggacacggcaagcccatcaaaggcaaagactttgtatccctacctcagtgcctggaatataatattcaataactacctactggatgaataaatgaatgaatgacttgactatcccccaggcagctcatcctcttcctttaaagtggtgcttctctgactcacgcatgcactagaactacctggaaagcctgttaaaacacaggttgccaagccccatcccgagagtttctgagtcagtaggactgaaggggccgcaattttgcaactcaaccaagttcccaggtgatgcttatgggaccacactttgaaaatcactgctttaaggcaaggtagcaggaaaggcaggcgtgactttggagtcaagcaatcaagattcaaattctgttctgactcttcttagctgggtggcctttagcaattccgtcarcccctctgtgcctcaaattcctcctatataaaatggggacaaaatattgactgcacagggttgcaaggtatattatggatatcgggtgaagttttcttaaactgcactgaggtgagaagccatccaaatatcacctagtgtttccaaggaatattaacaattatcagtgcatcccagaccattagacttggggtacaaggaaacatgcaatgttgtacccactctccaaaattatactgtccacttggtatggcaaacaccaatcattcaatataaagtgacgatgacagacgagggctgttggtgcagagagaggcacccacgaagcttcctcagaggagaggccaggcacagggatacatgcttcaacttgtctagggagcccacagacattgagattagccagcccattagagyttagggaatgtctttactcttaatagcatatatttggttttatgtaattattttaacaggtttgttgtcttatagttgattcaaaaacctgcatataaaatatacaatttgataagttttgatatgtttagacacctatgaaacatcaccacaattaagatcctgaacatatccatcattcccaacagtttattcataccttcataattctttcttcctgctcctccccgtcccctcattccagtgcaactattgatctgctttctattacaataggttactctgcattttccagaattttatataaatgaaataatcatgataggtactctttaatatctggcttctttcacttagtgtaatttgtttgagatttatcatattcttgtgtgtttcaagagttcattatttttgttctggagtagtttccaatttggtgcaaataaatttgcamatttttttaatttcttaaagttttattttaattgacaaatataattatacatattatagagtacaatgtgatgttttgatacatgtatataatatgtaatgatcaaaacagaataagtagcatattcattacctcgaatatttatcatttatttgtgataagaaaatttaaaatccttccttctagctgtttttaaatatacagtatattattattaattatagtcactctactgtgcaatagaacagatcttattcctcctatctaactgtaagtttgtacccattgtcaagcatctccccagtccctcttcacccccatccccagtccccaccattgactctctacttctatgagttcaacttttgtagattccacatatgtgtgagattatatgacatttgtctttctgtgcctggcttatttcacttaccataatgcccttcagattcatccatgttttctaaaatgacaggatttccttcttttatggctgaatagtattccgttgtgtatatataacacattttttgaatttactcatccattgatggaaacttagcaatcccactactgggtgtatacccaaaggaaatgaaatcaatatgccaaaggaatgtctgcactcccgtgttcactgcagcatcattcacaattgccaggatatgaaatcaacttaagtgttcaatgacaaatgaagggaaatattgtatgtgagtttatagcttgtcaatctttggagcttagaaattcttggtgcataacaccaagccaatatgaaataaatgcatgtgatagacaagcatgtgatataatccaaaactattcttgactttcttgacaccccttctctgccgcctgactgccccgaacacaaacgcacacacacatgcacacatgtggacacacatataaacaccacacacatatgtacatatatgtgcatgactacacacaaatgcacacatgtggatgcacatgcacataaacaacacacatgtgtgtgtgcacccacacacaggcacacatacatgtggacacaggcatgaaaacaacacacacatgcacacatgcaaatgcatackcacacaaatgcatgcatgtggacacatacatggacatacatgtgcacataaacatcacacatgcacacatgtactgtacacatgtgcacataaacatcacacatgcacacatgtactgtacacatgtagacatacacacatcactacacatgtactgtacacatgtagacatacacacatcactacaaatgtgcccacatgtgtgtccacacacatatgtatgcaggtggacacayatgcacataaacaccatacacacatatatgcacatatacacccacacccacacgcaatatgcacacatagttgcacacaggcacacacacacaaatctacatctgggactagcaaatgttagaagctaatttgcaggaacgccacacagcaccaatcttgttgattctatcaccaccaatataatctttcaaaatatccatatatctgactccatccctaacccaagccattgtcattgcctgcctggatcttgcagtaggtctcccctcatgtttccctcccctcatgacaataagaatgaactttccaaaatccaaacctgacttggtctctttctgcctacaccctttcagtgcttstcactactcttagcatagagacccattgtcttcaatatcatctgtgtgtcctccagggccttgtgtgttctggcccccactacctctctcagctcttttccttcaacttatrgcctggcttaccacactgtggccaaactgacctcgtcttcactctttggacctcctgtacattctccccaacttccagacctcatctatgctggcccctatttctggatgctccccttcccatgcccctagcttccccaacacacacaaactcatacactcactgctagaaaaacccctcctcaccctttagaactgaagctagaaatcacttgctgagggatcccttcctagatccttcagattagatcaaaatggcctgatctcctcatccctctaccctgtatatttccaacataaattctattaaaattgaactagggcatgttctgtgtatttatttttaacatctgacctccctacttgggttggtagagctcatgtatcttgttcatccaacatataagaactcaatgaatagttactgtattaatttcctactgctgctgtaaccaatggctacaaatttagtggcttgaaacaacagaaatctataaccttactgtttggaggtcagaaatccaaaatgaaacttacagggctgtgctccttccagaggctctgcaaagtcctttttgtcatgtaacctgacatatgcacaggttccaggaattaagacacaggcatctttggggcctgggttcaggaagcattattctgcctaccaccattgctaaataagacaccaaggtttccctctcttagcattaaaaccgaaaccacaggtaaaggtaaaggaaatgtcccaggatagcacccattccttcatttaatcattcactcattcattcttctctacagtctgtctaggtgctgagtagtaaacacaacagtggaaaatatatgctccaggaatattacattccctagaggaagaggacaataaataagcaatatcagggataagtgctaaggagagaaggtaaaacagggaaggaagataagaatatgtatgtgggaatgggatgctgcgttcaattttaaataaggtggtcaagaagactgcactgcaaagatgagatttgaggaaagacctgtaggaggtgagggagtaagccatacacttgtcccagggaagagtagcccagcaagagaacaacaggtgcagaagtcctgaggccaaagcaggctgagcttgttctcasgtcaktgtggcaaggggcaaaggggatcagtgcagctggagcagagtgagagagggagacgataagagagcggacaggtcttggcaagccttgcaagtcacagtgaagactggttttgaccttgagtaaaacagaaagccataggaggtttggcacagagcagggacaggatctgatttacatgtgaaggggcagacctactccttaaagagtaccaatttacacccatctccactcctgacccttagcaagtgctcattaaatatatgtgactggctgaaagcatgattctcagagagaaaagcagataactagaggatattgaaccatcagaggtagctcattgtgagccaggggcctgttttcaggagcccaggctgctggaagaataaacaccagggctaacaccattgcctggctctctttcagttgcttggtgaagaccgatttcaagacattgaaaagattaagaccattggcagcacctacatggccgtgtcaggcctgtcacctgaaaaacaggtaaaggactctttggactcagccacaatgcatggtggggtcttgctgttgtcatgtcacygacggtggtgaagcctctgtcaccaagatccttggggaaagatggggagaaaatctaatggactggattataatagttacgtgatgtggatttgcccccaaggtaggtagagtctaccagatgaagccaygctgcttttttgagaaacttctaggctttgttctgaacctcattgttcccttgaacaaaatcaagagcccagaaatagcctattgtgatttagttgtggatcttactaaacccctaatactagcctcttttttcctattttggttttgtctttcaaaagtcttacatcataataataacagttgctgctttttggagtgttgactgtgttccaggcactggtgttaaatggcaacactgtctaccttccagggttaatggatgaattatctcagataatgtcatgctccccaagcaaagccttgcatctagtaaagtcctcaattagtgttaaaagaatatgagtccaagatacttggggaaatggaattctcatcaatttcttccaatccttcgtatgcttttttccaactaaaaacaataaaatacttcaagagtgactatctgggatgaaactcatgctggttattatttggtacgtgtgcagcagggatcagaaaactacagctcacaggtcaaatctggcccaccatctgtttttataaataaaactttattggaaaacagccatgcccattcatttatattttgcctattgctcctttcaagctaaaatggcaatgttgagtgtcacaacaaagaccatatggtcgacaaaccttaaaatattggctatctagcctttattgaaactgtttgctaacctctgttctacaggggcacaaagttctctcatataaaaaatctcattcaatacctacgaggtaggaagggcaagtatgcttatccccattttatagatttggaaactgaggttcagagaggcccagaggcttatgcagcacttcccttaggagttttgtaagcaaatgtatcccttaaacacacactgtgagcaattcaaaggaaatagacacagttcttagactggaaaagctacacatacataagagcacatatacacacacatacccatacccacacatatacccatacccacacacatacccatacccacatacactcacggccacccacacgcccacacacccccaacacacacacacatacacacatacactcattcacacacatgccagtgaacatacactacggaattgatgctacatcaacctgaacagacaggtgtagatgtggaagaaggaatacaatgacccacatatactacactcttgcaagcaaatcttatgtcttcccatgttctgagataccagtgacttgagtgtagaggggctcacccacatgattatttccttaaagggatgtgcaggtagggttgggttaggacgtaaagcccctgctgcagaaatgttaatgttcccccacattccgcattaaatgatttcttctcctcatgtttgcttcagcaatgtgaagacaagtggggacatttgtgtgctctggctgacttctcactygccctgacagaaagcatacaggagatcaacaagcattcattcaacaattttgaactccggattggtgagtagcagctgcaggtggggcctgatagagccagctgaccttgctccaacagaccctcccctgccttgggcatcaatccaggaaagctttttcctgcaaaatgcaatagatctagcatgaccctgccaaggatagggacaaggtcagctcaggcctttcttagtttcctctcagtcaagatgctggaaacaagagtaggatactggcttgtgtgcagaaatacaaagcagccagcctttggcaaatgctagactattgtgaacccctcttccaacttgcctgcccatgcaaggtcgtgcatagagatgtagctgactaatcagtcatttaattctgactcctgggtagctcaatgctggtggtcaatgtattgctctcaaggtcttcaggataattccttcagacaaaagcaggattctactcctgaggatggcagatactatayttccagggacaggctttactcagccacaaagctcgccatttctttgggcttaaagacatcaccgcacaaagcaacaaygtaacattaatcactgcaatcaataataatcctttatatttgccattccttccacatctctactgagcctcagtgacctcctaaaatgcagtctgaatatccctggtctagtccacattctcattttgtagatgagtaaatgcgggcctaygaaaagggagtaactagcctaagatcacacagtcacaccagcagcagctccagcatttcctaactctgagacaatgacattctggctgccagagtgcagtttaaaataacttttgctacggtcctcacactgtagacatcttctggctgatatgccattttactttatctgcttctcccttagcagctttcaagaaaaacaggtcaagaaataccaatatctgacttgtcagatctaaggaatgccatatgtctttgctctttgcattaaagggcttatattttatgtttttgatctatggatgggatgttcagcgcttgttcccacatcttccatcaatcttatcaatgtcatttctgaaattgttgactacacaattgaaccaggaataaaaagggaactgtaatgctgaacagagatattctaagtaaattctgaagatgttgccaaatcagggtcaacccttgccatgacatattacactcgtagtatagtttcactgatctcagaggttggaaaattaacttcccaactgaattaagcatctcaatttgtgttttgggtctgctgtaaccagctgtatgactttgggtgaatcatttaaaccttctgtgtctccgtttcctcctatgtaagctgggtgttaaattattacctcctctgcctctctacctcayaataataatatgagaatcaaatgggatattggctgtcaaagttctctgcaaattttaaagagctaactatcattgtgattcccatgtactccatagagtgagattttcaaatttccagtcacttatatcagtgggtatacgtgtcttkcttttgcctcggcctagaataatcttaccgagatatctgcatggctattcccaccatattctctgctcaacaaggtctttgctaacctccttactcygaratrtactctcttccatctttctccattattttaccctcattgatttttytttgtagccctaatcattcattaatattatattacatttgtaaaattattttctatctctccccagtagaaggtaaattccatggggaccagggctgtatttctttcctttcccaccacatccccaatgcctaggactgtacctggctcatagcaagtgcctagtcaatgtttgtagaatgaaataattgtcttttagaaagagacatacatgcccactaacaggtttagtgaaatgctaccatttctagaattctatgcttcctagtggaggaggcactgaaactgtctttaaaagtatttaccagataaactgtgaaagtgtggggaagtaatagcacaagcagggggaaagtcaggacaaaggcacaaaggtgggtactggctggaaggttaggaaaactccagcagttcagtgtgaatataatgcagcagtaaggaagagagtgggataaatgaggctggaaaatcaggcaaaagccatatcagagaggttattgattgtgagtctaaggatcattggctttatcctgtaagtgaaaggagccctggaagatatttaagtgggttgtaacttgatcagatrtgcaacttgatcagaacgagccctcccgctcctgcagcagtgtggaggatgagctcaagggaacaagggaggagacagggaggacagttagaaagccatcgccatggaccaagggaatgatgctgaggacctgggctaaaacagagagggaaaaggcctgtgcaggctctcagagcactgtgtcagcagaagcaggagatcctagggtcctgacttctggtccatgctctgatcatctcacagactaagacaagtcagtgctcatatgacaataataattatattcaattgaacactcactggttgccaggcaccatgccacagtggctttacttgtattatctcattaaatctgcctttaattatttccattctactgatgagaaaagtgaggtccaaataggttaattaactgacycaggtgatacatctaataagtgactgggggcaggatctggaccctcccgttcatccacagagaccccacacatagtgatcactgtcccagggaggggtccaaacaccccattgtcccccttctccstctgacttcttgctcctttgcttcaccccccaggcatcagccacggctcagtggtagctggcgttatcggcgctaagaaaccacagtatgacatttggggcaaaactgtgaacctggcaagccgaatggacagcacgggggttagtggccggatccaagtcccagaggagacctatctcatcctgaaggaccagggctttgcctttgattaccgaggggagatctatgtgaagggtatcagtgaacaggaaggaaaaatcaaaacgtactttcttctgggaagagtccaacccaacccattcatcttgcccccaagaagactgcctgggcagtactccctggccgcggttgtcctgggacttgtccagtccctcaataggcaaaggcagaagcagctactcaatgagaacaacaacacaggaatcatcaagggtcattacaaccggcggactttgttgtcacccagcggcacagagcctggagcccaggctgaaggcaccgacaaatctgatttgccataaaagcattttctttctgttttttttttttttgtatttcttttatatataaaataaatatactaataaaaaggtttaattttttttagaacaaggatggtttcgttggtctttgaatgtaccagatcaaggacacaatttgagattctcttcaaatgttcccttcacaaatatttattggtcacctcttgtgtacaaggtttattgggaggcaaagataaatgagatctagtttctgactttgagagtttgagagacttacaactaggtggaagagtgggacatgtgaagtgaacagaaactccatacagtcagatactcaccaccatctgctatttttgagcacttgccatgtgccaggccaagcgccaaattttttacataatgacctcctgtaatcctcacagcacttgaccagtacgttcatcagtatttgctgagcaactacaatgtggatatggctgtcctatcctccagggaaatcctagcaaaagtgtttcccttatagagctaacattctggttggggaataatatataatattcttattaaccaatacataaataatctgctttcagattgaggtagaggcaacaaagaaaattaagttggccacttgggataataatctgctttcagatagaggtagaggcaacaaagaaaattaagttggccacttgggataaagaatgggaggacagggatgctgatttaactgagtcaccagggaaggcttttttgaagatgtgatgtcaacgattggccctaaataatagaaagaggtgacccataagacctgagagaaaagtttcgcaagaaaaagtaacagcaagtgcaaaagcccagaggggtatcaagtccggcacattggaggaacaatgagaaaggcaatgggtaagtgagctactgtgggcaagcacactgtttcctggaagacacctacgtgcttatgaccacaagattgccaggaaaatttcatacaggtgagaaagcccagaaaaattaaaggatttggccaaggtcatgtagttagttgtagaactagcttcataactatattgttcaataaaagccaactgctataacaaataactcccaatcttagtggctaaaacacaataaaagatgtacttcttgcttatgttctattggatatgtgtcaaggggtctcctgtgcaatttttgggaagcctaacctccttctgcattggagttctcttcttggccctctctatccagccaactgaggagaaaaaagggaaagaaacaagaatcacttagaaggtctcagctaccaggcatacatcatctttctgtcccacctcactgcaggggaagttagggaatggatgattcctgtgttcccttaccaaaaggaaaagtgaaatgtaactgcctatgccacaggcacctgagtctttctgagcccagagtccatgtttataaacactaagctattctgataagcgctatgttggaggtacaaggtttaagtaattgaatgagaattataaaatcccaaccattctctaaacacttgactctgaacaccatcccatttaaaagaaacttagccccaggtaacaaatccacagtagatataccctcaaaaaaacatctacctgaggcatctcaagtgggaccctaatgttagaagtgaagctgtcttctcttgaggcacaaagcagagagggaattgattcaggtaaaccttgaactttgaaccacatttgggatgctgtttgctctaggaaacgatatacacatcaaagaagtatgccccctccaaattcatgcaaggccccaaaggaatgtgaagatgacaagtgaaaagcctcagcatactgtaaatccctctaccaatgccagaggctgttacaatcttcatagactcagagaatccgaggtcaggaaagccccatgggttgttcagtccaacagactgaggacatttaaacaaagtaaagcttcatgcctgctgagacttggaaccaccagatgcaggtggggagctgagctcaggtaggtcgaggcttggcaaacaaagctagcaaaaaggctggcctccaaaaggtagttaggctgtgaaggcacggtatctgaaaaacagaaaacttgatgtagatcatcaagctctggtctaccccagagcataaggcccatctcaaaaccacagccagtatcaacagagactccagtaggcagacaagccatggtgagctggatctacccccaagaagagaggctagtagggaaagacttcgtttctaaaccctgagctaggactcaggacaaagtccctggactagaagaacttggccctaggcaagataactgggcagaaactaaggtaagaaccatcaggcatgtggatgccaccaatttgggggtgacagtggggttaccactgtaaagcttcacccagaacctgttcctgactcaatgatgtcaaccctcaagatacaacatatggaggagrtggacactccatcctgggtctgggaggtgtgacttcattcaggactccaggaaatagaggagcaaggggacatgatgatgctgagaattctcatcagattgccaaggagcccatcaagtgggcatctggcctctactccaattcacccagcaccaaaacgttgagtcccttccctctagatcagcacattcattggaaccagcagatgtggtctttccatactaaggcaaaaggacaagagacagaaccataaactggcttatggttgaatagctaagaaaacaaccctcttcttgggccttgcatgagtccrgagggggacatgaaggcacacgatcttcctgaattagaagtatgtttctgtttgcctacatttttggtccattcagctcacttagtaaaagaacctgaaatgtcaagtgatttctgggaaacctggcatagtattttagacagggatatcaatcttaccttttcctgctctgaactatgcctgtgagatgtggggtttgattttagaaatgtcaaggataaacacatgccaagggaatggtgcccgaaatgctgaaatacaaggagaaattcaataaggtttagttgaggctttctcaataactctgtatttttgacttactcttctggaagctgatccaggtgggtgcccccaccattcatcagcctgtgtaggaaaagcacagtctcccgtgagacaagcacagccttgcctagagattgggcaaggtatctttagctttcattcaaggactgggtttgaggagctgctgcctcacaatctgccatcacataaagccaggtgggtcacctggagctcagaaatgcccccacaccagtttcaccaattccttccttctttagggaccatgggagtgtagctgctttccactggaagttacaactatgttgtcatctccattttacaaatgaggaaactgaggcacaaagagcttgagcaactcacccaaggtctagcaactggaaaacagggattcaaagccaggtggtctagctcaagagtcctgtccttaaacaccactgttgaagcttgtaagggggtgaataatgttcattaaatgaaagttggatgtctgagtagactccccacttgcatgctgcaggctgtgtgaatgggtaagctgtgaaaaactctggaatgacagccattcagacagcctggggccacttgtcctgatcccaaacagcttcatcctcttcccccaatgggttaaacagcgatttttattttctttctgtcctgtgagatgaaaaaggtcagaaagtactgggctaactactcagaggcagtttcttgaggtgcacaggctttggtttgaatgctatatttatcacttaccagctgtttgatgctgggcatgcagcaggacctctgtgtgccccagactctttacctaccacctgggcatcagaaaggaagttgttgtgatttagaatcccgaagttgtaagacttgaaaagtgtgggaaacgtatcatatacagaaatatctcattttatttcacttcactttatgtatttcacagatattgcattttattacaaattgaaggtttgtggcaaccctgcctcaagcaagtctgtcacaatcatttttccaatgcatgtgctcgctttgtgtctgtgtcacattttggagatccttgcaatatttcaaactttttcattattattatatgtgttatggttatctgtggccagtgatctttaatgtcactatgtattctttttggggtgccacaaactgcacccacataagatggcaaatttaatcaataaatgtcacgtgtcctctggctgttccactaccaaccattccccaatcttgctgcttctccttgggcctccctatttcctgagacacaacaatattgaaattagaacaattaataaccctaccatggcctctaagagttcaagaacctgtattaatccattttcatactgctgataaagacatacccaagactgggcaatttgcaaaataaagaggtttaatggacttagagttccacatggctggggaggcctcacaatcctggtggtaggcaaggaggagcaagttacatctcacctggatggcagcaggcaaaaagggagcttcttgaaggaaactcccatttttaaaaccatcagatctcatgagactcattcactatcaagagaacagcacaggaaagacccactcccataattcaatcacctcccactgagttcctcccatgatgtgggaattatgggagttacaattcaagatgagatttgggtgaggacacacccaaactatatcattccacacctaacccttcccaagtctcatgtcctcacatttcaaaaccaatcataccttcccaacagtcccccaaagtcttaactcatttcagcattaactcaaaagtccaccacccagtgtttcatttgagacaaggcaagtctgttccacctatgagcctgtaaaatcaaaatcaagttagttagttcttagatacaatgggggcataggcattgggtaaatacagccattccaaatgagagaaattggccaaaacaaaaaggctacaggcctcatgcgagtccaacatccaacagagaagtcaaattttaaagcttcaaaatgatctcctttgactccatgtctcacatccaggtcacactgatgtaagaggtgggttcccatggtgttgggcaactctccccctgtggctctgcaaggtacagcctggaggctggtgttgagtgtctgtggcttttctaggcacatagtgcaaaccgtcagtggatctactattctggtgtctggaggatggtggtcctcttctcacagctccactaggtggtgccccagtagggactctgtgtggggctccaaccccacatttcacttccacactgccctagcagaggttctccgtgagatccccactcctgcagcaaacttctgcctgaacatccacgcatttccatacatcctctgaaatttaggtggagtttcccaaaccacaattcttgacttctgtgcaccctcagactcaacaccacatggaagctgccaaggcttaaggcttgcaccatctgaagccaagatctgagctgtatcttggctcaatttagtcatggctggagtggctgggatgcagggcaccaagtccccagactgcatacagcatgggaaccctgggcctggcccacgaaactattttttcctcctaggcctctgggcctgtgatggagggagctgctgtgaagacctctgcaatgccctgaagacattttccccattgtcttggggattaatatttggatcctcattacatatacaaatttctgcaggtggcttgaatttctcctcagaaaatgggcttttcttttctatcacattgtcaggctgcaaattttctgaatttgtatgctctgtttcccttataaaattgaatgtctttaacagcacccaagtcacctcttgaatgctttgctgcttagaaattttcttccaccaaataccctaaatcagctctctcaagttcaaagttccacaaatctctaggacaggggcaaattgctgccactctctttgctaaa

SEQ ID NO: 17651 - DNA, 141121 bp, Homo sapiens
gctaatttttatattttttgtggagacggggtttcgccatgttgcccaggcaggttgtaaactcctgagctcaagagatctgcccaccttggcctctgaaagtgctggggttacaggcatgagccaccgtgcctggccttgatgctgcacttttctaagcaataattcaagtattttttaactggggtagagggatgcccaccctatcaattttatgcacctgctgtttcttatatctcacaatttcaaatgcacacatttaaaatttgcctaagattggtcgcatttgtatgagttgttctcttcagccctttctttcaaaactgtcatggagatacttggctcattctcttggtgttcctgaatgcagtttcagaaatgaaaactttaaaaatcaaaattccagcttggttcaagacattggttggtgctcaatgtgtgtgcatatatatatatatctatatatatatatttttttcattttttcagcacacaggtttttttttttcatttgttttgttttgtttttttgagacaggatctcacttggttgcccaggctggagtgcattggtgccatcatggctcactgtagtcttgatgtcccaggctcaagtgagcctcccgccttggcctcccaaagtgttgggattacagacgtagccattgcccccagcttacacacagtttttgagctcttactctgtgccaagcaccaagctgggtacaaggatccaaaatgaatgacacttggtctatgtccccaagsaccacccagtcggtcagggagaacagacaaccgaacaagccacttccatgccatgttttctgtgtcatcatgatggaagtctgtacccaggcctcccaggccaggatggactgggcaaagagccccaagggagtggactgccgaatttctaaagcatttggccactgtggccagcagagggcatgagagggagtggccattcagcaggggtcaggtttagagggccccgtatgccctcctttcctggggaggatgtaggatttaatctgttgggcctctggggaagccgggatagcttttgcaacatttttggcaatgttctctggctgttgttaatttcaaaatttttcctgagggcatgtgtgagccagctgtttcaggactcggacctttcttgcagacaattttaaagattttcttgagaatttactatgcacaagagaaatagtaatagtatgaaatagactttgtccccagaggttcctagctcaccattcagaggcaaaaggagacgggaaggcaaggactaggcagaggagttgagaccagagattcacaaccaaagggcagttttgcctcccatgggacatttgtcaatgtctggagatgttttggttgtcccagctgatggaggtagatgctactggcatcaaacaggcagaggtcaagggtgttgctctacatactataatgcacaggacagcccccaccacaaagaattttccaaccctaaatatcagtagtgccatggttgagaaatcctggggtaagaacaaggcttgggcatcagaaagatacccatagtactgctatgtatttgtttgagtcgttgttttcaattcttttgggatatacctaggagtgagattgctggatcatatgataattctatgttcaactttttaaggaaccaccagacttttttccacaacggctacaacattttaaattcctactggcaatggttaagagttccaatttctgtacctcttcaccaacacttgttattctctctctctctcttttgggttatagccatcccagtgcatgtgaagtggtatctcactgtgattatatgatttgcattttcctgacacctaagcatgttgaatatcttttcatctatttattgaccatttgtatatcttcattggagcaatgtctatccaagtcttttgtccacttaaaaattgggttgtctttttgttgttgagttttaggagttctttatacattctgggcactagactcttattagatatatggtttgcaagtggtcctcccattctgtaggttatcttttcactttcttgatagcatcctatgattcacgaaagcttttaatcttgatgaagtccaatttacctattttttcttatggtaaattggacttcatcaagaagcatccaatgcttgtggtgtcatatctaagaatcaattgacaaatccaaggtcatgatgaattacttctatgttttcttctaagaggtttgtggttttagcttttatatttaggtctttgatccattttgagttaatgattgtatgtggtatgaagtaggggtccaactttttattcttgtgcatgtggaaatccagttgttccagcaccatgtggtgttaaagaggtaatacttttttttttttttttttgagacggagtcttgctctgtcgcccaggctggagtgcagtggtgcgatctcggctcactgcaagctctgcctcccgggttcacgccattctccttcctcagtctcccaagtagctgggactacaggtgcctgccaccatgcctggctaaatttttttgtatttttagtagagatggggtttcaccatgttagccaggatagtcttgatctcctgacctcgtgatccacctgcttcagcctcccaaagtgctgggattacaggcatgagccaccatgcctggcctgaagagatcattctttctccattggatggtcttgatatccatgtcaaaaatagattgaccatagatgtataggtttctattccattgatctatatgtctatcttatgccaaataccatgctgttttgtttaccatagctttgtagtaagtttttaaattgggaaatgtgaatcttcaaacatattttttaagattgttttggctgattggggcctcttgaaattccatataaatctgtatattcctttggataatatggacatcttaacaataagtcttccaatccatgagcaaggtatgtctttccatttatttaattcttctttaatttcttttagtaatgttttgtagttttcagtgtgcaggtctttcacttctttggttaaatttattcctaggtaggaaacaagtgtgataggcaataatagaaaaaggaaacattgaaattaaacatatttatttctaggtgttttattcttttgaatgctattataaatggaattgttttcttaatttctttttcagattatttaccactggtgtatagaaacacaactatttttgtgtatttatcttgtatcctgcaactttgcttaattatttttattacctctacaataccaaggttttctgtgtgtgtattatctggcactttctacatataggaccatgtaatctgtgaataggggtggctttacttcttccttcctaatctctatgtcttttatttcattttattgtctaattggtttgtctagaacttccagtacagtgttgaatagcactggtgaaagtgggcatccttgtcttattcctggttaaagctatcagcctttccccatttagtatgatgttagctgtggatttttcataaatgtactttattaagttgcagttcccttctgttcctaattttctgaatgttgttatcatgaaagggtgttggattttgtcaaatgcttttcctgcatcaattgggatgatcatgtggtttttttccctttgttccattaatgtggcatgttacattgacattgagycacccttgactgacttttctttaaaaaaaacacatgatgatcttgaaaggaaaaaacccctctgaccctgtgtactacctagaaaatagccttggcaacatatcagcaaattctgctgctgaaagtgtgtaagaagtacttggattgtttagttctgggaaatattgagaacttttccacttcctttaaaaacattgtgttgaaatttaaaaagaaaaagctttatggcagggcgcagtgtctcacgcctgtaatcctagcactttgggaggcagaggtgggcggatcacttgaggtcaggagttagacaccagcctagccaacatggtgaaaccccatctttacaaaaaatacaaaaattagccgggcatggtggggggcacctgtaatcccagctactagggaggctgaggctcaagaatctcttgaacccaggaggcagaggttgcagtgagctgagattacgccactatgctcccacctgggcgacagggtcagattctgactcaaaaaaaaaaaaaggatttttagataccaaattgacctgctgagctttgtggtccacttttgtaatgcttctagtatataattgtggcaaaattggttcagaaatttcaacacatagagagaggtcccatttaaaaattttttttgaaatagggtctcactctgttgtccaggctggagtgcagtggtgccatcttagctcatttcaacctctgcctcctgggcttttcttttctttttctttttttttttgtttttgagaccaagtctcactctgttgcccgggctggaatgcagttgcatgatctcagctcactgcaacctccacctccaggttcaagtgattctcatgcctcagactcccgagtagctggaattacaggcacccacctccatgcccagctaatttttgtatttttatttttagtacagacagggcttcaccatgttggccaggctggtctcaaactcccaacctcaggtgatctgcccgcctcagcctcccaaagtgctgggattacaggcatgagccaccgcactgggctcatttttaaaacaagatttccttcaaataacaatgatctactcattagtagggcagagttagggtgatagaaagaggtgtggcttagagattggaatacctgggttcattctttcaatacacacttgtaagccctcattgcataccaggcactggtctagaccctgcaacagaaaacagtctcccgaggcttgttgggcttctatgctagttgtaagcataccccacactggggatgatggcgcccttcctccctccagggccatgatggtgactgactatatgataataatactagaatgatgatgatgatgacagaagcaacaattccctttcatttataaagtggaatataattaagagtctttaaaaaaaaaaaataacagctttggctgggcgcggtgggtcacgtctgtaatcctagcactttgggaagccaaggtcaggagttagagagcaacctggtcaacatggtgaaattctgtctccacaaaaatacaaaaattagctaggcatggtggtgcatgcctgtagcccaagctactcaggaggctgaggcagaattgcttgaacccaggaggcggagtttgcagtgagcagagattgcggcactgcactccagcctgggcaacaaagggagactgcatctcaaaacaaaaaaacaaaaaaaccccagctttattgagagataattcacatggcatacaatccactcatgtaaaggacaagtcaatgttttttaactgtattcacagagctgtacaaccatcacctcaatctgctttagaacattttcatcatcccaaacagaaaccctacactctgtagccatcatccccatcccactaggtcctggcaaccactaatctgttttctgtctctcaagattggcctgttctgcacacttcatatacttggaatcgtataatatgtgaccttttgtgattggcttctttaacttagcagttttcaaggttcttccttgaaccttggcaggaaactaagatccagaggggtgaaggaatatgtccaagcctgtttcaggcagagcagggaggagaaccccatctctcccctcgtccagtatttcaggaatacacagcaccccaacagcctcctgccccactagcttctttaggagagaaatcacttgattatgtaaatcctaaaatgtctctccttttctccttacagattttctgaatggtcttgcttctttgtytatcttgtctgattttctcctgtctgaccttttcctggttaaaaatctgggggaaaatgacggactccaagccgatcaccaagagtaaatcagaagcaaacctcatcccgagccaggagccctttccagcctctgataactcaggggagacaccgcagagaaatggggagggccacactctgcccaagacacccagccaggccgagccagcctcccacaaaggccccaaagatgcyggtcggcggagaaactccctaccaccctcccaccagaagcccccaagaaaccccctttcttccagtgacgcagcaccctccccagagcttcaagccaacgggactgggacacaaggtctggaggccacagataccaatggcctgtcctcctcagccaggccccagggccagcaagctggctccccctccaaagaagacaagaagcaggcaaacatcaagaggcagctgatgaccaacttcatcctgggctcttttgatgactactcctcygacgaggactctgttgctggctcatctcgtgagtctacccggaagggcagccgggccagcttgggggccctgtccctggaggcttatctgaccacaggtgaagctgagacccgcgtccccactatgaggtaatgtgcattttctccttgtaactgaggagtgcagagttcaggtggggtccacacccttcccaacctgtgcccaccttgatcaagcygtttgctgatgccaaagcttcaagggtggctatgcacaaaaggagaagacacgagccttctcagaagtttccttccttccttctttccttctttccttccttccttccatccttccttccttctttccttccttccttccttccttccttccttccttccttccttccttccttccttccttccttccttccttccttccttccctcctttcaaaatcattccttgaggctgggcacagtggctcatgcctgtaatcccagcactttgggaggccaaggcaggcagatcacttgaggtcgggagtttaagactagcctggccaacatggtgaaactccgtttctactaaaaatacaaaaattcaccaggcatgcaggcgtgtgcctgtaatcccagctgcttggaaggctgaggcgggagaatctcttgaacccaggaagtggaggttgcagtgagctgagatcacgtcactgcactccagcctgggtgacagggcgagaccttgtctcaaaaaaggaaaaaaggaaagaaatcattccttgtgcatctactgcatgcacagggctcgatgccatgaaactgactttctagaagrcctcagcctagttggggaagatgaccttgtgtttagttataatttaagctgaatgagccaaggctggcaagagccacaagtgatgatggtagtctagagggaggggcagttctctctgcctcctgaagagacattgattcattcattctttttttttttttttttttttttttttttgagacagggtcttactctgtcactctgttagctgagtgtactggtaggatcatagctcactacaacctcaaactcccgggctcaagcaatcctcccacctcagtgcactcctgggtagctgggactacaggtgtgcaccaccacacctagctaatttttaaattttttatagaaatgggaatctcaccatattgcccaggctggtctccaactcctggactcaagcgatcctcggtctcccaaagtgctgggattacaggcatgagccaccacacccagcccattcattcattcattcattcagcaggtaactgacaactgaaaaaccagccttcccccagtgatgcctgaaaagcagaaactcaaacactctaaaggtctccatcaatttgattgttggaaatgaatgcctgtaggttcataacaggtgggactatcccagcggctgcagtcagtggctttgttgttgatgttgttgttatccaccttctcctctgccatccccaaattacaaatggaatacagcacttccaggtagaaaatttgggaaatataggagaacagagagaagaaaagagccaccaaccaaaacttcaccagccagagggaaacctctgttctcattgttctacttcttccttctagtgtgtttttctcctctggagtgaagttttactggctaktcttttaagcatctcctgtactctctcccaaattagaaaaatctagaggtggtcttccatacatgtccatgttagcagtgagcttggttttaaccctggtagctggaagtagaagacagagaaaaaggaggaggaaagtattccatatactgaaacttttcaggggaagagtgtttgagtttctagaagggttaagggaagagaaagtctcagaatctagtacaaagagcacagtctgtggagtcagctggagtggggttcagtctttggctctgccaccccctactgtgtgaccttgggcatgacccttcacctctccaggccccagtacctctgtaaaatgtggaagggattaaatgggataatgtaggcaggcatggtggctcacacctgtaattccagcactttgggaggatgaggcaggaggatcgcttgaggccaggagttcaagaccagcctgggcaatatagtragacctcatctctaaaaaaaaaattaagaatttgccagacattgtggtgcatacctatagttctagctacttgagaggctgaagcaggagggtcacttgagcccagaagtttgtggttatagtgagctataattgtgccactgcactccagcctgggcaacagagcaagactctgtctcaaaataaaaaaacaaaaaagaatgtatcaaaccaacaaacttataacatgattattattattactatttcctgagtcttggatgccaaaatagtcgtgaagattaaatgaactaatatttctcaggtacttggcaagagaataaagcatccrtatttggtagataataaatagaaaggggggcaagtctcccacctttccacccactgtcttcctgccaccattttgaggggtctttactggtttgagcttaaaccaaggtttttctgagctggtacatttataaaggygaaaactatctctctctttctctttctttcttctttttttatttttttggacagagtctcactctgtcacccaggctggagtgcagtggcatgatcttggctcacagcaacctctgcctcccgggttcaagcaattctcctgcttcagcctcccaagtagctggaattatgggcgtgtgccaccacacctggctaatttttgtatttttagtagagacggggtttcaccatgttggccagtctggtcttgaactcctgacctcaagtgatccacccgccttggcctcccaaagtgctggaattacaggcatgagccatcacrtctagcctacttaactatctttcatagggaaaatgaaaccaaaatgttgagtgaatttcctgccctcgtgtcttcatggcatagaaacctaacattgtagatcaatcttttatccttactttgtcccagcaaacagctggcaggagggacagagggatcttggaaaggcagtgaatgtggagctgaatgacattgtaggattgtgggcgattcaaaggctatgatatggtgaacgaaggagtgatgtgctgcatgaacttgggtgagtcccttcccctctctgagtctccaatttmtcatctttrgaatgaggaggctgaggctgggcctgatggctcatacctgtaattccagcactttgggtggccgaggtgggtggattgcttgagctcaggagttcaagaccagcctgggcaacatggcaaaacctcatctctacaaaaaaatataaaaattagccagttgtggtggtatgcacctatagtcccagctactagggaggctgaggtgggagaatcacttaagcccaggaggcagaggttgcagtgagctgagattgccccactgcatcccagcctgggtgacacaggcagaccctgtctcaaaaaaaaaaaaaaaaaaaaaatgaatgaggaggctgcaccagactcctgagatgtgacctgtggccctaaagctcactgacatacagttagttattttgtccccagtatgtgtgcattttcagagttgagaatttagaattttagcacccaggggcaatgcgggtggttctgctggcacctcctgagacactggcacttcctcaaggaacattcccagccccagratcaggggcttctgacagagaagactcatgtgtgcttgttgtttctaatgaactgtagtgagaatcccacatcaaagaatcttcagggagtcaagccttagacatgtgtgctggtgcctgctgcctctggtgtttgactggatgaaaaaattatgtccaaacctggtgttccagcctgttggaaacaacgcatatcaaaatgaggctgaggtccagcatggtgactcacgcgtttggggagactgaggtgggaggatcccttgagcccagaagtttgagagcagcctgggcaacataatgagaccctgtctctacaaaaaataaaaataaaaaataaaatgaggccaggtaaggtggctcacacctgtaatcctagtactttgggaggctgaggtgggtggattgcctgagctcaggagttcaagaccagcctgggcaacatggtgaaaccccatctctattaaactacaaaaaattagccaggcatggtggtgcacgcctgtagtcccagctactcaggaggctgaagtgggagaatcgcctgaactcaggaggtggaggttgcagtgagctgagatcacgccactacactccagcatgggcaacagagtgagactctgtctcaataaataaataaataaataaaatgaggctgagcattttattatcttgtagagcttttggctttggattttggcatctttgggatccktggtagcctggtgtttgctggttacccattgactcttttgcacacatacaggcagggtagtaatacctcttccctggtgttcacaggtcaacacccaagcagttttgggtgtrggccatggaaggtggtgtcaaaagacaaaatcacagcaaatttgatttaaaactcgaattggcttttatttacaattctaggatcatgcagcacctcattctgtaaaatagaatgggtcttccgaagagctgagcagagaggagcttggctttataggcagaacagggctgaagaaagcagaaacaagggacaaaggggagcttcatagtttctttctttttctttttctttctttctttttttttttttttttttttttgagacagagtcttgctctgtcacccaggctggaggctggagtgcaatggcacaatctcggctcactgcaacctctgcctcccgggttcaagtgattcttctgcttcagcctcctgagtatctgggactacaggcacatgccaccatgcctggctaattttttatatttttagtagagatggggtttcaccatattagctaggctggtctccatctcctgacgtcgtgatccacctgtctaggcctcccaaagtgctgggattacaggcgtgagccactgcgcccggcccgcttcatagtttcaaaatgactttcccttcagggttaaaacaaatgcaactttcttatcatgttggctcaggtacactggaccccttctgattggttgctattgttttytggaaaactggtcagtttcaaagttcagactgattgcgaggcagttggccaggagtgatccgtcgttttggtttggtctgtaggggctaagcacaggagctcagctcaaaatcatggcctcccatatattaaaattttgttttaattttttagatttggggggtacaagttcagttttgtcacttggatataattcccagtggtgaagcctgggcttttacgagccattgcttgcatagtgtacattgtatctattaggtaatttgtcattccttaccccttcccaccatgccacctttccaaatctccagtatctattattctactctttaggtccatgtgtacactttatttagctccacttataagtgagaacaagcataaattatatttaagggtggtgcatgcaggccagccagccagttgcctgtaaccagctggagcactgaggaaaggaagcctgacccaaaaaggcaaatacagtgagcaagaatccctgttagctgaatccaggaactccttctgaaaaaaaatattatttttcttgaggccaggcacggcaggtcatgcctgtaatcccagcactttgggaggccgaggggggcggatcacaaggtcaggagtttgagaccagcctggccaacacggcaaaaccccatctctactaaaaaaaaaaaaaaatagaaaaattagctgggcgtggtggcaggtgcctgtaatcccagctcttcaggaggctgagttaggagaatcrcttgaacctgggaggcagaggttgcagtgagccaagaccacgccactgcactccagcctgggcracagagtgagactctgactcgaaaaaaaaattattattattttttcttgataagttgctaaataatctgtatcctctggcaaatcttctaaccgtttgaggtcctgtttctgcaaaatggaagcaggggctagaggtttaagctagtccttccagacaggatccaacccttgccccatttccaagacaaacaactaaggcctgggagaagaggccaggggtatttatttgagggttctgactcacgtggaagccacagtgaagaagtgacttgtatttgtggatctgcttctgctctctgcagtttccttgggcagtcacttcactgctgctctgccctggaaggccacttcctacattcacctcttcctgccaggccagtagctgggagactggcaaggcaaggatggaaaatgcttgtgttaagtctgtgatttgggaggaagctctttctgaagcagtcttcaaggggctgtctccttcctgcagtgcccagagcatcccagagttctcacaactgtgttcctgttttgggagttcgcactgggttccctctgaactgraacactctctttctcccaacccctgaacccagacctcccaccagggccagcttcacaggcatgccctgtgcttcaagggaccccgtgcttgttttgacgctttgttgtcgccgtcttgagattcttttttattttgttttttgagacatgatcttgctctgatacccaggctggagtgcagtagcatggtcatggctcactgcagctttgacttcctgggctcaagtgatcctcccgtctcagcctcctgactagctgggactacaggcacgtgccaccacagctggctaatttttttatttttggtaaagatgaggttttgccattttgctcaggctggtcggaatctcatgagctcaagcaatctgcccacctcggcctcccaaagtactgggattacaggaataagccactgcacccagccccaaattcacaataatttttcaacaaggggctctgtgttttcattttgcactgggtcctgcaaattctgtagccggtcctgcctctactgctagctctttgcccatcagagtcacttcctcaaagggccttccctgtccctttctcacatttaaaaaatctaccccccaattaccttcagtatctttatcaatcactctgattagttgtctytgcaacatttaattatttcttgagattatgtctgtttttgtttgtttgtttgtttgtttgttttgacacagtttcactctgtcacccaggctggagtgctgtggtgtgatctcagctcactgcaaccccacaggctcaagaaatcctcccacatcagcctcctgagaagctgggactacaggcatgcatcaccatgtctggctacttttttttttttttttttttttttagtatttttagtagacactgggtttcaccatgttggctaggctggtcttgaactcctgagttcaagcaatccacccacctcggcctcccaaagtgctgggattacaggtgtgaacctccacaaccggctcctaaaagattacgtcttttatttttttatgatctacttggttattacctgtctccctacactggaagcaagttccgtgaagccagggccatagttatagtggtctctgtttttccccactgcctaggctggtgctggctcatggtaggctttgaatatctgctaaatacatgaatgaaatgagctgcaacaagcttgccaaagacagaattctgcattacgggggaatgtaaaacatgtgatgaatgagtgtgggaatggatgaacgaatggatgaatgaatggatgaatgaatgaatggattaattaattaattaacaggtgaataggcattttrtagttgttgctctttagcagcagtaaatttttgttttcataaaattctttctccttgtatcttgtgactttggagactagttctggggtgaaactccaattttaaatttttcttctgtctttgataggatcatgcaaactcagcctttctctcctttctcccagctggcaagggctggctgagaatatgaatccaacaacctcrttaagctctctcctcccatctcctcccctttgggttgatctcagggcagggattagaacttggcctttccttggacttggaaacagtccctgaggtttggaaatcccatgcaacacttagaaacagagctaatgagaacattacatgatgtggcaaaatcrctgcttacatgctctgaaatgagcacggttacaagaacctcctgttctgtgtgatcccattttgttggacaaacagcatgtggttagtagtgcatagtgggcctatgatgagacactcaggttcaaagctacctcttcctagcttgtaccccgacttagtatgaccctgtggggtgcgcatgtggactgaatggaatgggacaggttcaggattgctgagattgcagctggaatcctgaaacttaaagctatgaaattgaagttcataaattagtggtgaactcatttggcagcaaaacctgtcctgaattgatgtgaggttatgtatagtaattatttatcctattctgctgctgaaatattaatatgataatgtggaacagaaagttttaccttcctaaaaacaataatttccaagttccaaaacrtatcaggccctgggaatttcagataagggattatggactatatataacatgcttagaatagttcctggcatatagtaagcacaaaaaatgcttctgcttagtaaatgtgcctaataaatgtgtgtgtgtrtatgcgtatgtgtttgtatgtgtgtgtcttagagggactgtaaagagtgtctccaaatagtaaataatcattttatgtggtatgattatgagtgatttaaattttcttctgcattttctaactttctgctctaaatgtcattttataatgcattttracaatgtataataataaaacagtataaaaatattgggagaaagagtaaaccaatcatctcacttcctagataggaagctgaagcccagagacattccaggcctctcagcaaggtaatcagaggcccagagcaccatttgaacccagaccctcgttagatgtggatgtgaaatcagtcaacgaactgctagtattagtgtcactgcctaaccttcccccagcgggtaagaggcttggactccaggacgggcacctccgtcctcctcctaacttgttctttctattagtgggaagggttgggagattagggtagtttatggataacctttaagtcgtatgagcttgaggacatcatctaccttctcaggggccagactggacactctgaggttctttgtggctctaacagttggtggctttgttcctttatatgtggaggaatggacagcagggagggggctgggagatagagaaggagagtagctggaaaatggcagaaaagtttgttaatttacaggcaggctgaagcgggaggatcgtttgagcccaggagtttgaggctgcagtgagctatgattgtgccagtgtaccccagcctgagcaacagagcaagaccctatctctcttaaggaaattgttaatttagaaccattttctccctggtaaatgaccacagatagtctgggttctaggcaagagagaggacacactaagggatgaaatggtaggtggggaagtcaaggtttgtcccatccattcgttggcccaggagcagttattgcaacccctctgggtgccaggcagtcagttggcactacagatgcaaagatggtgagatacagcctctgtccttagggagaccagggcaaggggtctgagagcccacaggccagggcattccccatcatttttacagagagagctgtggaatagttaagagcacaacacrctggtggctgaggctggaggctggtgtgctggcttctccacctagccatcatgtgacttggggccaagttctgtgattttctgtgcctcagtttcctctgaaatgaagtcatcgtgttacctccctcacagggttgggatcaggcttcattgagttgctgtaagtacagcactcgaagcagcacccatggtgcgatcatggtcattagatccagtgcacggcataagagcccaggacccacaatcaggtctggattcagacctctcctgttacctgtctgagctgcaatttcctgctctgttgaggcaggataatactagtgcctactttaggagattgttgagatcgagtgggagcaagtgctgggggtggacggcccagaggtggttcagtagccattagttgggtgggcttcttccaaagttcttgcctgtgcgcatggttattcccaagccctggccgggcttacatcttaaaggtgtagcaacctgtgtccacggaggaggaagaggattgaaaaggcaggtgaagtgtcccgataaaaggataaagtccaaaacagcagatgggtgctgaagtgttccttcccgccaccatttacgaccatgttgggatcactgaggtaagaacagtttagcaaggcagaccttggatcccaggaaggcaaatgaggctctgtggggtctggacatacagagggggccctgcaggcaaaggtaggtgaaggaataccaggaaagggagctgacaccagggacctggcatcgcccccactttcccagatagcagactgggtgggcttgcagtgcagcctcccagctgcttgttcgtcatcccagcccacatctcttatcggctccaagcaaggaacaggtcaggaaactaaattgtctatgcatatttttatgcgcccctgagtgaaatgccaaggatcttcctgtaatgtttaatttattcatttattgacttaggaaggggctgggagaaactctsktttcaagtctctttagctcctaaaatgtttactttttctttttctttttctttttttcttttcttttcttttttctttcttttttttttttttgagacggagtctcgctctgtagctcaggctggagtgcagtggcacaatttcagctcactgcaacctctaccgcccgggtcccggttcaagcaattctcctgcctcagcctcccgagtagctgggattacaggcatgcaccaccatgcccagctaatttttgtatttttaatagagacagggtttcaccatgttgtccaggctggtcttgaactcctgacctcgtgatctgccctccttggcctcccaaagtgctgggattacaggtgtgagccactgcgcccggcctcctaaaatgttttctaggagcttgggggaaagaggatccctgtctttgagttgttcttgtattaagttaatacaaggtacagagcaactaaccattcatacattcccctcccccttaagcatcattgccctattttagaaaaattattcacttctgctctatacttaatgtaacacagtcccccccaccccatatattgaaagagattatttcattttgcttttctgcaaaaatgaaggcaaattgtatgtggataattttatagttgaggaagtggagagacgggatttacttaaggtcatccgtgaggggaagggtaagttcaagcccatggatggcacagtctttctaccacgctgctggccacatgcatgcrgattttcttgttgattttgtgtgtgtattgttcattgacctgggttttccctctgcaataccagtaagtaaaattgagcttctagtaagtctgagaggaagggcttaatgcatgagacagcaactaccrccatgcttgaactgtttcatcaaaaagcacaacaatggatgtttgtataaaggtggtgttgtgcttgkaggtggatattaggttggtgcaaaagtaatcgtggtttttgcaatcccttttaatggcagaaactgcaattagttttgcaccgactgaatattattcatttctttccgtcttctattccctaataatgcaattagagaaaaatgcaaggtcatgatcactgtgatgaaatgatgagcccacccatctaaatgaaatcccttatttgagaccctgggtcatagtgagatgtgtgaggctgtctttcaggctgtattagcagagaagtgagaatatctatacagtgtttaagtagtgttggggtttttgcaatagagaataaaaatctagagcaatacaagtatgctggcaagcagttctcttctgcatgatcctaactgactttggtagggttggggtattttgaaatatcttcatttcttgattttcattgctttccctattttgaggtggttacatttacactggggatatttgggggatgaatacttgttggttttggtttgaatctctaaaaatcaggatacagtgggttacttttttggaggaggtgaagrcaaggctgtgaacaccttcccagaaacttgaagaactgagaattttgtttatctgttttttttcttaaacctgttgttgaaatgttatttaatatatggtcagrgcatagctatccactgctgtcaggcatggctgcttaaacaggggcccagggtgtttatgttgtggccaagtacttggcacccccgggaagtgtggccctgcctgtgccttttctttcttcctttctttctttttttttttttttttttttttttgagaaagggtcttgctctattccccaggctggagtgtagcgagatcatggctcactgcagcctcagctacctgggctcaggtaatcttcccgcctcagcctcctgagtagctggaattacaggtatgcaccaccacgctggctaattttcatatttttagtagagatggggtttcactatgttggtcaggttggtcttgaactgctggcctcaagtgatctgcctgcctcggcctcccaaagtgctgggattacaggtgtgagccactgcacgtggccttcctgtgaagtgaatttttaattgtattttaaaatttgttttcatgtttttgtttgttttgagacagagtcttgcaatgttgcccaggctggaatgcagtggcctgatctcggctcacttaaacctctgcctcgtgggttcaagtgattctcctgcctcagcctctggagtagctgggacttcaggccaccccgccaccacacccagctaatttttgtagttttagtagagacgaaatttcaccatgttggccaggctggtcttgaactcctgacctcaagtgatctgcccacctcggccccccaaagtgctgggattacaggcatgagccaccatgcctggcctgttttcatgattctgatacattatatttttacacatttataggatacatgtaaaattttgttacatgcatagaatgcataatgattgtagggaccaagggaatatcttctgctttgccctctgaagtttcgctgaaaaattaacttgtaaaaaggcagattagttggagaaaagacacacaaatttaattaatgtgtacactgggagaaccgcagagtgattacccagaagggaatttactggccagcatttacattatttttggttggtttgtkggctatgaaagtaggctacctttattattactgcgatgacttctaggtagtgttttggttctttgcatttattacattacttgaagaagcattcattcatttatttttgattttttgagatggagtctcactctgtcactcaggctggaatgcagtaccgccatctgggctcacttcaacctccgcctctcgggttttagtgattctctctcctcagtctctcgagtagctgggactacaggtgtgcaccaccatgcccggctaatttttgtattattagtagagacagggtgtcaccatgttggccaggcyggcctcaaactcctgacctcaagcgcctgcctcagcctcccaaagtgctggtattacaggcatgagctaccaggcccggcctcattcgtttattctaactggaatcggtttgtctgagttcaagaccctgggctctggcacttcagataacatgcatctctgggccccagtttccttatctgtattatagggataaaaacaataagattgccacgaggattaagtgacacagaggaacaaaggagcacttagtaaatgttagtcttaccagaagtttatttcggatcaccgggctgctggggtcctccctgtcctggaggcactcgcttcagtagcggacccaggtggtgcaaagtgcgtgctagaagcacactgggtgattgcgcagccacctgtcccagggagtggaggtgaaaagatgagagaaaccaggactttgggaaataaaagtcgacttgacaacagggacttttaacgggcacagtggcgacctctgactcacattttaaatttcccatattttccaccgcttccctatcgtgtgtgtattcaagcatatcaattgctgccaatatgtaggggtgtcccatattggggagcaaagcagaagagaggctttaaaaatatatatctccgcagctcatttcggctgccgaagctcagcggcgggtcggaggtaggccggcccgggggcggggctccgtccggaaggcggggccctcctggggcggggtcggtgtgggggcggggcctgggtggggcctaggcgggcgcgatggcccgggactctggcgcgcagggygcatttcgggatggagcaagcgcagcgcgaagttgggcgcccgccggctgcagcagaaccccgcccgcggcgctstaggactgcatctcggcctccgggtcgcgacctggctgtcctgctgggtcccgggcctcgggtcggcttcaggcggttaaggggtgcatgctctgcacccctgcgggagcccggtgggattggcctgcggggtggtcaacatgagtcctgccaagtgcaagatctgtttccctgatcgcgaagtaaagtaagtaagcctgcaattgtaatgaccatgatcttttacaaacttacgcagtcttccttccccttgaagtcaagctgtgtgtcctcttagcaccgccccctttaccsccacccccatccaaagaaacacgggcttgagttggctgctggggagatgatgcccgccttggaaactctagctggccttggcgggaggggaggaaggaggctggacgttgggggtgacgttgcttggaggaggtcgcttcggagcacacaggtgcctaaagatcagcccttgcgcaggggcacgccttccccgctttctctccttcgcctccagaagctgatggttgtggaaggcaggtctcttttgaagctgaagcctgggcaaatcgacgtgaacttgagcaggctctcattgagggtcattttctgagcagatgagcgtaggcatctcagtgcctgagtgctttgtagctctacctacttggttttgtttctttccttttttgtcctcattttattgcacttaaaaagaattaccaaattgatggtgtgtctgttgttgacaattcagaaaattatagataagcaaaaaagaggaacaaaaatcacccataattccacccctgtgatgtttgttaacagttgtatattcttcagcttttttttttttccggtgcagatatgttttaatttataaacttgaatcatgcagaacgttctgtaactcactttttcattcaacattaagtatttttctaccactgggcttggcaaactatgacccactgcctgttttgggatggcctgcaagcagagaatggttttttcatgtttaagtgattgaaaaaaaaatcaaaagaagattgttttgtgacacgtgaaaattacatgaaattcaaatttcagtgtctacgaaaaaagttttattggactgcagcctgctcatcgatttatgatttatgcctagttcatggctgcttttgtgcctcactggaggatttgagtggtgggacagagactgaccagatctaaagtacttactgcctgacccttgacagacaatgtttgccaatccctgcctacaacatgcttttactggattcatagtgttcctttaaatgggtgcaccttaaaatgtatgaataatcctcgccaggcagggtggtgcaagcctgtagtcccaaatactcaggaggctgaggagggaggatgcttttgcccaggagttggaggctgcagtgtgctatgatcgttcctgtgaacagccactgcactctagcctgggcaacatagcaagaccccatctctgaaaaaaaatgtgcccaggtgtggtggctcatgcctgtaatcctagcgctttgggaggccaaggcaggagaactgcttgaactcgggagttcgagaccagcttgggcaacatagtgagacccccatctctacttaaaaaaaaattagctgaggatggtgatgcatgcctggagtttcagctactggaaagactaagggaagaggattgcttgagcctgggagatcgaggctgtagtgagcaatggttgtgctattgcactccagcctgggcaacagagcaagaccctgtctcttaaaaaaaaagtataagtaatcccctataagtagcggatattcaggctgtttctctctgttttttttttttttttkggggggggctattatcaacagcacagtgaggagtacccctgtagctgaatctctgcctccatcctttattttcttaggatatgtttacctggtccataaacattcatgcacacctcccatgcataaggcctgcaactggtagcaggaagggtcgcaaaaatggttggaaaccgtgacctccgccctccaggaacttcggttccattgtggaaggcagatgtcttctcagtaactccaattcgaggctgatgggtgcaacagtaatagccactaccactcatggggtgctttcagtatgccaggccaagtgctttgtaggtgtggtctcatgccatcttcaaaataccactgtgggggcactaagtggagrstgttgtacccatttcacaaaccactttaatggaaaaaaaraaaaacctcacacaaatttggaattgtcccagcaagtccaggacgtggggtccccctatttataataatatggacatactttgttgggggactacattgttcctctcttagcttagagtggctaaaaagatggatttggacgatctaactttgccaccaagctgtgtgatcttctggagcaggtaccatcaagccttggaacctcagtttccacatctgtccaagggactagccctcataggcctttctagagttgttattattattattattattattattattattattacagacagggtcttgctctgttgcccagacagtggcatgatcatggctcattacagcctcagcctccgggctcaagcagtcctctcacctcagccttccaagtagtgggaccacaggcatgcgccaccacacccagctaatttttgtattttttagagagacagggtttcaccatgtttcccaggctggtcttgaactcttgagctaagcaatcctcacaactcagcttcccaaagtgctgggattacaggcatgagccaccatgcccggctctttcttggttcgttgagaytctgtgtggaagtcgctggtcttgagtactgccctgggtcagcacaaacattgatgaaaactaataagtaaagacagagttcggttatgaaagagccctctggagttgggaggcatttgggatcttgtgctgaaggctcgggccatctaagaagccagaactcctgagaaggtgaggtcgsaaatgatgactgatttttcatggcatgagaacggggtcacagttcagagagtagagaaatgattgtggatcagagtgcagaagggcttgaaataaagttggggatgaggaggcagaagttgttttttaatgagtcccatttcactgccatgcaattctgctctgaaaggccagctgcctgcatgcaaatattggctgtagacctatcaggggttttcactcttggctacacattagaatttcctggtggggagatttttgaaaaatctggatgcyggggaccccacctctaccccctagacatgctgatgggaccccgacatcagaatcttataaagtttttcatgtcagggttgaaaactcgtgcctagcttggggtcagcagactgctattataaacggccagacagtaaatatttttggctttgtggccatgtggtctctgttrtaactactcaactctgctgtttcctgcaccagaagccatagttatgtaattgaacaggcctggctgtgtttcaatcagacattatttatagatggggaaattcaaagttcatataatttttatgtgtcacaaaacaggattcttttgattttttttttttttcgatgacttaaaaatgttggctgggcatggtggcttatgtctatagtcccagcactttagaagaccaagacaggagggttgcttgaggagtttgagaccagtctgggcaacatgatgaaaccccgtctctacaaaaataaaccaattagttgggcatggtggtgcacacctgcagtcccagctactcaggaggctgaggtgggaggatcacttgagcccaggagtttgaggctgcagtgaactatttttgcaccactgcactgtagtcctggcaacagagggagaccctgtctctataaaaaacaaataaggctgggtgtggtggctcacacttgtggtcccagcactttgggaggccaaggtgggcagatcgccctgaggtcaggagttcaagaccagcctggccaacatggtaaaaccctgtctctaataaaaatacaaaaattagcagagcgtggtagcacacatctgtagtcccagctactcgggaggctgaggcaggagaatcacttgaacctgagaggtggargtagcagtgagctgagatcacaccgctgcactccagcctgggcgacagagcaagactccctttcgaaacaaacaaacgaaacaaaacaaaaaacaatctaaaaagttaaaaccgctcttagcctgtgggagatacaaaaacaggtggccgagtggatttgacccatgggtcctagtttgcccactcacccctggcctagccaaggtagtcatcccagggggtactgatggggcaggtggcttgagaaatttccaagggtccatttctggagagcgtggttttgtgctgtttgaacgatatcaacctttactgggctacacagtgttctttcttgctttcttgtttggaagtagttgtaattacagaattgcctggctcagaatcagctcttagcagtgcgggtagccgttaccatctctattttatagaagaaaagagagggaagraattgaaggtctgattaatgccggggccctagcctaatggcccagcctgggctcctgtaatgctatcctgcagacgtacatggtagctaaagtgttgcaagctgtttactttggctaggtccagggataaactgttaattccatcatgtgaggaaactgaggcagggagtattgaagtaactttcccaggattacacaggttataagcggtagattctggcttcaaagcctaggaggatggccgcagtctaccagagtttctaaactgcggctctgttgacacttggggctgtccagttctttgtggggctgtcctgtgcattgcagggtgttgagcagcatccctgrtctccacccactagatgccagtagcgcatcccccaagttgtgacaatcaaagatgtctccaggtattgctccccggggagcaaaatttcccccagttaagcactcagggctgggcgcggtggctcacccctgtaatcccagcactttgggaggccaaggtgggcagatcacctgaggtcaggagttcgagaccagcctggccaacatagtgaaaccccatttctactaaaaatacaaaaattagccaggcatggtggcaggcacctatagtcccagctactcgggaggctgagacaggagaatcgcttgaatctgggaggcagaggttgcagtgagccgagatggtgccacttcactccagcctgggtgacagagctagactctgtctcaaaaaaaaaaaaaaaaccaaccaaccaaacaaaaamcctcagcattatacatgtttgtctcttatttgagaggaatataagaggccatatgtgtaatgcatgttttaaaagtccagttaatagaggggcttccatttatctcagattgtctttctgcctagaagttagattctgaggtcagctagagttggatttgaaacggggctctgccacttgccagctgtgaaactggaggtaaatggtcctctctgaacctcggtttcctcatcgtgaacctggagatgacagactcctccatacagggctgtggagattcactgagaggccccctgtgcccagtccatagtgggcagccgagaatgtttatttcctccattcctgatactattctgcctggtcttgtgctccggcagctgactgcatttggtgtttggctgacacctctgctgttgattgtacctgaagtcatttccaaagtcaccttgaaacatttcagctctcacccttgccgtgctgtataaggacagggcttctcactggacaatggcacttaggatgatcctccttcagtggaagcaaatgctggccgaaggtcagctctctagagccaatgttggttggcttccagctttatcaaaaagaattaaaatagccmcttgcccggagattgggcctgaaacaaggccagtccggcagctttgtgtgttcgcttgcctagcctgcggtaatgggcttgtggcctgcctgatggaggggctctgtcaccagtttcgaaatcaacatggtggccaagaatggtttttttgccccctaggccacaaatgaagtttttctttgttgtgctttaggtcaaattgctagagttttaatgtttgtgtgtgtagaaatgggatgtctcagactttctgaagctgaaccatcaagccagccagtcagggaaggtcgtggacagaatgaggggtgcggctgtgtgtgggaatgtcgattagtacaacctctgtggaaaacagtttggagagttctcaaggaactaaaatagatctgccagtctctccagcaatcccactactgggtatgtacacaaaggaaaagaaatcactcagtcagattcgcttttcattgggaggatcttaacatgattggttgaaaacaataaataaaattagcaaggagtccagttgtggggtctcacgcctgtaatcccagcactttgggaggctgaggcaggcagatcacttgaggtcaggagttcaagaccactctggccaacgtgtaaaaccccgtctctactaaaaatacaaaatttagccggacatggtggcgggcacctgtaaccctagttgctcgggaggctgagggaggaaaattgcttgaacctgggaggtggaggttgcagagagccgagattatgccactgctctccagcctgggcgacagagtgagackcagtctcagaaaaataaaataaaataaaataaagaaataattatatcaaaagacacctgtacttgtatagttatcacagcactattcacagtagcaaagatatggaatcaacctaagtgtccaccaacagatgactagatacagaaaatttggtgtatatatatatataattttttatggctcagtagtattcttttktgtgtrtgtgtgtgtgtggtgtgtgtgtgtgtgtatacctacatgtatacatgggtgttcctcttacaaaattaatagcttttttcttattgaaaataacacatcattgcagaacattttttaaaayatagcaaagagataacggctcttaatactttagcatttttttcccccagatcaggggtctgtctacaaatgatgtcccttgggttgcatctacctttttttgtaaataaatgaagttctctttttttttttttttaggtagagtttcactctgttgcccaggctggagtgcagtggtgtgatctcagctcactgcaacctctgcctcccgggttcaagtgatttttgtgcctcagcctccccagtagctgagactacaggcgtgcgccaccatgcccagctactttttgtgtttttttagttgggatggggtttcatcatgttggccaggctggtctcaaactcttgccctcaagttatctgcccatcttcgcctcccaaagtgctgggattacaggcgtgagccaccgtgcccagcgtagcattaaccttttagaagctagaaagcagatgaatgagtggtcactggcttaaggctgagtcctaatggagcagtgaggaaagttggggacccctggccatctgtaccacagaacccccaaaaggcatggtgtctggcagcaagggatgcccctggagctgaggggtaaggagggtaccaaaatgagaaggacagggtggaagactcccaggtcccctcccctgtctcctgcggcaggggctgtccacttcgaccccaacagaaggcagcagttcaaaggtacatatagagggtcttgggagaggggatcgacaggcacagttgagggcatggggcctgtatcccaaataggaagataagggtctgaataggtgctgaattcttagaacttccccgttccccccggggctccaggctgacctttactgtccaggcagaagactggaaaacttctccctggggaatctggccagcgagagagaaagacacraagatactgactcaggggatccccaacgcactcctacctcaccctacattgagctcagggtcaaccaggtccaccacagtctcagaaattctgttctcactcatagtcacaaggttggaaccaaggcttccctgacatttgggttcagtttctttttctttttcttttttgagatggagttttgctcttgttgcccaggctggagtgtaatggcacaatctcagctcactgcaacctccgcctctcaggttcaagcgattctcctgcctcagcctcccatgtaggggggattacaggtgcacgccaccaagcccggctaattttttgtatttttagtagagatggggtttcaccatgttgtccatgctgctctcaaactcctgaactcaggtgattcacctgcctcggcctcccatagtgctgrgattacaggcgtgagccactgcacccggccctgaggtccagtttctcatatgtaagtcaaggtccaaaccagtagacacaggaagcttggaagaaacagaaaccacgctggagaagagaagtttaaaaagctctcattaatatcatcgttgaggtcagacaggatgttgcactcataggaagaggatgctataacaaagggaacatttgtaggccaaaaacaggctcgtagacatcaaaaacatgatagcagaaatgaagaactccactgaatgtttagaagatgaggctgagaaaaatcaaccagcaagtagaagaagagagagaataggagaggggaaaaatgcataaaccagtaggccagtgtaggaatttcaacatccagataataggacttcrggaaaaaatagagaaaaaaagaggcaaggacatcatcaaggargtatttgtttcttgttgttgttgttgttgtttgagatggagtctcactctattgcccaggctggagcgcagtggcacaatcttggctcactacaacatccgcctcctgggttcaagtgattctcctgcttcagcctctcaagtagctgggattacagaygcacaccaccatgcccggctaatttttgtatttttagtagagacggggtttcaccatgttggccaagctggtctctaactcctgaccttaagtgatcttcccacttcagcttccaaaagtgctgggatcacaggcgtaagccaccatgttcagcccatcarggaagtatttgaagacaaattcccaggatggaagtttccagattgagagggcctgagagatgtgcagcctcattggtggaagcagacacatacttgagcycatcactgtgaaatcatagagttctggggacagagggacgctcctataagcatctggatatgaaaaaacaggtcacctacaaaggatcaaggatcagaattactcttgttctagcagccttggaagccacaacacaatggcacaaggcttctaaaacttgaagaaggttttccttcctgaaatttctttttgtttgagatagagtctcactctgtcgcccaggctggagtccagtggcgcgatctcggcttactgcaacctccattctctgggttcaagcaattctcctgcctcagtctcccaagtagctgggattacaggtgcacaactctgtgtctggataacttctgtatttttagtagagatggggttcaccatattggccgggctggtctcaaactcctgacctcaagtgatctacccacctcagcctcccaaagtgctaggattacaggcatgagccaccatgcctggcccttcctagcatttcacacacagccaagtggtaaggttgaatgtgagggcaggagaaaggctgaagtgcaatggtgcaatcctagctcactgcagccttgacttcctgggctcaagtgatccttctaccttagcctcctgagtagctaggactacaggcaggtgccaccatgcctagctaatttaaatttttttttttttttttttgagatggagtctgaccctgttgcccagtctggagtgcagtggtgcaatctcggctcactgcaacctccacctcctgggttcaagcaattctccctcctcggctttccaaggtgctgggattacaggtgtgagccaccacgcctggccctgaatagcctttcttagaaagctacttgaggatgycttccactgaaamcagagggtaaaccaaggaagagcaacacacaggagacaggaaacaggagattcaacatagactgaaagggagtctccagggtgatggtgataaggaagcccagtcaggaatagggcagggaaattgagggcatcattgtcatgcgccttgccattctaccatcttcttaagtggatgaaactactggaggatatgccccagcaaaacaagggagtctaccaagaaagacgagccacccattcccccaaattaggaatccaaccccaaggaaaggcaaagggaattctagggatgtcagcaaagggaagccccaaaacaatggtgatgtaggggcctagaggacagccagtacctacggaaggagaacagaggccttcaggagagatgtcaccagtggaaaaaaacagaactgatmaattatttattattattatttttaatgagatggggtcttgctacattgcccaggctggtctcgaactcctggtctcaagcagtcctcctgccttggcctcccgaagtgctgggattacaggtatgagccactgcatgtggcctgatcaattatcttatgtgtactgggaatctattaggaggagtggggtgatttagcaacaggtacaaggaacactaagtaaaggaaaaaaatcattaactccaggaaaaggcaaaaagaaaggaactaaaatctggtacactgcagctctcatatgtgaataatgatcacaaacttcatatgtgaataatgatcacaaacwagtaaaacattgaatacccagtttgctaaattacagtagacttctatggtattgaccagctggtggaggggagccgatggggtggccttgtgagataactaaattcacatctctcaggatgggaaggccatagatgctgtctcacatggatgactcacaagattgcatacacttgttgtttaggactatggagatgtgtaattgctagaaaaaatcagcatcagtttcctctggtgtggagggacagagcaggwaacctgttttgttgttaaacatttaaaaaattgttttcagttttctaaagaaattttgtgggctgggcgtggtggctcatgcctgtattttggaaggccgaggtgggaggatcacttgaagccaggagttcaagaccagcctgggcaacaaagtgagacccctgtctctacaaaaaagaaaayttaaaaacttctgaaatacaaatgtagaaaagtacatgaaagatattaataccatgtaacaagtcggaacgattagaatgtgtggacttcttccctgatcataaaactctcacccttgttatargttttttagtattattcaggttcctaaacaatgggcatgtaaagtaaaaattaacttaggattaaaaatctaaacatccaccttgggacaggtagaagaaactgctccttctagttcatgtgctggtaccttagctggcctcttaaggtgctttcagttgggtacagtggttcacgcctrtaatcccaatgctttgaaaggctttgacgtcacttgacatcaagagtttggacgagcctgggcaacatagtgagaccccatctctacaaaaatgtttaaaagtcggctgggcttggtagtgccctctgtggtcccagctacccaaggaggtcgaggctgcagcgagccacgattgcaccactgcrtactagcctaggtgacagaatgagatcccgtctcaaaaaaaaaaaaaaaaaaaaaaaaaaaaccgaaggtgcttcctgmccttgagcctccttgtaaattgcttcaggggctctggagagcaagtgcaaagcaggggggctctggtgcagtttggctcctctgctccactggctttacaggtgccgagctctgagtcccaggcttcttccctcatgcacgtctgtccctcattcttattctgcaggccgagcatgtcgggactccacctggtgaagaggggacgggaacacaagaagctggacctgcacagagactttaccgtggcttctcccgctgagtttgtcacacgctttgggggggatcgggtcatcgagaaggtacagatgggtctcggcactctgggtggggtccgattggggtgcaggggcccctcctctcagctggaggtgggagattcgggttcaggctcattctgcctgctgcagagagggggtgagggccacgctcctctgagttttaatagtttaaccctcaaatagaaataatagtgaagcctctttcaaagggctattgtgaggatgaaatgaaataagacaggtaaaacacattgtactgtaaaacactcaaaaagtgttaagggtgatcacaatgacaccaaaggaataaaaaaaaaatcattcactgggctcggcacagtggctcatgcctgtaatcccagcactttgggaggrtgaggtgggcagatcatttgggcccagcctgggtttgtgttcaagttcaagaccagcatggacracatgacaaaatcctgtctctgcaaaaaaattaaaaaattagcaggatgtggtggtgtacacctgtagtcccagctactcgggaggctgaggtgggaggatcacttgaagctggaaggtcgaagctgcagtgagctgtgattgcaccactgtactccagcctgggtgacagagcaagactctgtctcaaaaaaaaaaatatatgtatgtgtrtatatatatatatatatatatatatatatatatttcagacaaacagccatccatccatccatccatttgatgatccattcatgtggatggcagactttgagctcctgctctgtgctggggtgtgtgccatggaaatacatagaaataccaagaggaatgatgtgctgcgggggctgcaggaggctctgcagctgtgaggtggactcggggtagcacgtggcccccagcgcaggtagatgtgcatctacagctccttccttgtcttcccatgcaggtgcttattgccaacaacgggattgccgcygtgaagtgcatgcgctccatccgcaggtgggcctatgagatgttccgcaacgagcgggccatccggtttgttgtgatggtgacccccgaggaccttaaggccaacgcaggtacctgggccttgaccctctcctcccatcacgctccatccttgcctgccctcgcctcyttcccctgtgcctaggcaagtccatcctggactcccgatggtcaggacctctcatgagtctgtatttatttgtccttccttctttatttaattaaaaygtctgctgacatcaagaacaactcatgtgccttacaaaaatgcagatggttaacatgcagagaggaaattcgatctttgagaaatgtctgtgttctagcagattgggggctgtttctcctgcaggtgtatgtaattgtatttcaatcatttgttcattcttccgttcatttgcctaagtttattataatgaatcattctataaacaactgttggatgatttacttttttcctgaacagtcttatccttttataggccctactccccacagcagccaaagtgaccttttaaaagcataacttcttctgctgtattttctgaaggttgttaaaaacaaaaacctcagccagagcgctggctcacccctgtaatcccagcactttgggaggctaaggtgggaggattgcttgagcccttgagtttgagagcagcctgggtaacataataagaccctgtctctacaaaaawtaaaaataaaaaaattaactgggtatagtggcacgcacctgtagtctcagctactcaggaagctgaggtgggaggatcgcttcagcccagggggtctaggctgcagtgagctgtgattacaccgctgcattccagcctgggaaacagactgmgactctgtctcarataaaacaacataaacctaaaagcataactcaggtccgagcacagtggctcacgcctgtaatcccagcactttgggaggccaagatgggcgaatcacttgaggccaggagttttgagatcagcctgcccaatgtggtggaaccccatctctactaaaaatacctcccaaaaatttgccgggcatggtggcaggtgcctgtagtcccagctcttcaggaggctgaggcaggagaattgcttgaatccaggaggcggaggttgcagtaggctgagatcactccactgcactgcggcctgggcgacagagtgagactgtctcaaaaaaaaaaaaaaaaaaaagcaaaacaaaaaccaacataagtcaggtcttcaggtctttttgtgcttctccttaaaatgcatcagaggctgtgtgctgttcccartattagcaacctcagcaccatcccctaagccttcctgccccaagctcttcacagacatggcctcatttgttacttacagctctgttttacagatggcacagtcgaggcacagggatgtgaatttatcacttgtccagggtcacacaaccatcatgtgatgcgggtgggatgggaaccctggtctgggttcagagcatcayccagtgggtcctcccatcttggttagtctaaaattcaaaattgtcacccaggcctattaagtcccctcctggctccatctygaacctcttgccctccatcagccgggtaccagtcaccctgacctctggtagctcctgggcctgttgcagagtcttggcacctgctggaacctctattgaaggtgcttctcccagagccctttgtgcagtggactccctccccacccagcctgtaggtctcaacatgatcatcgcatytctctcagagaacctcatttattttcttcccagcactgacckgagtctgtagttattgtgtttattttcttgtttatcttctccaacataaaagaaaaactggacaaggaccaggaagcctgtctggccgctcacttcatcatctctggaatctccccgttggccgacacttctgtgtttgataaacataggaggcaggcaggccggaaggarcagctgctctgggatttctttctgtgtttgcatataaagtgccacattgttcaatttcaggatcttagcaattctatagtacagatgtcccaacccctgtgtttggattgagtctaacttttcctagtccaaaacactgctcagtggctgttctctgactttggcctcattgatgtgtgggtttttgtttgtttgtttgttgttgctttttttctgagatggagtcttgctctacctcccgggttcaagcaattcttgtgcctcagcctcccaagtagctgggacttcaggcatgtaccaccacgactggctaatttttgtatttttagtggagatggagtttcaccatgttggccaggctagtcttgaactcctgacttcaggtgatctgcccgcctcagcctcccaaagtgctgggattacaggtgtcagccaccgcgcccagccagcgtgtgtttttttaaggacatattcctagacatggaacttctggcttaaagagcatgagtattttaaaatcaaaacattgcgttatgttcagccttaaaaaggaaggaaatcccgtcatatgttacaacacagatgaaccttgaggacgttatgctggtcacaaaaagtgaaataagccagtcacaaaaagacaaatactgcatgattccatgtagaaggggtaactagagtagtgcaattcatagagagagagaagatcgttggttgccaaggacatgagggagggagagaaagggagttgttcatgagtatagagcttcagattcataaaatgaaaaagttgtggacatctgtttcacaatataaatatacttcactattgaactgtacactcaaaaatggttaagatggtaaattttgtgtgtgttttttttttaccataatttaaaactctgkattgtatttttgtttgtttstttgttttttgagacagggccttgctctgtcacccaggctggagcgcagtgacatgatcacgactcattgtagcctcgaccttctaggctcaagtgatcctcctgccttggcctcccaagtagctgggactataggcatgcaccaccattcctggctactttttttggatttttttttttttttttttttgtggagacaaagtctctgtgtgttgcccaaactggtcttgaattcttggcctcaagtgatcctcctgcctctgcctcccaaagtgctgggatgtcaggcgtgcaccaccgtgcccagccctattatattatttaatggtaaaacaatattaagataaactttaaataggactttttttaaaaacccacctctaatcccagtctgttgacagattacttccttcttccttcgttcctttccaggccttccaggccttgtccagaaacatatctgtatcacataattaaaatcatatttcattttctttacattttctttcttttttttttttattagacagagtctcgttctgtcacccaggctggagtgcagtggtgtgatctcagctcactgctacctccgcctcctgggttcaagcgattctcctacctcagcctcctgagtaccttggattacaggtgcccaccaccacgcctggctaatttttgtatttttagtagagacagaatttcaccatgttgcccaggccggtttcgaactcctggcctcaggccatctgcctgcctyggcctcccaaagtgctgggattacaggcgtgagccaccacgcctggccttctctttacattttcatacatgtttgtccattgttaccatagaaatctgcatggttctgctttccatggctgcacatagtcacatcttgtaatgttctgccattgatgtcagtctgtcagcagttccttccttctccctcccatttaatttcagagtacatcaagatggcggatcattacgtccccgtcccaggagggcccaataacaacaactatgccaacgtggagctgattgtggacattgccaagagaatccccgtgcaggtagatggactggggtgcccaagtgtggcccctgagtgtgggatgatgcccctaggttctagttcaattccacagttcacaaggggtggagggtccagatcccacaaggctccaaattcctgggctgatgtaacacagaaaagagtgttcaagtgaggcgaagcacattctgtttttwaaaaaaaattttatagacaggatctcgccatgttggccaggctggtctcgaactcctgggctcaagtgatcctyctgccttggcctcccaaactgctggggttataggygtgagttactgcacctggctgggaggcatattcttgaaggaagattgttgctcacccctttctgtgtttgcaggcggtgtgggctggctggggccatgcttcagaaaaccctaaacttccggagctgctgtgcaagaatggagttgctttcttaggtagagtgtgtccccatcagatacatgggaattggggtattgctgggacactctgctgggtctgaccctctttctcctcctgtcctgtaaagcggaggtccgtttgatttcccacctcacacttctgtcgtgaggagtgagtgagtcccagggtggaagggcacatagctaatctgccaactcatggaattaggagctgcccgcttttcaaaggaagacacacaggcagccaacaagcatatgaaaaaaagctcaacatcactgatcattagagaaaggcaagtcaaaaccagagtgagataccatttcttgacagattctgagattgtggagaaaagggaacgcttatgcactgttggtgggagtgtaaactagttcacccattgtggaaaacagtgaggcaattcctcaaagagccaaaaatagaactaccgtttaacccagcaatcctgttactgggtatatacccagaggaatttaaaatcattcgaccataaagacgcatgaacacgaatgtttattgcagcactattcacagtagcaaaggcatggagtcaacctaaatgcccatcaataacagattggataaagaaaatgtggtacatatacaccatggaatactatgcagccatcaaaaatactgagattatgtcttttgtgggaacatggatggagctggaggccgttatccttagcaaactaacacaggaacagaaaaccaaatattaaatgttctcacttataagtgggagctaaatgatgagaacatatggacacaaagagggaacagcagacactacttgagggtgaaaggcgagaggagggagaaaagcagaaaaaataactattggatactaggcttggtacctgggtgatgaaataatctgtaccacaaacccctgtgacataagtttacctatataacaaatttgcacatgtaattatgtccatgtccttgtgtagtttaggggaatcatttactatcatgtaataaatccctgcttctccttaccggtgggtctgaaaacagtcttgcccaaatgtgaagcaactcagtgcggatcaatacatgatattcacctgaggtacagccgggagtcccatgcccattgacgttttctttgtctgtggactctgagtacatgtgggcatctgtcctgtctgacagttacccaggactctcattatcagtcttaattcctctggaggttgatgatccagcccactggacaaactacagctcataggccaaatccagcctatggcttgcctttgtaaataaagttttattaaaacatggtcgtgcttattcgtttatgtattgcctatggctgctttcacccaacactggcaaagttgagtcattgtgacagagacctgcaggctcgcacaactgaaagtatttcccatctggctctttatagaaagagtttgctaacctatggtccagctctttgagctcctagcttacctctttgatctagctttctgccttccctccaaagtgaattttgtatatgccactgtagcctaggttgtaactcacaacaggtttacartccacatacgttgaaagttgactgatgcaatagcagactaacagattatttttcttccctgacatgaggttaagctccttgagagctgggaccagagaattttctctgtcatctgctccttacctggccccaccaccgtgcactcggtcggccttcagcctcgagggtcttgtgactgacyggattctgcttcccttcttgtcccsgattcctcaggccctcccagtgaggccatgtgggccttaggagataagatcgcctccaccgttgtcgcccagacgctacaggtcccaaccctgccctggagtggaagcggtaagggaccccgagcttccctctgggggagcttctcagcccagtcttgataatgtgaacggtcagggtgacagaagtatgcttgtaacaattctttccattacaaatgttacttacttttattttttagtcattagcaaaatattttaaaattttaaattagtaaacaagtggtataatttattgtaggcaatttagaaaatacaagaagtacaaaaaagaaatggaaatcattcataatcctatgacccagtgttgaacatttattacattgtaggtatctacctttccaacctttttctgggcatattctttgggaaaaaaaaaaaaaaaagacagatcttggccagtggctcatgtctgtaacccaaccccccaacccagtgctttcagaggctgagggaggaggatcacttgaagccaggagttcaagaccagcctgggcaacatagcaagaccccatctccagaaaaagtaaaaaaaaaaaaaattaactggttatggtggtgcatacctgtagtcccarctactgaggaggctgaggcaggagggtggcttgagcctaggaggtcgaggttacagtgaactatggtggcaccactgcactccagcctgggtgatgagaycctgtctttaaaaggaaacaacaacccatcttacatttcctagtttgtgactttttttttcctcactaatgaatatctttctatgtaaaaaatacactttacaccatttaagatgcctgcataggattatatcttatggatgtatcataatttacttaacagtcctcatggttaaacaatttaggttgtttccaatttattttttctaatttaaaaaatattcaaaggaatggagctttgataatcttacagctaaatttatgtgtgcattttaataattttcttaggataaattcctaacagtggagtttctaggacaaattaaaaaataaataggaccgtctcaaaagtttcctattaaatttgtttttttttccccccccaaaagttgaattttaaatttgggatggaaaatttgctttcatttgttaaatctttgcatggtgttgggaaataattattcacatataaatgactccataaggtagaattgggatttttttttggatttagattaatatggttgttgttggtcgactcagtctgagtttctttccttttttgttgttttgttttcgagacagggtctcactctgtcacccaggccaaactgtagtggcatgatcatagctcacagcagtcttgacctcctgagctcaagtgatcctcctgtatcagcctcccgagtagctgggactacaggcccatgccaccatgcctggctaattataaaattttttttgtaaagacaaggtctcactatgttgccagggttggtcttaaagtcctgggttcaagcgattccccccacctcagcctcccaaagtgctgggattataagcatgagccaccacgcctggcagttagtttcttaagcttgatttctcattcaaggttgggttagttcttgaggaaatgaaaagccattgtgagaagctgaagggagtgtctgtattccgctggtccagaagcccaggtctagcactatgtcagcagggagaggcgctgtggtttctgggttgtgtgtgtttctcctggatttgggaggaatcaggtttctttgtgactctccaggcctgacagtggagtggacagaagatgatctgcagcagggaaaaagaatcagtgtcccagaagatgtttatgacaagggttgcgtgaaagacgtagatgagggcttggaggtaaatgcagagcctgtgggggccaggggagccagaaccgaactgcctctgtcctggtagcagttggcaactggctaacctctaaagaggtctgtttgtcctttgcacccaggcagcagaaagaattggttttccattgatgatcaaagcttctgaaggtggcggagggaagggaatccggaaggctgagagtgcggaggacttcccgatccttttcagacaagtgagcagttcttgctgtgtcttttcgcatctgtctttgggaattgtttgtgggctgccagattatttctcttagcattattctgtgacagtcaagaagacatttgtaggagctggatgtatcgttgtatcgtattttgcaacaaacgcgtacatttttactcagaaaagcccatggttttgtgtcgatcttgacagaatcttttaggtagttcaagtctataaatcagtgtatctagaaatgatttcagagatacaggatcaaaatagctgtttgtgactatattggcctatagaggaatgggatattttataaatattagtactcttgttatttctaatgtttctagatggtctattttattttatttttgagacagagttcactctgtcacccaggctggagtgcagtggcacaatctcagctcactgcaacctctgccttccaggttcaaacaattctagtgcctcagcctcctgagtagctgggattayaggcgtgtgccaccacacgcrgctcatttttgtctttttagtagagacagagtttcaccatgttggctgggctggtctcaaactcttggccttgagtgatccacccgccctggcctcccaaagtgctgggattacaggtgtgatcygctgcgccctgcctgatcaattttaactgtaggaacgaattgcacatttacttactggtagctagttttcctcttttaaaaccttatgtccgttatcagcaatgtttagaaaacatttatactgacaatcttcccattcttaaagctattttaatatttctagcttttcttctagaccttcttcatatgtatattttaaagagctgtattcagtctacacgaaattttgctctgcatttaacacattccaaattgtagatcatgaatattattatgttattcctgccttggcaattattttgatgattactcaatattttatgtgtggcaatagccttatttatgaaacctttccttttttgttaaatgtttagcttatttctactttgttattatgaataataataccacagtataatgtgatatttagtactataaataacacttagctcttttttcttcttaattattttcttggataaagacttggggagaaagacttagttaaatagcacacactttacatgcactttgaaacacatatcagtacattgctttctaggagttttactaattataccactcttggtataatatgtgaatgttgtataaagcagcagtttcactaccattgtatcgctgttggggtgtacaagtgttttggggatttgggtggggggaagaattgatattaaaagggaagttgcagcagcagtacagaaagttcacatctatccttcgcccggtttcactcgttaacatttttcatataactttgcaactaagagattaacatgggcacttttctgtttggtaaactccagactagattgaatttcatctgtttttgcaccaatgtccctttcctgttgcaggattcagtcctggattccatattgcattaggggtcatacagattttaaagcttttttgctttttaaaaaatagactttatttattagagcagttttagggtcacagcaaaatggagcggaaagaatagagagttcccacataccccaggccctcaygtgcacacagatgcccaagcttttttattttacttatatgagtgcactatgaatatgttcttaatgtagagagtcagtcaagtcagccatgtgttaagaataaaaaaggaaaaacccttttccccattaccttccaactctcctttctcagatgtaaccactattagcagctgccgatggtggggggctcttttcagcactgtcactgtatatacttttacatagacattcatacagttgtttyattattttttgcatgacttcatcctatacattattgcaaatttgttaaacttaatttgtcttagaaatcattgcacgtgaatacttttcacattgtctttaagaatctctagaagacatgcctataaaacaatgcctttcagctcttaacaggatgaagtaagtttgtccttagattccacccgggagagctagctgagaaagtgcagtaagtggaagaaaaagacaaccacagattagkgtgttttggtcccattttcattcaaagaaactttctctgtatgtgttgctatatgcatagaagaaagccagtttggacaccaaactctttaacagtgcaatatctttaggggatgtgactgtgggagattttaccatttcacagagtttgacttaaaaaagagaatatgttgcaggtagtgactattgggctggcggtgcagctggtaaaggaatttaccaagacagctgtaggtaaagaaaggcagatttattggaggaagtatgaaaatatgttgcaagattgcaacaggcagcacagcagagaaggatctgtctgcaaagaggcaagggctggtgggaggttttatagggtggtgctggaggaggggctgtgaggtcattacgtcctggggttgtttgtgattagccatctctcgagcagttgttcattgttcttccccacctggggccgtcccccacctggggcccctttctcctcgttactgtggagtcgggactccacagaatattatgtctgtgagacaacaaaagtaaaagatcagcagagtcctggatgagtaccctaaacacatcactgcgtttgttttatgttctctcctgagaacttccagaagcttccagagctggtttycccatgaagatcaggctgctctgcttcccccgacaggtacagagtgagatcccaggctcgcccatctttctcatgaagctggcccagcacgcccgtcacctggaagttcagatcctcgctgaccagtatgggaatgctgtgtctctgtttggtcgcgactgctccatccagcggcggcatcagaagatcgtkgaggaagcaccggccaccatcgccccgctggccatattcgagttcatggagcaggtacacttctcagagcccagggggcagcttcagagagagccgtctcagctcagagtcaggaagaactttctacggtcagtgtggctgaatggtggcatgggtgcctaacaagagggatgagggcccattccagaggtgatttcagcatcacacaggtttattggattagccggtctgtgaactccccaaatatttcttttcttttttgagacagagtctcactgtgttgcccacgctggagtgcagtggtgcgatgatagttcacagcagcctgtaactcctgggctcaagtgatcctcccacctcagcctcccaagtagctgggactacaggaacctgtcaccatgtctggctaattttaaaaaaaaatttttgtagagacagagtcttgctatgttgcccaggctggccttgaacttctggcctcaagtgatcctcccgccttggcctccttaagcgctagggtgataggcatgagccaccacacctggccagtcccaaaatatttcacatgtagcaggtgctcagtctgcatttggtgaaggaactgatagtcaccatttacagttccctgaaaagacctctggaacccccttggcctctttctgtttcttcacagtgtgccrtccgcctggccaagaccgtgggctatgtgagtgcagggacagtggaatacctctatagtcaggatggcagcttccacttcttggagctgaatcctcgcttgcaggtggaacatccctgcacagaaatgattgctgaygttaatctgccggccgcccagctacaggtgagaaaatgggcttggggccctgggacttctctgccctgggtcaggggtccatgtgctgctcccattagtccatcycgcccatctcttggccgactgtcccaggggaatgactggccaaagagcactttgagaaatctgtaaaagctatagttctccctgggaaaatatcttttatacaatttcaggacattcatagacctagagraatgtttcttaaccttgttatcattatcactccctgcaaggatcctttggacacattttatatcctaatccctgtcttgtgaaattttaatatcacaaatataccacatacctgtttggatattgtagatatatctgtgctttattcatgaaaagagtgagattttcttcactcccaagaacaaatatttgtctcttcagaggcaatatcatccctgttaagaatatgtgatccagagttgtaacctcttgggttaaagggaactctaaattttttttttatttttaattttgatgggtatatagtaagtctgtatatttatagggtgcaagagatttttgtttttgtttttgtttttttgagacggagtcttgctctgttgcccaggctggagtgcagtggcgcgatctcggctcactgcagcctccgcctcccaggcatacaatgtgtaataatcacatcagggtaaatgggtatccatccccctccagcgtttatcctttctttgtgttatggtgttatgaatattccaattatactcttttagttaattttaaaatgtacaataaattattgttgactgtagtcaccctgttgtactatatcaaatagcaggccgtattcattctcttaatcactacatttttgcgcccattaatcatcctcgctttccatgcccctacctcttcctttccagcctctggtaaccatcattctactctctgtgtctgtgagttccattgttttaatttttagctcccacaaatgagtgagaacatgcaaagtttgtttttctctgcctggtttatttcatttaacataatgttctccagttccatccacgttgttgcaaatcatggtctcattcttttttatgtctgaatagtactccattgtgtgtatgtaccacattttctttttcctttttcttttcttttttttttttttttgagatgcagtctcgctctgttgcccaggctggagtgtagtggtgcaatctcggctcactgcaacctccacctcttgggttcaagcaattatcctgcctcagcctccctagtagttgggattacaggtgcacactactatgcccagctaatttttgcatttttagtagagatggggtttcaccatattggccaggctggtctcaaactcctgacctcagatgatctgcccacctcaacttcccaaagtgctaggattacaggcatgagccactgcacctggcctgtaccacaytttctttatccaatcatctgttgatggacatttaggttgattccaaatcttggctattgtgaatagtgctacaataaacatgggagtacagatactcttcgatatactgatttcctttcttttgagtatatatttagcagtaggattgctagattggtagttctacttttagttttttaaggaacctccatattgtcctccatagtggttgtactaattttcagtcctaccaacagtgtatgaggggtcccttttctccacgtccttgctagcacttctttttctgttttctttttcctttcctttttttttttttttttttttttttgagagtgagtcttgctctgttgcccaggctggagtacagtggtgcgatcttggctcacagcaacctctgcctcacggttcgaacaattctcctgcctcagcctcctgagtagctgggactacaggcgtgtgccacgacgcccagctaattttttgtgtatttagtagagatggggtttcaccgtgttagccaggatagtcttgatctcctgacctcgtgatctacccacctcagcctcccaaagtgctgggattacaagcttgagccaccgcgcccagctgctagtatttcttattgcctgtcttttggataaaagccattttaactggagtgagacaatgtctcattgtggttttgatttgcatttctctgatgatcagtgatgttgggtgccttttcctatgcctgtttgccattcgtatgtcttcttttgggaaatgtctattcagatcttttgtctgtttttaattggattcatgagacttttttcctactcagttgttttagcttcttttttgtttttgagccagggccttgctctgttgcccaggcaggaatgcagtggcatgatcatggctcactgcagtcttgacctcctgggctcaagcgattctcccacatcaacctcctgagtagctgagactacaagtgtgcaacaccatgcccagctaactttttaaaattttttgtacagataaggtctcactatgttgtctaggctggtctcaaactcttgggttcaagcagccctcccacctcagcctcccaaagagctggtgttacaggcatgagtcaccatgctcatccttgagcttcttatgtattctggttattaatccctcgtcaggtggctagtttacaaatgttttctcccatgctgtggattgtctcttccctttgttgattgtttcctttgctgtgcagaagtttcttaacttgatgtgatcccatttgtcctttttttgctttagttgtctgtgcctttggggtattactcaataaatttttgcccagactgatgttcctgagagttcccccaatgttttcttctagtagtttcataatttcaggtcttagatttaagtctttagtctattttgatttgaagaatttgattcttcatttatgattctgcatatggatatccagttttcccagcaccatttatcgaagagactttttccccattgcatgttcttcgcaagtctgtcaaaaatcagttcactgtagatgtatggatttgtttctggattctctattctgtcccattgatctatgtgtttgtttttatgtcagtaccaccctgttttggttactgtagctctgtaatataactcatagtcaggtaattcaattcctccagtgtttgttcttttttttcaggatggtattggctattctgggtcttttgtgtttccatataaactttaggatttttttttctatttctgtgaagaatgtcattggtattttggtagggattgcactgaatctatagattgctttgggtaatatagccattttaacaatactgattcttccaaaccatgaacatggaatatctttccatttttgtgtgtcctcttcaatttctcacatcagtgttttatgctttttattatagagacctttcacttctttggttaagtttattccagggattttattttgtttgtagctatcataaatggaattactttcttgatttttttttccagaccattcgctcttggcatatagaaatgctactgatttttatatgttgattttgtatcctgtagatttactgaatttgtcaattcgaattgtttttttggtggattctttaggtttatccaattttaagattatatcatctgtaaacaaggataattggacttcttcctttccaatttggatgtcctttatttcttctctaaattgttttcattgttttcttccttccttccttctttcttcccataatggggtctcattacgttgcccaggctggtctccctcccttcctctttttcttccttcagcagaattttttaaaaagttttctttatttttttttcagtttgaaagatttcaaaaaagttgcaagaatgatacaattaatacccatacgccctgcatatagatccatcagttgccacatttgctttgtctctcttctgtctgtttgtataattttagggggctcaatcttttttttttttctttgagatggagtctcgccctttcacccaggctggagtgcagtggtgcgatsttggctcactgcaacctccacctcccaggttcaagcgattctcctgcctcagcctcccgagtagctgggattataggtgcctgccaccacacccagctaatttttatatttttagtagagacggggcttcaccatgttggccaggctggtctcgaactcctgacctcaactgatcagcccacctcggcctcccaaaatgctgggattacaggtatgcaccactgtgcccggccgtgggctcaatcttttgagcaatggtttgagtgaaccttcgtaacatatggcctctgaatacttcattctaaaggcctcctagaacaagagcattccggtccaatgccctagtgcaattatgacacttgagaaatagagcattgataccacatctatatctaatatataccattcacattaaatattttccctgttgttccaataatgtctttttgtagctgttttttgtctcttaaatccaggatccaacccaacccagggtgacacattccattttattttcatgtgtctttaatctctttaatctgaaagcatttcgtagtcttttttcatccttgacattggcattaaaatttttttttttttttttggtgatggagtctcgctctgtcactcaggctggaatgcagtggtgcaatcacgactcactacagattcaacctcccaggctcaagtgatcctcccacctcagcctcctgagtagctgggaccacaggtgcaagtcaccatgcctggctaatgtttttttaattttttctgtagagatcgggtctcattatgttgcccaggctggtctccaactcctaggctcaagcgatctgcctgcttcagcctcccaaagttctgggattacaggcmtggacactggcatttttgaggagctcaggcagaatgtccctcattggatttctctgattgtttcttcctggttcgattcctgctacacattttggcagaatactacacaggtgttgtgtccttaatacatctcatcatgaagcctgttaaatctgatcatttggttaagctggttccataattgtctactttttacccattcttcatgtccagtttccccttcgggtgccctttacaaaaacttcctttaactctgcagccaacatggttgcttctcaccttccctagctctaaaartctagtgcttttacttgatgcatgtattttcttgttgtgtgatgttgtttcataaatatttttccttttcccaactgtactatttgctccactgtgaaaagttcatgtcttatggctttttctttctttggctctctggccacagtagagcaccatgttgtctatagagtagtgtctgtatatcctaaatcattgactgaacctccgttgcatctaccactgtgcctggtgttttggggccrtgttctggtaggactgacagtctgtgggttggatctcttgattttagatcgccatgggcgtgccactgcaccggctgaaggatatccggcttctgtatggagagtcaccatggggagtgactcccatttcttttgaaaccccctcaaaccctcccctcgcccgaggccacgtcattgccrccagaatcaccagcgaaaacccagacgaggcaagttatgggggcccctgtgtttccaccatctcagatctcccagcatgtgggggaccctggatgttagcctgggaagagacacccacaagctatccaggcatctcagtttacaaatggggaaactgaggcatgggaagggacatcccatggtttatttgattattggatttattggatttttatttttatttatttttatttttttgagatggagtctcaccctgtcacccaggctggagtgtagtggcgcaatcttggctcactacaacctctgcctcccaggttcaagcgattctcctgcctcagtctcccaagtagttgggattacaggcgcccgccaccacgcctggctaatttttgtatttttagtagagacggggtttcaccatattggccaggctggtctggaactcctgaccttgagtgatccacccgcctcggcctcccaaagtgttgggattacaggcatgagccaccacacctggctggatttactggatttttggattattgccaggctctgggccgagccttcccatgtctcactgctcacttataggacactactgctgctggacatcgtcaccccacattacaggcaaagagcctggggtaacttgcttcctgtctcccacctgggacctgctgagacccatcagtggactccaaaagccatgcctatctttgggacaagcagccaggtttagaaccctagtccttggatttctggccccgtgtgctttttgcyacagtatgaagtctggctcattgtagagagtccctttgtgacttggccttacttgggtcttaaaaaacaaaccaactggcatcccttacagtttacatgcataccgaccgttgattgtcacaggactcatcaatctactacaacttaattgcttaattattaccctcaggaaactgggggtaagagagggtacacctccaccccttttaattaaataattttaagctagggtagctgtattcatttagggttcttggctgtgaaccaaacaccaactctggtggacaagcaaaaggggaattttttggagggatgatggctcgttcccaggttcctaggaggatggaggaccaggtatggtaacagcccaggcacttgggtcgctccatctctcacttctacatacctctycccaaatccttcatcccttagttcaggagccctaatcccagtgagaggtgccatgtccacccactcttaccaaaattgtacttagagggagacgggccgttctcccagagggaatcaggtgtgtgttggcagcagcctggccgatggggtgaggaaaagggggatggagggagggagggaggaaggggtaggaaaggaaggagggaagaggggagtgaggaaggacgaagggagagagggaaggagggagggaaggaggaaggaaggagagaagaaaggaaggaaataccaacgaaatggcctcttccctagcagcaagggccctgcccaggatgccctggatttcttcacctgcagaggttttcattatccagaattggaaatctaacctgtcttcacttctatttaaactttttattttcgaaatgtcaagcatataaagtcagaatgtcccttcactcagctccatcaatcatcaatgttcgcccatttaacacctgcactaccatctctgtcccaactcgcttattttatttatttatttatttatttatttatttatttatttatttatttgagacaggttcttgctctgtcacccaggcgggagtgcagtggcgtagtcatgcctcactgcagcctaatctcctgggctcaagagatccttctgcctcagccccacaagtagctgggactacaggtgtgtgccaccacacctggctaatattttaattttttgtagagatggggtctcctgatgttactctggctggttttgaactcctgggctcaagtgatcctcctacctctgcctcccaaagtgctgggattacagacatgagccactgcgactgaaccaacttcgttatttttttacagttaaaaaaaataagaattataggcattgaggagctcatatgggtacacccatgaatagatacatccatacctgtaacaagcgatatcagtgttctattgactaccctaagcttttggtcagcgtaggggttcttgggttttcccaggactgaattctgatgaaaatatatctggagtaatgatttcttccattttgcattttctgtccggactccagggttttaagccgagctccgggactgtccaggaactgaatttccggagcagcaagaacgtgtggggttacttcagcgtggccgctactggaggcctgcacgagtttgcggattcccaatttgggcactgcttctcctggggagagaaccgggaagaggccatttcgtcagtatctccttccttccttccttccttccttccttccttccttccttccttccttccttccttccttccctctctcccttcttcccctcttccttccctctttctcctcccttcctttcttcttccctccctctcagcctttctccttttttccttccttcccttccattgccttcctgccttcctttcttccttccttcctcccctcttctgccctcccctccccttccatcccttcccctcccttccttcctcccktccttyctcctccccttcccttctttcctcccttcctccctccttccttcttttcctgacttctctgctttcctccccctccctttcttcctccttctttccttccttccttctttccctcccttcccacttcctccttttcccaattccttcctttaagaaatgaaacggtcccctggggcttcagatacagtagcatttcaggagaccaagaaaagtaaatcacagggtaggccccattttaaataccctgtgcttgaagttcaagatcaaagcctgccctttttttcctttattgaagatccacaaagtaaaataagtgcaccaaggtcatttggtcttgagcttataagagttctagcttgaaggagatctaaagattgttctaggagatacccaaagtgtaaaaggtgctaagtaccatagctgaagaaagggggagggaaactcctttacatttaaaccttatcagtagttccctaatgggttgtatttcacaccgaagactaaattttaaggagtgtgtcctgctgtgaaccacccaccacyctgaggcctgtgacagcagccccatgtccccagctcagccaagtcctcccatacttgtgatagtttctgcagagctgagaagcccacattgacagagggacccccaaattctgacacaccatctccgacacttctcctggcttgacatgggtgtggaaaggtataaaactagtttactttgtaattaaatgtttttgtgtgggtaactgcccttcggagtgaaaaaatcccaaaggccttagcattaaaatctgacgtggggcacttagccacgaattaaattgagttgggcagttttgatgatcaggttttctttgccagcttagaataattaattttaatcatgcttagtgaaaaatcaagatccttgaagtttatggaagattgcagcaaaaagggcttacttaataggagtaggcggaagacaggtcagccagcccagacccctccgagtgaagtgacctgtggcttgtcacatgctacgagtggaccaaccgcaacttcaacagaactcacaggcagaaattccagcttttcttattgctgttagtgagagtccagtagggggatcaactgtcctcgttttcctggcaccggtttctcaggttgaaggacttctcagtgctaaaatggggaccrccccaaggaaactgggacaagtcactcacccgtgagaccagcgggttaactctcatacccagcttccagacccacagctgacttttcatggcctatggatacccttgtatgaccttactgggtcttcattttctcacccccaaaatggggtcatcagtgtccttccccgttacctgctgacagcacacaggatgctgcaagacatgaaagcttactcggccaggcacagtggctcatgcctgtaatcccagcactttgrgaggccaaggcgggcagatcacttgaagccaggagttcaagaccagcctggccaacatgacgaaaccccgtgtctactaaaaatactgaaattagccgggcatcctggtggccatctgtaatcccagctactcgggaggctgaggcaggagaattgcttgaacctgggagatggaggttgcagtgagctgagatcgtgccatttcactccagcctgggcaacaagagtgaagctccgtctcaaaaaaacaaaaaaaagaaaaaaagaaagctttctctcccagaagaagaggtgttcagatacctgcccacactcaccatgaattcatagggctcagcttcccgagtagctgggactataggcgcgtcccaccacgcccggctagttttgtatttttagtagagacgggatttctccatgttggtcaggctggtctcgaactcctgacctcaagtgatccacccgccttggcctcacaaagtgttgggattacaggcgtgagccactgcacctggcctgaggtttagctatttgaactggtgctcttggagatttggagtctgtgtgttggggagaggcagccatggggcccaccaggcccctgagccgggtgacagtgccgtccatctgcaggtgcaccccacacacaccaggcagagcagctgtgtggaaggtgagagggtggcaccagctctggggacaggagatttgaataggtcaagggagagacagaggcggtgaccgattttccctttgttttttttttcttcttttaagagatagcgtctcactgtgttgcccaggctggagtgcaatggtgtgatcatagctcactgcagcctcaaactcctgggctcaagcgatcctccccctttagcctcctgagtagctgggactacagtcacataccatcacgcttggctgattttaaaatttttgtagagatggcgtctcattatgttgcccaggctggtcttgaactcatgcctcaagcaatcctcccgcctcagactcccaaagcagtgggattacaggcatgaaccaccatgcctggctggttctttctctactaatcattaactattatagtcaataattataacaataataactaatcacrttcattgtagttaacatttattgatcagtgaccatgtgcattacatggattgtctcatttcaattctcgaacaccctcatgaagtcagggctatttccccattttccatatgaggaaactgaggcccagagttctcaagtcacttggccaagattagccaggcagtaaaccctggygctgattcaatgcactggctgtgtcagtcagagccctctcttaactcttctttttttttttttttggagacagagtcttgctctgtcgcccagcctggagtgcagtggtgtgatctcagctccctgcaacctctgcctcccagattcaagtgattctcctgcctcagcctcctgagtagctgagattacaggcgtcctccaccatgctgagctaagttttgtatttttggtagagatggggtttcgccatgttggccaggctggtcttgaactcctgacctcaagtaatacacctacctcagcctcccaaagtgctgggattacaggcgtgagccaccacacccggccactcctgtgcttttccagttctctgaatcacatcattgcagcaactctgttgatgtatgcatgaatttggaaaatgatccatgtgcctttcccttcaaggaacatggtggtggctttgaaggaactgtccatccgaggygactttaggactaccgtggaatacctcattaacctcctggagaccgagagcttccagaacaacgacatcgacaccgggtggttggactacctcattgctgagaaagtgcaggtagggagtgagctgcctgtgtctcccctctggatggccgagacctcggcttcctgaggatactgaagtgcattttctcctaggcggagaaaccggatatcatgcttggggtggtatgcggggccttgaacgtggccgatgcgatgttcagaacgtgcatgacagatttcttacactccctggaaaggtaggggctgtggcagttcccttctgcttttgtgatatgtgttagyggcttaggaggctgaatctgtctcctttatttgtgtggccagttagtcaccaggcaattggtgagtctctcctccggtcttgcctctgggaaattcctctacagatcaacctaggctacccttgaagaggctgtgggttagggaatgggattctcgaggccagggtggcagtcagtgaacaggctgttgtgtayggatccatgctgacttgtgtaaggtacatcataatagtcaggagttctgagttcaaggaggtggatttgggaagcaaagcggcttaaaggtcatctctacaagcgggtgcattcccagaccctcaccagaatcagagggtcatcatgaaatggaccagaatggaaagcaaccaggcgatctctgttaggataggccggggtttctcagcctcagcaccattaacattttgtgctggatgctttttttttgtttgggaacctgtcccgtgcatcataggatgttagcagcattcctggcctctacccactaaatgccaggagcagcccttccctctgagtcatgacaatcaaatatatctccagacattgcccaatgtcccagggttaggagtagaataatcacccccagttgagaactgctgcaagaggcaaaggaactatcaaaaagaaaataaaaggataawcttttttttttttgagacagagtcttgctctgtcatccaggctatcacccaggctagagtgcagtggtatgatcacagctcactgcagcctggacttcctgggctccagtgatctgcccacctcagcctcccaagtagttgggaccaccggtgcatgccatcatgcctggccaatttttttaactttttgcatagatggggtctcactatgttgccccccaggctggtctcaaactcatggcctcaagcaatcctcctgcctcaactctgaaagtgctgagattataggcgtgagccactgtgcctggtaagaaatgtttttagtgtttggttatgcttttgaacggtagtagaatcacagyccctgctctggtttctttcataagccgaaggcaggatcccatatgtgaaatttttccaagagaccgttatggattttgctcctgaaaagcctttgtaagatttcaaatccctcagcaagtgctgattccttaagttctaagcaatatcaggctgctcagggtgattcaggttctgtgcgtgacttttaatcagatttagcctttttttttttttttttgagacatagtctcgctctgtcacacaggctggagtgcaatggtgtgatctcagctcactgcaacctccgcctcctgcattcaagcaattcttgtgcctcagcctcccgagtagctgggatgacagctgcatgccaccacgcccggctaatttttgtatttttagtagagatggggttttgccatgttggccaggctggtctcgaactcttggcctcaagtgatgtgcctgcctcagcctcccaaggtgcagggattacaggcgtgagccattgcgcccagcccaggcttagcatttttagtgcagtcaggtttgctgatgcagagagttgcgtaatttttttaaatgcaagggatggctgtggagttctcagtccctcccaaggstgaccacaaccctgtcttttctttcaggggccaggtcctcccagcggattcactactgaacctcgtagatgtggaattaatttacggaggtgttaagtacattctcaaggtaaatgcccccgtgcytctccgatgtctccaacactctgcaagcttcagggagtttctttcttccatgaaccatccctggagtggatttgctcatgcttgggtttgagctcttgtgttcctcgggaatccccatgtagtccgtgaccttgacacctaaacactttggcttttagaacatgtagggctgtgcattctgcagagggcacaatggagcgtggataagtttcctgtagctgcggtaacaaggtaccacaaactggtttaaaccaacaaaaatktattgtktcccagttctggaagccaagtctaaaatcgaggtgttggcgggccgtggtctctctgaaggcgctggggcaggatctgttccgagcctccccagcttctggtgctgctggcagtccctggtgatttttggcttgtggatgccttgccccagtctctgtctctgttttttkttgttgttgttgttgttgttgttktttcaaacggagcctcactctgtcacccaggctggagtgcagtggctcaaccttggctcactgcaacctccatctcccaggttcaagcaattcttctgtctcagcctcctgagtagccgagattataggcatatgccaccatgcctggctaatttttgtatttttagtagaaatgggatttcaccatgttgcctaggctggtcttgaactcctgagctcaagtgatctgccctgccttggcctcccaaagtgctgggattacagkcatgagccaccccccggcctctgcctctgtgtgtgtgtgtgtgtgtgtgtgtgtgtgtgtgtgtgtgtgtgtgtgtgtgtgtgtgtgtgtgtgtgtgtgtgtgtgtgttcacattatcttccatgactgtgtctttgtgtctcttctcttgtaagaacaccagtcacattggatttagcgtccaccctaatccagtatgatttcatcttaattacatctgcagagacctcattccaaataaggtcacattccaaggttccaggaaggccatgaattttggaggatattattcaacccctatagaatgtgagctgggcctttgctgagacagaatagtgggcccgggtctgtttccaggggctctgaggctggttttgttctctgtctctgcaccacgtgtagattwctggcrtcttccctggtttactactggagtccctggggcttattccggttgctctcctctgtcagaagtgcctagttgccctttgtgggccatccaaggtcaattcaacagtgtcagaaatgtctctgagatgcacaggtagggggtgaggcttggtgtcctagccatggtgttctgggcccagggtccttgttggggtgagccggctgtggcatcagtgccccgggttccaatgcaatggcaggaggctgtgtcccctgtaagcccaggcctgcccagtacttcccagcctcacattgtcaggagggaaaagaggacagagtttgagtctgcttatgagacagaatttttgttttctttaattagtactttctatttaatattgatgagcatgagtagaactcacaactttggagatttgggggctttagttcaactaaacctgtgtgtcattgatcagggtatgctttcacaatcatcctcctttgcccctaatgcctcttggctacctttggggacctagctgcccccaacttgattttaaatgtcacatatgcacaatgyagaaaatttcaaaatttcaagcgagcataaaaaatcaggaaaacaaatccatcatgtgctaatgcctagaggtaatcctggtaaacattttagcaaatctttgttatatatttttttccttttgcattaattttacaaagttgagatcatggtgcaaatgcagttttacagctttgatatgatcatggcataaagttttccatgttattaacaagttttttttttaacacgagtctaaactcatgtctgtggcactgtctccctgaacttttaatagtgatgggaacattccctatcttctgtgtccaagatgctgcccttatgtggtgactgagagcttgaaagtggccagtgtgactgaggaactgaattttacattttatttcattttgatcartttaaatagctgtgtgtggttaggggtcaccgtatcagacagggcagatctaaagtgttccattgcaaggttgttggcytgctaattttgttctaatttttgttgttattacaaataatgctgcaatacacattcctctatttcttgctgccttgtgtcataaactgtgaattttataggttgaaggccctttagggtgtgtgttttctgagagaaaacygaactgaagtaccagatggggcaggcgctcttcctggagggagatgtagtgctggggccagggcttggctgtgtctctctcacgtgtcccaaagctcttgtgtgctcctgggcagagctgggtctgggaagcagagccctagtccatgtccaggtgtcttagtccatttgggctactgtcgtaaaataccaaagactgagtggcttctaaaccacacactgratttctcacaattctctaggctgggaaggtcaatatcaagatactggcagatttggtatctactgaggacccacctttcgtttcatagatgctgtcctttygctatgtccttagatgtcagaaatgggccacagagctctacaggggatcttttataagggcactaatctcttttacaagggccccaccttcatgatctcatcacctcccaaaggctccacctcctaaagccatcacattaggggttgggatttcaacttatgaattttgcggggacacaaacgtttagtccattgcacctggctgctggtggagtctccagggctgcctcacacagagtgagagctggagacaggaatcagaagggagtctctagccccagaggacatgcagttgccaacacggcttgacagggactatataagcggccattagcctacccacagggcaggtgtggctcgctactccaggcctcccccagccccatcagcagctgctcccttggcaggaattgtgagggctgggtccgagagacgggggtgttcatcttggccctctgtggtggacaaccagctcttgtttgttgttagcggggcccagcagtgctctgggagcacatcctgaacccaggcggtgacaaggggcttgtccccacaggtggcccggcagtctctgaccrtgttcgttctcatcatgaatggctgccacatcgagattgatgcccaccggctgaatgatggggggctcctgctctcctacaatgggaacagctacaccacctacatgaaggaagaggttgacaggtgcgtgggggtgcgagtcccactgtgggctgggcatgcacagctctctgtcctaggcatggaaaacacagcrctggcctgtgtgcaggtccaagggtcttagagaaggtgcctttcyggtaaattctgggggtgtgcagagaagttaatctcttggttggaattctgtgcaactggcagatatttaggggaggatcctaggaggcccttttctagtaacctggttggtggggattcagagctgaacgggacatgactcccagctctgtggcctgcgaggtgtgtgaycaggtgcctgctgcctgtgcatctgggctcyggcatccacccagttagtgcggcagtgacctactaagctcctccgtaccaggcgctgtgctgggtgttgggatagcattctgggtgtgactcgtggagcttccagcccattcgggaagatgacacactgaacaaacagatagtggcaggaaagggtgtcgtgtacctgacgggtaacacacaagatgccctggaagctcttagcacaggggcttgtgagatagtgagataggccccaaagatgccccgcctccagtgtgtctgatcaccccgagatcacgcaatgaaacagaccccagccaaggtgatgaaaggggaggggatgtctgaaaagctccagttagagagtggagactctcttctcaatcctcaatgttttggaagaaggaagactaggtttatgccagagtaatattttgttatctccttttttttctttttgagagagggtctcgctctgtcacccaggcaggagtgcagtggcaccatcatgactcactgcagcctcaacttccctgggctccgagatgatccccccacctcagtcccccaagttgctgggactacgggcaygtgccaccacgcctggctaatttttgtattttttgtagagacggggttttgccatgttgctcaggctggtcttgaacttctggactcaagcagttggccagccttggcctcccaaagtgctgggattgcagtcatgagccactgcaccctgcctgttatctcttttttaacccacgttctatctgccaagaatgttcaggattactataggttctactctccccagttcaaaggttaagactttgaatcagtaaatatttgttgaatcatatccactgattgatttttctgtgtcaggccctgttggaagtatgtcagtaaaaggaaccagctttcagccaaaaaagggtcacatcctttttattattttattttattttaaagactggttcttactctgttgcccagcctgggcaagagtgagaccctgatcgcttgagtccagaagtttgagaccagtctgggcaacatggcaaaaccccatctctataaaatacaatgattagccaagtgtggtggcgtgtgcctgtagtcccagcaatttagggggttgtgatgggaggatcacctgaccccagggaggtcaaggcttcagtgaaccatgattgtgccactgcactccagcctgggtgacagagtaattatagctcacaatagcctcaaactcctgggctcaaaggattctcctgcctcagcctcctgagtagctgggactactggcatatgctaccacgcccagctatttttttttttttattttttgtagaggcagggtctcactgtgttgcccaagcttgtcttgaactcctggcctcaagcsatcctcccacctcggcctcccaaagaaagcatcacagccttggccaggcacagtggctcacgtctgtaatcccagcactttgggaggctgaggcgggcggatcatgaggtcaggagatcgagaccatcctggctaacatggtgaaaccccatctttactaaaaatacaaaaaaaaattagctggatgtggtggtgggcgcctgtagtcccagctatgcgggaggctgaggcaggagaatggcgtgaacccgggaggcggagcttgcagtgagccgagatcgcgccactgcactccagcctgggcaacagagcgagactccgtctcaaaaaaaaaaataaaataagaaagcatcacagcctttttgttcacccacctcactctcagtgtctctgagataactatcaactgccaccctttgggaatgtagagggtacactccccctttaggaaggggaaatggtattgaaagccggactagggcttgctgagttggtagtcctcatcagtctccctacccsactcctcctctctcccagttaccgaattaccatcggcaataagacgtgtgtgtttgagaaggagaacgatcctacagtcctgagatccccctcggctgggaagctgacacagtacacagtggaggatgggggccacgttgaggctgggagcagctacgctgagatggaggtgactgcagagccsgccgtggggaatcctgaaccctcaaactcccactcttctggctttgtcccatgtctgaacaaacaggcctacctctccccttgaccactgtctgcaaatttctaagggaatcagtctgtggatttcagccaaatcccctgaagtattcaaagaaaaaaacttcaggctgggcgtggtggttcacgcctgtaatcccagcactttgggaggctgaggcgggcggatcacgaggtcaggagatcaagaccatcctggctaacatggtgaaaccccgtctctactaaaaatacaaaaaattagccgggcatggtggcaggcgcctgtagtcccagctatgcaggaggctgaggcaggaggatggcgtgaaggcaggaggatggcgtgaacccaggaggcggagcttgcagtgagctgagatggcgccactgcactccagcctgagcgacagagaaagactccgtctcaaaaaaaaaaaaaaaaaacttcaaaaaatgcacatctccccaggaatgagtaagaaggttaatgacagagaaactgggtacagagaatatggaaactctctgtactatttacataactgttctataaactgttgtgtaaatcagtttccttgatttctttattttttttttgagacaagtctcagtctgtcacccgggctggagtgtagtggcgtgatcttgtctcactgcaaactccgcctcccaggctcaagtgatcctcccacctcagccttccaagtagttgggattacaggcacgcaccaacatgcctggcttaattttttgtatttttggtagtgacagggtttcgtcatgctgctcaagctggtcaaatacctgagctcaggtgatccacctgctttggcctctgaaagtgctgggattgcaggcatgagccactgcacacagccaagaattgattgataataacaattattgtcaatcaatgattaaatattaaatattgaccccagcaataattgaaaggtgttaagccaacacttgcaaagccataaccatgtggcaggtgctgttctaagcattttactgatctttattttttaaccttcccagcaaatatatgagatgggcacaaatgtgatccccattttataaaaaagctgggcccaggcaggctaagaaactcactggaggtcacacaaagccaggattcaaacccggaaaataacaacaataatagcaatgaaaatacatcaataatagtagctactgcatattgacctgctgcatggcaggatctgcatctcattcaatcctcgtaagagccctaagaggtgaaactgtcattattcctcattttacacttggggaaactgaggctcaaggaggggagccacttctgaagatcacagaggtattggggggggcagttcctgggattctagtccaggcctggctgacttgggtgcccaagctgtgaactgccaagcaagagagatagcacagtcctggctctgcggccgccaccatggtgacaaagctcatgccacgcacgtatccagacattcgggaaaattaaaagggctgatgagcagattcttcatttcacagagtgttccctgagggttttctaagtgcctttaataaaacaaactgttcacaaaatgtttgatttatgcagtacgttttaggaacgtgtatatgaaccactctatgtaatatgatttaacagtatttctaagagaagactccccctttggaaataaacatcagtttccatatctgtaaaatgggcatcataaacacctccttggctggctttgcagattgaatggcacttgcctggcacttagcaggcttccagtaaaggtcacttttccttgtaccttctgcctgaacactacccagggagtcattctggcgcgtccctgggtagtgtcccggcgcgtccctgctccggcatcactagttctgggtggctctgggtgtcaatcccggtgggctctgtactatttcttctttttacgaaataggtgatgaagatgatcatgaccctgaacgttcaggaaagaggccgggtgaagtacatcaagcgtccaggtgccgtgctggaagcaggctgcgtggtggccaggctggagctcgatgacccttctaaagtccacccggtatgtggctccacrgcccaagtgctctggctggtgcaggtgcactcgtgacctccactggttcagtgagacaggtggactcaaggctggtagcgcttctccygcctccacctgcagacagagctcgtcgcagcagccaccgtgatggtgcagaaacacaaggaagccgcgccctgctttactcagatccctctctgtggctctccatcctgcttagagcaaaacccaatttctgccagtgacctgcaagaccccaaatgagctagctgttccctgctttcttctctgcctttctcctctgtccctctccccatcacttacttgaatacactggacccctccctcctggcggctgtcctctctgctgtgaaggacctaccccagactttgcagggatcactctcaactcctgggagctttgattccaatgtcttcccctcaatgagggcattcttgaccattgaccaccttttctttttaatagacttaatttttagtatagttttagatgtacagaacagttatgtaagtagtgcagagttcccatattctctgtggccagtttccctgtcattcatttaattatcattcaattaattgttagtattattattattattcatttttttttgagacagactctcgctctgtcgcccaggctggagtgcagtggcgtgatctcgactcactgcaacctctgcctccctggttcaagtgattcttctgcctcagcctcctgagtagctggggattataggtgtgtaccaccataccagctaatttttgtatttttagtagagacagggtttcaccatgttggccatgctggtcttgaactcctgacctcaggtgatccaccctcctcagcctcccaaagtgatgggattacaggtgtgagccactgcacctggcctcaattaattactattgttatcaatttactgttattaatttaactattattgcacgagcatggtccatttgtcatatttaatgaaccaatatcgatatattaggtattattgtttaagaataataattaactttaaaatttaactattattgcaataatatggtccatttgtcacatttaatgaaccaatattggtacattattgttcactcagatttctttagttcattttttaaaaattgtggttaaatacacataacaaaatttaccatcttagccatttttaaatgttctcttgagcagtattaaatccattcacattgttgcacarccatcaccatcatccatctccagcacttgcaaaactgaaacttgacactcgttaaatggtaactcctgagtccctcctccctccagcccctggcaaccattgttctgctttctgtctatcaattcaactcctctaggtgcctcatataggtggaatctatatagtatctggccttttgtgactagcttatttcatttagcgtaacgtctccaagtttcatccatctgatagcatgtggcagaatttccctgttttttaaggctgcataatattcccttgtaggggtgaatcacattttgtttatccacccatccactgatggacacttggattgtttctacctgttggctactgtgaataaggcagctatgaacatgagtgtacgattttcttagtttttacctattgtccrggatcccatccaggttagcacattgcatatagttgtcaggtctctttcaaccgccctttaaaaaattgtgctcacctccacccacgtgcaaacacacaccrtacctcacaaagatgatctcactgattgtcttgttgctttattatttggcctccaggagactggaaacaccgtgagaacagggccttttggctttcttgctcgctgctggggccccagtgccaaaaacagggcctagtacatcagaggtgctctgtaaatattggttgttggatgaacgtgtagcaggcaggtgccgggggcgtccccctgtcctcaggaccaccagggggtgcaccagagtgtctgtcatgtgaccctgagctcaggctcttgggggcacctccaatttagattcctcttaatttgtcaagctstgtcattaccgatgagtccctgaggtcaaggactactttcgatgtccactgttgtgatcctggggcttagcacagtgctcggagcatagtgggtgctcagaaataacaagtcttgatgaatgaatgaatgtttacaccctcctaagcaagactctaaaataattagtacatctgtccagtaaaaaaaaaatttaaaaatatcacatggtctcttttctccagagtattctattaattgtatttgttttctttttwaaaaaaattataattattatgggtacataataggtgtacatgtttatgggggtacatgtgatcttttggtataggcataccgtctaataatcaaatcagggtgattggggtatctattacctcaagcatttttcatttctttgcrctaggaacattccagttctactcttttggttagtttaaaatgtacagtcgattttaattgactgtagagtcaccctgttgtgctatcaatactatatctttttttttttttttttttgagatggagttttgctcttgtcgcccaggctggagtgcagtggcgtgatctcagctcactgcaacctctacctccagggttcaagcaattctcgtgcctcagcctcctgagtagctgggacttaaggcacctgccactatgcccagctaatttttgtatttttagtagagatggggtttcaccatgttggccaggctgatctcgaactcctgacctcaggtgatccgcccacctcagcctcccaaagtgctgggattacaggtgtgagccaccatgtccagcctcaatactagatcttattcattctatctaactggatttttgtacccgttaaccatccccactcccaccagccccactacccttcccagaccctggcagccatcactctacattctatttccatgagtttatttgttttaattttcagctcccacatatgagtgagaacatgctaaatttgtctttctgcccagcttatttcacttaatgtaatatcctccagttccatccatgttgctgcacatgactgttgttacaattcttttcattagtctctttctctctttttttgagacagagtctcactctgtcacccaggctggtgtgcagtggcacaatctcagctcactgcaacctccacttcctgggttcaagcaattctcctgcctcagactcccgggtagcaagtacctgggaccacaggtttgtgcgaccatgcctgactaatttttgtatttttagtagtgatggggtttcactaggttggccaggctgatcttgacctcctggcctcaagcgatccgtccaccttggcctcccaaaatgctgggattacaagggtgagccactgtgcctggcatcactagtctctttagggagttcccaaagctaggaatagactgggcctttttggatcagtgggcaggtctgggtacctgcactgtgattcctttcagcacacatttcctgtgctgggttaatgaggcagggcctgcccacccattccctgcagcctcacataaatgcttgtgagacagactgggagatcgagtracttcacttggtgagtgtagttagaagaccgcccttggccctgggctgtggggacccacatggagaagctatgatcagattgtgtaggggaaaaccctcaagtcagctttttttttttttgagacagaatttcactccattacccaggctggagtgcaatggcacaatcttggctcactgcaacctctgcctcccaggttcaactgattctcctgcctcagcctctggagtagctcggattacaggcacgcgccaccatgactggctaatttttgtgtgtatttttagtagagatggggtttcaccatgttggccaggctggtctcgaactcttgacctcagttcatcctcccacctcggactcccaaagtgctgggattatggtcatgagccaccgtgcccggccaagtcatctcttaaaaggggagaaaagcctgcagggctaggggtggggatgggtgtgggtggaggggtagagggtgggcaggaaacrgagtgttctctgctgggagaacagcaccccagcactgtgcgtcatgcacrgtaggtatttgtagaatgaatgagtagacgaatgagcacatttagtctgtgttgccctctagggagctttttatttttccatgtgtttacctaagactgaatttttatgatttacaaaaatcagatgcatttgtatgagatgttcataaattttcatcctactgtgaggtgtttaactttgggattcaatagagaatgaaaataaatacagaacatgagatttgttgattataaagcaaaacaacaacaacaacaaacagatcggccgggcgcagtggctcacccctgtaatcccagcactttgggaggccaaggcgggcagatcatgaggtcaagagatcaagaccatcctggccaacatggtgaaaacctgtctatactaaaaatacaaaaattagctgggcgtggtggcctgcgcctgtagtcccagctactcgggagactgaggcaggagaattgcttgaacccgggaggcagaggttgcagtgagccgaggtcatgccactgcagtccagcctggggacaatgcgagtgtctcaaaaaaaaaaaaaaaaaaacagatctcaccgccaccccacaaaactgtctggggtgtgaaactgtgtactgggccatttgcaaaaggaatggtttggaaaacccacattggggtgtgagtttggccattttaactttccagttcattgtctttgattttttcctcagacctcatcctcacttgattacggaagccggcagatctgtcctgcctcccattctgcccggtcccatttggaattcccagagttttcctgacctgtcgttcttgtggtgtctcatcaggctgaaccrttcacaggagaactccctgcccagcagacactgcccatcctcggagagaaactgcaccaggtcttccacagcgtcctggaaaacctcaccaaygtcatgagtggcttttgtctgccagagcccgtttttagcataaaggtaaagtcacctatgagcgcaggcgtgtagaccagtgcggagggtcagaagatctaccccgtgacagcagaggtcattattgagtaagaaatgagaaaatggtcggtcctctgttgkttttattttatttattttattttttcagacaaggtctcactctgtcacccagactcactgcagcctcgacctcctgggctcaagagatcctaccacctcagcctcccacgtagctgggactataggtgcaccccaccacgcccggctaattttttgtatttttgtagagatggcattttgccatgttccccacgctggtcttgaactcttgggctcaagtgatccatccgcctgggcctcccaaagtgctgggattacaggcctgagccaccgcacccagcccctcggttgtgtttatgaaggacctgtcctcagggaattcctcaattcaattgtaaacattggcctgactttttctccttgatcgtaaactgggcttgtagcagttcagctcaagactgagaatactccagtaggacattaaggaaggagtcagtgggggtcaccctgcttaaggagatgacagacaaggcactttgtttgaaacacacctctgttcgtcattcacccttgctgggtctcatctgctcactcagtagagaaacaagaagttctctgatttgcagacctccttgaaagacccatgatgctcatagcagtgactaagcatcacactgtgtgctgtaccgggtccgtctcaggagagcaaatcatgatggtgatgacgataataaccgccaacccttagcaagtatgtaccatgtgtcacccccctttgtttttgagagggagccttgctctgtcacccacaccaaagtgtggtggcacgatcttgtctcactgtaacctctgcctcccaggttcaagcgattctcctgcctcagcctcccgagtagctgggattacaggcgtgtgccaccatacccagctaatttttgtattttttagtagagacggggttctaccgtgttggccaggctggtcttgaactcctgacctcaggtgatccacccaccttggcctcccaaagtactgggattacaggcgtgagccaccgtgcccgctgtgtcaccttctaactacttaaaagttcaatcatttcatcctcccagcaaccgataaggtaggaactcttatttccacttacagttgaggcaactgagggacacagagactaagagacttgctgtgcttcatacatgaggaggcaaagatgagatctgaaccatggccatcaggattctgactctgtgctcttcgcccccacgttatgctgcctgatgattattaccaccattgcaacattttttttttttttttggagacagggtcttgctctgtctcccaggctggagtacagtgggggaaacactgctcactacaacctcgacctctgggttcaagcaatcatcccacttcagccttccaagtagctggggttacaggtgcctgccaccacacccagctaattttttgtagagacggggtctcgccatgttgcccaggctggtctcgaacttctgggctcaagtgatcctcccgccttggcctcccaaagtgttcagattacaggcatcagccaccgcaccccacaataattgcaacttttattagttggggcacttcgcagtttatgcatcagttcactttgaaacctcacaaccacactaggatgttggccccactatcatcgtcatccaaagaccatcagcattggctactgagacaccccggaaacagcatagggcagcagttcagagtctcaggagctgaatagcctgggtttgcttcttactagctgagtgactttggttaacttaactaacctctctgtgtttcagttgcctcaattgcaaaatggacaaaatcattagacttcctttatatggttgcttttagggatcaaatgataacatgaaaagaaagttcctagaacactgtctggcactaagcaagtatcctataaacatcagctcatcatgtgaccttatgtttgatcccccmcaccatgctggctttctgatgcacagagagggggagtcagggtcttcctatgtagggaaactgagtattcccctgtggtcagggggccattccactctggactgccccagaggctgctgggtctggatcttcagccacttgagtgcatggggtcaggatgggttgagctgtgttgggtgccctgtttggggcggtggtgcccatgcccatgcagggctgggggctgatgctgtggtccccgcttcagctgaaggagtgggtgcagaagctcatgatgaccctccggcacccgtcactgccgctgctggagctgcaggagatcatgaccagcgtggcaggccgcatccccgcccctgtggagaagtctgtccgcagggtgatggcccagtatgccagcaacatcacctcggtgctgtgccagttccccagccagcaggtgcgtgctcccctgcccagccccaccccaccaggatggtcacactgggccggctcccggtctggctcgatatctggcctctgatcaagttgaactccttgagacccacttatagcctaacrtatcaggggccgagggtttccttttgagccttgtctgcagaatcctatcatttactcaaagcaacagttgtttgaatgaacatcagtattccttaggcctcattgcctaaaacccaagattctgaataggagtgagcagttgttgcagatggagtgagcatttcccaaaaaataaactggctgacatcattagaggaaactgcaagtttttttatttttgttttttcactggtttgcagctttgattttctgcccctggattttgtaggtgatcatctgggagctccatgtatgtgtgtgtgtgtgtgtatctgtgtgtatatatatatacacacacatatatatacatatatatacacatacacacacgtgtgtatatatgtatatatacacatacacacacgtgtgtatatatgtatatatacacacacacacacgtgtgtgtatatatgtatatacacacacatatatgtgtatatatgtgtatacacacatatatgtgtatacacacacatatatgtgtatatatacacacatacatgcatgtgtgtatatatgtgtatatatacacacatacatgcatgtgtgtatatatgtgtatatatacacacatacgtatgtgtgtatatatacacacgtacgtatgtgtgtatatatgtgtatatatacacacatacatatgtgtgtatatatgtgtatatatgtatatatacgtatatacacacgtgtgtatatatgtatatatacgtatatacacacgtgtgtatatacgtatatacacacgtgtgtatatacgtatatacacacgtgtgtatatacacgtacatatgtgtatatatgtgtatacacacacgtacatatgtgtatatatacacacgtgtgtgtatatatgtgtatatgtgtatatacacacacgtgtgtatatatgtgtatatatgtatacacacacacgtgtgtatatatgtgtatatatgtatacacacacacgtgtgtatatatgtgtatatatgtatatatacacacgtgtgtgtatatatgtatatatacacacgtgtgtgtatatatgtatatatacacgtacatgtatgtgtgtatatatgtgtatatatacacacatgtgtatatgtatatatgtatatatacacacatgtgtgtatatgtatatatgtatatatacacacatatctgtgtatatatgtatatatgtatatacacgcacacacatgtgtatatatgtatatacacgcacacacatgtgtatatatgtatatacacgcacatacatgtgtatatgtatatatacgcacatacatgtgtatatgtgtatatatacatgtatgtgtatatacgcacatacatgtgtatatgtgtatatatacrtgcatgtatatayacatatatacatgtatgtgtgtatatacatataaacatatatatgtatatatataatattttttaagaattatactgaggtcgggtgcattggctcacrcctgtaatcccagcacgttgggaggccagggcaggtggatcacttgaggtcaggagttcgagaccagcctggtcaacatggtgaaaccccatctatactaaaaaaaaaaaattagctgggcgtggtgttgcacacctgcaatcccaactactcaggaggctgaggcaggagaattgcttgaacccaggaggtggaggttgcagtgagccgagatcgcaccactgtgctccagaaaaaaaaaaaagaatgtactgagatgtcttatcataatcatagttgcatttgtgaacatgttaaaaaaaaaaaaagaatggaagccattccagggaagtaagaaatatctctgttatttacacatcggcctcgcgttgttcattttgttgtggttgttggttttgtggggcatttgaaaggcatttgcactgggaagagcccctctgcctgtttgccttcctgccctctggtgggagggttccccaccatcatcatccacccacccacaaattggtgatttgggaaaccagaggacagtgtagttcaggccattctcggargttaggagttctatgggttggaatgttgttcagccaaagaaagaaagaatactgattcatgctcccacgtggatgaacctattgtgctaagggaaataagccaggcacaaaagaccacatattatgtgattcctctttttttttttttttttttttgagacctcccgaatagttgggattacaggtgtacaccaccattcccagctatttttttgtatttttttagtgragatgggttttcaccatgttggccaggctggtcttgaactcctgacctcaggtgatctgcctgcctcggcctcccagagtgctgggattacaggcatgagccatggtgcccagccctgtgtgattccaattttatgaaatgtccagaataggcacgttcatgaagaaggaagtagattagtggccgccaggggctgcagtgcagggaaaatggagagtgagcgctaatgactacaaggtttctttttagagtgaygaaaatgctttaaaattagatggtggtgatagttgcacaactttatgaatacactaccaaccactgaatgtacactttaaagggagatggtggaatatgatggtgtgtaagttatatctgaactaaaaaataacaaaagccaaactctagaggatcctaactgaaaaagtacacacttggaactttcaggaatttgtcattgatccaggtttttttttctttaaaaatatttttgatgccaaaggcaatacaccgataacattatgtgtaatgataaagacaggacccttccccatgagcaccctggtttttgctagagtgggacattcccatctccttgttccccatcccattgatatgtgcggaatggtataaggcgaatgtgtgcactcctccatgtgatcgctggcattttgagcgcttgaattcctcaccgttgaggggatgaacaggggtgtttcagggtagctggaaggctttgggcctggaattttcaatcttcaaatgagtctcggatgggacctccctgggaggctgtggtgggtcctttaggtcagcagttcccaacctttttagcaccagggaccggttttgtggaagatagtttttccacggaccggggagggggatggtttcgggatgattcaagcacgttacatttatggtgcactttatttctattatgattacattgtaatatataatgaaataattatacaactcaccataatgtagaatctgtgagagccccaggcttgttttcctgcacctagaaggtcccatctgggggtgatgggagacagcgacagatcatcaggccttagattatcgtaacgagcatgcaacctaggtccctcgcatgcacggttcacagcagggtttgcgctcctgtgagaatctaatgctcccgctgatctgacaggaggtggagctcagatggtaatgtgagcaatggggaggggctgtaaatacagatgaagcttcgctccctcacccactgcttacctcccactgttcagccagttcctaacaggccacggaccagtgcycgtttgggtactggtttggggaccctttctttaggggactgctgtgtgtcatytgaatcatcagcagtcagacctgtcttgttttcccatccagatagccaccatcctggactgccatgcagccaccctgcagcggaaggctgatcgagaggtcttcttcatcaacacccagagcatcgtgcagttggtccagaggtgaatcctgggtctccccgtaggatgtggttgtcacctgaatcgtcgcatgcattgcaccagggtggtgctctggggctgtcttcagggcaggcttgaactgagagaaagtgtgttatagtcctgcagtgccattactaacagcagaaccctgggtgaggtactttacttctgtaaatctctgtttgtaaatctcagctcactgcaacctccgcctcccaggttcaagcaattctcctgcctcagcctcccgaatagctgggattacgggcatgtgccaccatgcctggctaattcttgtacttttagtagagacggtgtttcaccatgttggccaggctggtctcgaactcctgacctcaagtgatccattctcctcgacctcccaaagtgctgggattacaggcctgagccaccatgtctggcctataaatgtattaagttttgtgaagtgctgacaaatagtaaatacttgatagatayattagattgagacaatgggatgaaatagctttatgtatgataaaacactgcaaaaattgttattgtggcttttgggacaattgcaaaggaaagtggatgaataattgtatttcatctcaagtagttatttattgtacaggggtttcccgctgcaggactattctgatgacaaaaggattttctttgtttttttgagatggagtttcgctctgtcggccaggctggagtgtaatggttcgatcttggctcactgcaagctccgcctcccgggttcacgccattcttctgctgcctcagcctcccgagtagctggaactacgggcgcccaacaccacgcccggctaatttttttgtgtgtttttagcagagatggagtttcatcatgttagccaggatggtctcaatctcctgacctcgtgatccccctgcctcggcctcccaaagtgctgggattacaggtgtgagccactgcacccggctgacaaaaggattttctgccacttttcatgaaaaatccacctagcaagaaggctttccttatgaagacaatcagggccaggcgctgtggcttatgcctgtaatcccagaattttgggaggccaaggcaagaggatcacttgaggccaggagttggagaccagcctgggtgatgtagcgagaccctgtctctacaaaaaaaaaagaaaaaaaaaatgagtcggggatggtggtgtgtacctataggcccagctactcaggaggctgaggtgagaggactgcttgagcccaggagttcgaggttatagtgagctgtgatcgcgccattgcactccagcctggggacagagcaagaccttgtcttttatgaaaaagaaaaaaggaatcaaagcattcttggatttgaaccagtaaattccaggcatgtttcccatgtgccagaaactcacaggtacaaagaatgtgagattgtagaaaactggcctccttttcaaggagctcctcagctgttagggagagagattttagtgtggattccccacaaactgcaagtttcacagccaagggctaggaagggagtcctcctaaaacacatagactgctaaccttaagcycatcctttaagcttcagagaaacatctaggaaaaatgaaccattaataaattaactgaattttctagcaagttttctgtgctgamcataaatattaaagccctgtcctgtattgtgtaagtatgttttaaaatcacatttgtatcagagtcttttagcatcttggtctgttttgttgtgatttggtgatgctgccatgaagcgtctacttccccacaactcagtggcgcatctcctgagaaacttgactcctgtgttcagatttttggaagaacatccaggttaaaactttgttttaaaagaagcggctaggtgcgatggctcacacctataatcccagcactttgggaggccaaggcggrtggattgcttgagctcagaggttcgagaccagcctgggcaatatggtgaaaccctgtctacaaaatatacaaaaattagccaggcttggtggtggccacctgtggtcccagctactccagaggctgaggtgagaggattgcttgagcccgggaggcagagattacagtgagctgtgattgcaccactgcactccagcctgggtggcagaacaaaacctcgtctcaaaaaaaagaaaaaaaaaaagggagaagcaaaatttacatggggatcttttggtaaatgtttttccagtttgtctttttaaaatggtctctataccttgggtaagtaattgaaaaattttgtttttaacagttaaagcttgctaaaattggctacccctgttcagtatccgaaatctatgaagttttttttttttcttaactctgtggccagaaaggcgccctcccaagtataaggcttgggatctacctactccagttttgcctccagtttgatgtgggactttgggcagggcagtgttctttttggcctgcagatgaatcaactccatatcctttgaaggcctcaggattagagggtgcctctagatactttaaaaaaatttttggctgggcgcggtggctcatgcctgtaatcccagcactttgggaggccaagacagccggatcatgaggtcaggagatcgagaccatcctggctaacacggtgaaaccccgtctctactaaaaatacaaaaaaattagccgagcgtgggtggcaggcgcctgtagtcccagctactcgggaggctgaggcaggagaatggcgtgaacccgggaggtggagcttgcagtgagccgagaatcgtgccaccgcactccagcctggccgactgagcgagactctgtttcaaaaaaaaaaatgtatttttaaattaactaattaattaatttttatttatttattttgagacaagctgtcacccaggctggagtgcagcagtgcaatcatagctcacaacagccttgacctcctgggctcaagcgatcctatcacctcagcctcctatgtagctaggaccacagtcatgcgctaccactcccggctaatttttttgatttttttgtaaagacaaggtctcaccttgttgcccaggytgctcttgaacttctgagctcaaatgatactcacgcctcagcctcccaaagtgctgggattattggtgtgagccaccatgcctggccttaatttttttgttttgttttgtagatatggggtcttggctatattgcccaggcttgaactcctgggctccagtgatcctcccacctcagtgtcctttctaaaatcctttctctctctctcttttttttttttttttttttgagacggagtcttgctctgtcgcccaggctggagtgcagtggtgcgatctcggctcactgcaacctcctcttcccggattcaagctattctcatgcctcagcctcctgagtagctgggactaccggcgcgtgccaccatgcccagctagtttttgtatttttagtagaracagggtttcaccattttggccaggctggtctcgatctcttgacctcgtgatctgcctgcctcggcctcccaaagtgctgggattacaggcatgagccaccatgcccagccaatcctttctctttttaaaaatcataaaaaaaaatactaaatattcaggtactcaaggaagggtgtgagcattaagagcagccttcccttctccccagataccgcagcgggatccgcggctatatgaaaacagtggtgttggatctcctgagaagatacttgcgtgttgagcaccattttcagcaaggcaagagatgctgatgccaacaccagtgggatggtggggggcgtgaggagcctgagctttacctctgtgtggtgttttgtctcccccagcccactacgacaagtgtgtgataaacctcagggagcagttcaagccagacatgtcccaggtgctggactgcatcttctcccacgcacaggtggccaagaagaaccagctggtgatcatgttgatcgtaagcaggaagagggcctgttactagactgggggtgggtcaggagtccacaaacgttttcttaaaagggccagaaagtggctgggtgcggtggctcatgcctgtaatcccatcactttgggaggctgaggcgggcagatcacttgaggttaggagtktgagaccagcctggctaacatagtgaaacctcgtctccactaaaaatacaaaaattagctggccatggtggtgcatacctgtaatcccagctacttgggaggctgaagcagaaggatcgcttgaaccctgaaggcagaggttgcagtgagccgagattgtgccattgcactccagcctgggcaacagggtgagattctgtctcaaaaaataaataaaagaaaaagtaagccagcaagtaaattttttagactttgcaggttggtgtggtckctgtcgtgaccactcaacactgcctttgtacaatgtaagggaatgggcatggctgtgttcccataaaactttgttgggagcccgaggtgggaggatcacttgagcctaggagttcaagtccagcctaggcaacattgcaagactccatttcttagaaaaaaaattaaaactgggcactgtggctcacatctgtaatcccagcactttgggtggctgaggcaggagaatcactcgaggccaggagtttgagacgagcctgggcaacatagggagacccccatctctacaaaaagtacaaaaattagccaggtgtggtggtgtgcacctgtagtcccagctactcagggggctgaggcaggaggattgcttgagcctgggatgttgaggctgcagtaagctgtgatcacaccactacactccagcctgggtgacagaatgagatcctgtctcaaaaaacaacaaaaaaaatcccaactttgtatacaaaaacaggcaatgagtcgggtttgttggcactgggaagatcatgactaatgcaaagcacctagtttgtgccaggtactcctgaagtgctttccaaataaatagttgctcatttaattcacgcagcagtcctagaaagtgggtactgctgtcacagctctttggcagagcacagagaggttaagccacttgcccaagggcacccagctcctaaatgtagagccaggatttgaaccaatagtctgactccagactcatgaactattagccgcaggatattggattttgagtcctgtgtgtggagaagaagaaatatggagtctctgttcttgtttctctttccactcgatgatagcagtcttttgttttttgtctgttttttcttttgagacagggtctcgctctgttgcccaggctggagtgcagtggtgccatcatggctcactgtagcctctatcccctgggcttaagccatcctcccacctcagcctcccaagtagctgggattacagactcacaccaccacgcccagctagtttgtttgtttgtttgtttgtttgtttgtttgttttgtagagatgaggtctcactatgtttcccagtcttgtctcgaactcccgcgctcaagcaatcctcctgccttggcctcccaaagtgctgggattacaggcataagccactgcgcctggccgataatagcagtcttttataactaaaaatatttttctttgatatgtcccttgcaactgacttggaaaatgtaggatcagcagagtaagagcaacttggacttggcttatagtagaaaggggtttggcaatttttttttttttttttttgagatggagtcttgctctgtcgcccaggctggggtgcaatggcayaatcttggctcactgcaacctccgcctcccgggttctatctatcttctatctatctttttttttttttttgaggcagagtctcactctatcccccaggctggagtgcagtggcacgatctctgttcactgcaacctccacctccagggttcaagcaattctcctgtctcagcctcgtttagctgggattacaggcatgcgccaccacgcccggctaatttttgtgtttttagtagagacgtggtttcaccatgttagccaggctggtcttgaattcctgacctcaggtgatccaccagcctcggcctcccaaagtgctgggattatagacatgagccaccacgcccggcctggcaacttttttttgtaaagggctccagatagtaaagattttaggcttgaggacgtccaccccctattgccactactcagctctgtgagctctgccactgtagcctgaaaactagacaataggtacatgaatgagggtggctatgttccaataaaactttatttacaaaaacagtcagtaggcagagtttggccacgatctcagagaatagttaataccctgtcccctgtccaagttgcattaataaatattgggatttttggtaaagaatcatttaaaaatctcacgcagcagcttttaatcctggctgtacattagaatcacctagggggtggggagacttaaaaaatacaattgcccatgccccacccttggtcaatttaatcagagtttctaggggtagggcccaggcattagtgctttttgaaagtttccctgtgggaaacctaaatgtgcactgtatattagataatattattggtttaatgttcagtttctttggtgttttaatggttctgtagtaggtggaagggagatatgtgcgaaaatagtgtaaaggattgtggtgtctgcaactgactttcagaaaaagagagagtgtgtatgtgtatgcgcacgtacgttcttattagagaaaaatcaaatatgataatgtggcaaaagttttaacaattagtgaatctaggtgattactatgggtttttaacatactgatcttcaattcttctgtagttttgaagtttgtaaaaattaattgggagagaggactctccaagtgattgcaacacgcagccaggactgggaatttatgcccaaggagatatccactctttggggggagttctattactaaaataatataatgtttttcaaaatacattctttggatggagtttcctggagtttgagtgtttgtcaagcaaaatatgcctgtaatctattacagtcagcttgccattcaaaggcagtgggtctgtgggttattttgctgttcgttcttctgtgcacatattgactctcttctgggcatgaagtcatgaaatatcatgtacaccagaggacagccaagggaagatgggtggagcagcccccagttcttgggaattgggacattttcctggacctccttggtgatagaggctaaaaatgttgaaccaattacagtctcgggataaatgtgagattcattattcttctractttcttggtcccatttgttagaaaatagtgagttctctgcacctgatggtatttggtacctgagaggttttgaacaaagacttgtgaattgaatgattatttcgaaatgaatttttttgaggcttttaaagggacctagtttctgacaccagttcactggtcatgggacttcgttagtgacaaaacgaagcaaacaaaacatgattctgagaactaaaatatacaagatgagactgcttcacaaagttaacaagaaagaaaaatggtgttgttgttgttgttgttgttgtttgtttgttttcgagacagagtcttgctctgtcacccaggttggagtgcagtggcgcaatctcggctcactacaacctctgcctcctgggttcaagtgattctcctgcctcagcctcccgagtagctgggactacaggcacgtaccaccacacctgactaatttttttgtagttttagtaggaaacagggttttgccatgttggccaggctggtcttgaactcttggcctcagatgatttgtccgccttggcctcccaaagtgcagggattacaggcctgagccaccatgccctgcctagaaaaatgtttttgttattattattattatcttttgtatgtagaaggcaatggttagattttttaacattcacacttagatgtgtggggggaaatttaaaaaatgttcacacaaactcttgagtttttcacctcttagaaaagcaccagtctagctgctggccagcacctgtgctgtctggcctgggagccacatgcctaggggattggtggggagttatgccaccaccgtttaataatagaaagcaaatcagagaagggagaggagatttagaacactttcctaccacatttcttcagcattgatgttcctgtgtctttgtgtatgaaatatcaatatgttgaagttttttctgatgataaaatcagtctcggttcattataataggaaaatgcagaaacacatgtagaaaaaaatgccccacagctctaccatctggtgacctcttgaagaccagtcttagtggatgcccggggtggggaatgggggcatattgctcaggagctctgatatttagcattcattgctccatcttcagtgggtggttagggagcacctgcgctgagctgttcccaagccccatatgcacttagggcataagaggagatgcgaacaccggctgcacccaggcctggtctccagcagaaaggcccttctttcagaagcagagaggagggatgcaacacagacacattgtccctccctctcctgcaagattcaaccccacgtccctctcctctgaaaccgtgagcgccttaagtcaggcagcaatgtgtaggggaaggagcgggaggctttgggggcagaatagtgctgtgttcgaatctggctctgtcttgcacatgtttgctggctttggggtgaggcatattgcctctttgagcctcagtgttcctatctgtaaaatgggaatcaaaataagtaactcttcgtgggggtgggagaatttggggagttgtatataaagggtctagctgtttactagccacctggcacatagtatgtgcctgataatcactgacctttttttttttttttgggggggagacagagtctggctctgttgcccaggctggagtacagtggtgcgatctcagctcactgcaacctccacctcccaagggatgatcaaatcatcctcccacctcagccttctgagtagctgggactacaggcatgtgccaccatgcccggctaatttttctatttttttttttgtagagacaaggttttgcgctgttgcccaggctggtctcaaactcctgagctcaagcgatcctcctgcctcagccacccaaagtgctgggattataggtgtgagccaccatgcctggcctaatcactggctattaatagtaacgtaggcagggacttagttgtatttgtttgttcttaccaggcatttagggcatgttgtggggtggatgaatgggtggccgagtgagtgagtgagtgagtgaatgaatgactgactggggtgggtgcacagtagaaagtggtgagggtttgcataacaggctgtgctgggcctgtttggagagtggagcagccgcctggcttttgcggcaggtgctccccaagtcgagatgagtgctgcatgtttccctgggctggagaaaagccatttggcttctttttctgtcccctaaggatgagctgtgtggcccagacccttccctgtcggacgagctgatctccatcctcaacgagctcactcagctgagcaaaagcgagcactgcaaagtggccctcagagcccggcaggtagggtctcagggtgcggtccccacgatgtgcgtttccccccaccctcctatgtgtcccctaccgtgctcagccctcaccatgcacagtcccaccgtgctgccggcccgtgcccgagcctctgccttctgccctgggaggttggctcacgccagcgcccccatccctccccctgcagatcctgattgcctcccacctcccctcctacgagctgcggcataaccaggtggagtccattttcctgtctgccattgacatgtacggccaccagttctgccccgagaacctcaaggtgagcccgtctccttcctttcaccatctgcagagcacacactgtggcccaggtgggggcctctggggaaacggctcctcctgccctccaggtgctcagtggggtgcagggcacagccacagatgcagacagttcagcccaatgtggccagggctgcccgaggggtcacctggggagactctaggagaggtgggcatggagcccagtcctccaggaaggacagtgtgacagcagtgggggctcacctggtgcagtttacaaacctcagccatatggagcatatctggaagctgtgagccctcctgtggctgagtcgcggcctcatcttccctattcctggactctggctcatttacatgttctcaggtaccccctcagtgcctgatgggagacctgtcccaggtgccgtcatcccggagttcttcaccagctctcctatgattaaataggggaggagcccagcgcgctgcagggcactgatcgcttttagtggtcaaagcatgacttctgcctgctcccaccgcccccactcatcagactggtgattaaaaaacttactcactggctgggcacggtggctcatgcctgtaatcccagcactcgggaggccaagactggaggaycacttaagcccaggaatttgaggccagcctgggcaacatgtgagaccctgtctctacaaaaaatagacacacaaaaaaaagagccacgatgttggcgcacgctgtagtcccagctgctcaagaggttgaggtggggagatcgcttcagcctgggagtttgaggctgcggtgagctatgatcacaccactgcactccagtttatctcaaataaaaacaaagaaaaacctgaaacttgttcacatttacttttccttgtttccccttttcatttcccttagaaattaatactttcggaaacaaccatcttcgacgtcctgcctactttcttctatcacgcaaacaaagtcgtgtgcatggcgtccttggaggtaagcaggagaggcccagagaacagcactgaccatgccagttctagtgttcactgccgctaccatgcacctgaccctaggccacatgccttggtgaatgtgatcctatccttttctcttcaaggtagctatgttaatagtcccatcttacagaggaaggaactgaggctcagagaggtcaagtgacttatgcaacgtcacacagctagaaagtggcagaaccaggttttgcattattgggtctgcctcattccagattccatgctagtyaccactgctgtctcatgtcattccagcctcttccaggcagggcacattaaatactaatccctgagagccaagtctgaggcacctcatctaaactttctgactcacgtgcattaaatacctttgaaagacttttctgcttggaactgccagagctagaggagcccaggtgacaacttaaggtgaccccctgccccccgagtgatgaggtagaagggcgtggccagtagcaaaacccagattagagccaggtgatcccaggtggtcttgctcccgggagcaagaattcaggtcttcttgaattcaggaaccaagaagtgttgtgttggttccaggaaatcagagttttaaatctgctcttttwttattattattattattattttgagactcgcttgtgcctagggtggagtgcagtggcactatctcggctcactgcagcctctgcctcctgggttcaaatgattctccttcctcagcctccccagtagctgggcctacaggcgcccaccaccacacctggctaatttttgtattgttagyagagacagggtttcaccatgttggccaggctggtctggaactcctgacctcaagtgatctgcctgcctcagcctcccaataaatctgctgcccttttagaatctttttaagaaaatatgtttttaacacggccctcttacccgggtctgctttgctggcagtagtttttccaatattctttatcttctgagctcagagtctcagtcccctgttgcccccactttctcttctgcatccttgggagcctgtgagtcacacagtgagaaggtttactgggtcttctggagaccatcttgggcttgttagcatattacagccacagggtctcctgggcctgcaacttttattcctctatgggtttcacctctggaagaatctttctcaggcctcactctttgtttctaacagggagacctaatacacctcttctgtagttactttaaacacaatttttgttttgttagagacaggtcttgccgtgttgaccaggctggacttgaactgctacgctcaagcgatcctcctgcctcaccctccccagtagcttggactacaggtgcatgccaccatgcttgacttacagttactttttaaagtgctaaatgctgtttgtgtcaattagagatttttctaggatgcttttgggtttttttatttgttttgtttttccaccacgcccagctaatttttgtatatttagtagagatggggttttgccatgtcatccaggctggcctggaattcctgggctcacgcgatccacctgccttggctccccagagtgctgggattacaggcgtgtgccaccatgcctgaccccattcttgacagggaatggtgggaaccttccccaaattcaagttccccagtgctggccaagggcaagtcttttaatggaaagcaattatgtctgctaattgctgtattagctcctgctgcccagttcccgcatttcctgttcagttgaaaagcttccagtgtttaaactccagaactgcattgtccactatggcagccaccagccacgtgtggttagtgagcacttgaactgcatccagtctaaatcgagctgtgctctaagtggaaaatacacactccattccaaagatgtagtactgtatggagaaaagaatgtaaaccatctcaataatttcttatattgattacatgttgaaatgataatatttgcatatgtggggtgaaataaaatatattattaaaattattttttatcttttttctaagtggttactagaaaatttaaaattataggccaggtgaggtggctcatgcctgtaatcccagctctttaggaggctgaggtgggagaatcactgaactcaggagttgcagaccagcctgggcaacataggaagatcctttctttactaaatataaaaaacaaaaaaaattagccaggtgtggtggtgcctgtagtcccagctacttgggaggctgaagtgggaggatcctttgagctcaggagttcaaggctgcagtgggttatgatctcaccactgtactccagcctgggtgatggagtgagaccctgtctcaaaagtaaataaataaaataaagttacatacacagcttgtgttatatttctgttggacagcactgctctaaagcagggtttgataaactatagaccatggaccatatttggcccaccacctgtttctgtaaagttttatcagaacgcggccaggtacggtggctcatgcctgtaatcccagcactttgggaggccaaggcgggcggatcacctgaggtcgggagtttgagaccagactgaccaacatggagaaaccccgtctctactaaaaatacaaaattagccaggcatggtggtgcatgcctgtaatcccagctactcaggaggctgaggcaggagaatcgcttgaacctgggaggaggaggttgtggtgagctgagatcatgccattgcactccagcctgggcaacaagaacaaaactccatctcaaaaaaaaaaaaaaaaaaaagaagaatgcagccacacccattcatttacatgttgtccacagctacgtccgtgctaacagcagaattgagtagttgcagccaagatgatatgtcccacaaagcctaaaatatttactacctatctcttacagaagtttatcaacccctgctctagagtttagagtggattttgtgtaactagtaacactctgaaatatgagcaaatttgctcttaactgctgcttagaaatctttttttttttttaattgaggaaggatttttctctgttgcccaggctgaagtgcagtggtgctatcatagctcattgcagcctcaacatcctgtgctcaagcaatcctcccacctcagcctcccgagtagctgggactacaggcgcctgccaccatgcctggctagtttttgtatttttagtagacatggggatttgccatgttgcccagactggtctcgaactcctgggttcgagtgacctacctgccctggccttccaaaatgctggattgcaggcctgagccactgcacccggcctgcttacagatagatattttagaggtcatttctggtacctgttccccgtgagtgccctcagcttttgagcacactctgcagtggcccctgagagaatgtccgtgtgtttctgccttgtcaggtttacgtgcggaggggctacatcgcctatgagttaaacagcctgcagcaccggcagctcccggacrgcacctgcgtggtagaattccagttcatgctgccgtcctcccacccaaaccggtatggagtggracacacccagggacggcctgtgtttctgttcttcctgacctctgtcgtcctgtctctggaaggacctggcaagtgtgtttgggcacgctgctggggagacatcagcgataagcacttcccctgtgggagctccctgcagcgccattttctcccctctaacatggtgataatgcagagcccacctcctacacctgcactgttcagtacagtagccatgtgtgcctatttacattaaaatgaatgcacatgggccaggcgcggtggctcatgcctgtaatcccagcactttggggggccgaggcgggcagatcacttgaggtcaggagttccagaccagcctggccaacatggtgaaaccccatctctactaaaaatacaaaaattagccgggcgtggtggcacatgcctgtaatcccagctactggggaggctgaggcaggaggatcacttgaacccgggaggcagagtgagtcagtgagctgagattgccccactgcactccagcctgggcgaagaagcgagactccgtctcaaaaaaaaaaaaaaaaagaggccaaacacagtagtggctcacacctgtaatctcagcactttgggaggctgaggtgggtggatcacaaggtcaggggttcgagaccagcctggccaacatggtgaaaccctatctctactaaaaaaaatacaaaaattagcctggcatggtggtgtgcactggtaatcccaggtacccgggaggctgagggagaactgctcgaacccgggaggcagaggttgcagtgagctgagattgcaccactacacgccagcctgggtgacagagcaagagtccatctcaaaaaaaaaaaagagaaaaaacaaagaatgcaaatgagccagccatggtggcccacacctgtaatcctagcacttcggagggctgaagggggcagatcaggaacttgaggcctggagtttgacaccagcccggccaacttggtgaaaccccatctctactaaaaatataaaaatttgccaggcgtggtggcacacccctgtaatcccaggttactcgggaggctgagggatgagaatctcttaaacctgggaggcagaggttgcagtgagccaagattgtgccactgcactccagcctgggtgacagagcgaaactctgtctcaaaaaaaaaaaaaaaaaaaattcagcttctcagtcatactgggtggctcatggctgccatattatttgacagtggagttctagaacattctgtcatggtagaaagttctagtagacaatgccacccaagccattgggaagagtcatgagataaggcacatgtagcattttagacagtgcctggcacaaaggaagttgttgactgtaagtgatcccggagatgatcatgactaacgctgttattaccatctagtggcatgccattggcctgggcactctgctcagtgctcccacactcttttatttatttattttttttgagatggagtctcgctctgttgcccaggctggagtgccagtggcacaatctcagctcccagattcaagcgattctcctgcctcagcctcccgagtagctgggactacaggcgcacaccaccatgctcggctaatttttatatttttagtagagatggggtttcatcatgtcagccaggctgatcttgaatgcctgacctcagatgatccacccgccttggcctcccaaagtgctgggattacaggcgtgagccaccgtgcccagcccacactcttattttattcagctcttatcctctatcggccaaaaatgtgttctcatcctcgttttacagatgggagccctgggccctcacctgacctaggctgagctgcttgtgcacgtggagtgggaatttgagcccaggccacactctcacctccaagtcctttccacagcattcaggggccctctgagccaggtgtgagggcacctgtcctgtctgtgtccactgtagtctgctgtccaagagctgtagttcagtagataccctcagtgttctcacctgagaatatctttttttgatttttttgagatggagtctcactctgtcacccaggctggagtgcaacggcgcgatctcagctcactgcagcctccgcctcctgggttcaagcgattctcctgcctcagcctcctgagtagctgggaccacagtcatgcaccaccaagccccactacttttttttgtaattttagtagagatggggtttcactgcattgaccaggttggtctggaactcctaacctcaaatgatctgtccacctcagcctcccaaagtgatgggatgacaggcgccaccatgcctggctcacctaaaaatatctgatgtgtctgagttcctcactcacagtctttttttcagtccatcttgtttcaggacccaaagtattaataccatttaggtcaggtagagtgggataccttctcttaaagtaattatgtctccttgggattcgaagtgttctctctcacgctccctcacccctctggttttagttcttatgggggtgcccaaggccttacctacggcggcattgatgtcattgtgatttgggagttcggttgatcagatctgtacaggcaatagggttcatgctttggtgaagcggggatttttctggcctcttaggatttttaaaataactttcttttcctgttggttttaagaagaaagatgctgctatgttttggatgaagaaaagggggcttccccacgaggcactgcctttcctagttatttgtttttacccttcttatttccaaaaataggattgtgacattttaccccattgagagaaaggggactgactgcttgcagcctggggtcattctggggatttggagagcagtggtggtgtaagatattttgtagctgtctactcctgagaaggactcttttgatttttttgtttggttgtttagagacagagtctagttctgtcacccaggctagagtgcagtggtgtgatcatagctcactacagccttgaactcctgggctcatgtgatcctcccacctcagctccctgtgtagctgggaccacaggcttgcgccaccacacctggctaattctttaaaaatatttttttgcagagatgggggtctcactatgtggcccaggttggtcttgaactcctgggttcaagtgatcctcctgcctcggcctcccaaagtgctgatattataggcgcgagcccctgtgcctggccttctcttttgatcttattgtcccagcaagtcagccctgttaggaagggaagggcggctctcctgagggctgtgggtcatgccttgtgagctacacgtatatccaggttattggttgtgattttcagtatgggcacagggtccttttttgacccagagagacattgaggaccctgggggattcctggccatctaagattctcatgattgctctcagtgccagaaatgtactctgggcctgtgaagagaccttgcctgcggctgcccccaccaaccagccctttaatgcctctgtaaagggccatgaggaataaagtctatccccaagatggcctggcttggccctcaacacttgtgtgtgtagagccaggcacatggtgctttaggtcaccgagacccaagggaaggtcagatgagaagttggcagggctttgtgccagctgcagcctggacctggacctctgtgctgggtgggaactggctacatccccctgcgatggggctgctgtcctagctctgcccactgttgccctgcaggaaactgaccatcacaaccagacttctccatgattttttccagcagaagcaggaaatctatttttttttaacctgaagtccttccatttttcaatggggacaggtaattcatgttaaatgaatacatgaacacatgttaattcatgtatgttattaaaatgctgcatggaccaaagtcattctgtgagtggcattcagccacactgccactgcaagtttgtgacccctggattgagctgtcggggagcagaggggccatgatcgtgatttcagagcacccaacaggaatgcacacacctgtgtcagggtccccaaaagcacccccaggttcgatcatcgcctaggagaactcacaggtctcgggacatagtcatgcttatagctctgacttattagggggcaaggatacaaagcagttagccaaggcagaaggcatcagggtgaagtccagaggaaagcaggtgtgctgccagggtcctctcccagtggattcacgcagggtgcacttcattcccccagcaaggagttgtgacaacacaagtgaagggttgtcttccagccccgcaccagggattggtggctggtcacatcaccctctgctctgcatcgaaatctcaggcttgcagaagaaagcaggtgttcagcataaaccacactgtttgtgcaaacagttgaggcacagtgagccccccttgtcaccttcagggaacgataggaaccttccccaagtccaagttcccagaggccagccaagggctgtccttgcaagcaagcaggtctcctttctcagaagagcagtgtggggcctgctgtgctgacttcctgcacaccatttcattacccctcccgtatctgattccaaggcccaattctaacaacctcaggtggcccattgagatttgctgctggtgagcagccagttctgggagcatcgttgtctaaactccagaaggctgctgactttgtcccaagggcaagtttgatggagggattacagggagcagaggactggagtgtccgtcaggaccaagcctgactgcctcaccagctgcctggggctggtggatttctccaggagaaattgatgctgggagtgtttcttctctgtggtcaagttcagcacttggggctcccctcgggactgtgttgagactggactctcatgcatgaatcattgattcctacacttgttgagctcttactcttcaccaggtcctgagggatcagatgagaccctcctcaggccccggccccagccattgtctcatcccctgcccattttaagcccccatttggaagagctctaaatctggtccagctcactgaagcttcaggagtaggagcagctcgtagagttgggtctgcaagcagctgcctcatccccgacttgccatcaccytacaggatgaccgtgcccatcagcatcaccaaccctgacctgctgaggcacagcacagagctcttcatggacagcggcttctccccactgtgccagcgcatgggagccatggtagccttcaggagattcgaggacttcaccaggtacccagcatggcccggtctccaacaccctgagcatgggggctgsgcagacttcccttgaatccccccccaattcactggacagatggggtgggagagacccagacaygtggcacagcatgtcaataacaacagaataataatagcattgtagccaagagtatgagcctacatgtcagcttgcctggcacagcacatcaataacaacagaataataagagcatcgtagccaagagtgtgagcctgcgtgtcagcttgcctggtttgaattctggctatgtgctttctaactaagagactgagcaaaatatttttacctctccataccttcgttttcttatctgtaaaatgggaataataaaggactcacttcataggtgcgccatgagaattaaatgagataacatatgtgaaataacatatttaaagtataattagtatgcagataatatagtgactaaatgttagctctcaatagttactgttatagtcttttttcagcctttcactgtgtgttctgctttgtgcttggagtatcttgtggaattttcacaacagcctcatgaggcatagggattactcttattacctttctttgactcggggtgaggtgaggtttctaggatctcccagccagtaaaaatgggagccaagagttgatctcaagcccagctgatgcctgaaagcgctggaatccttccctgtattcctgatcacagatcacttaggttcattcttcccttttgggaaggaccccatcacgggtgctctggacaaagtagacagggaacctcctgagctctgtagagttggataagatcaaagggtgttggctgggaaattgggagggtctggcgttccctgctgcctggcttggaagcttgacctcatccccatgggtcagcagcccctcagccctccctctctacccgcacccccagaaattttgatgaagtcatctcttgcttcgccaacgtgcccaaagacacccccctcttcagcgaggcccgcacctccctatactccgaggatgactgcaaggtaagcgtctaagcccagggagcaacctggggagcaggtgggccgtggyccccaggctttccagccctaycccttgcttctccctmtcagagcctcagagaagagcccatccacattctgaatgtgtccatccagtgtgcagaccacctggaggatgaggcactggtgccgattttacggacattcgtacagtccaaggtactctgggcgtgcctctggttttggtgggggttcttggagaaggaggaggggctgggctcgtcgaggcggcccttggggaggcaggcgtgctgagtacttcagagccacagacctggcttcccactctagctctgctcgcctcatagctggcgaccttgggcagatgtggctgaacgtggggtcagcatttctctcrctcacggtgttgcaatgattcaatgacaaagtatatacacggcttagccagtcccaggtacggagggcacacccaataaatagtttggagattttctgggagtgtttttgttggaataatccagaaactggcagttttaaaatggctacttacattgatgaccaagtgtgccaataacagcaggttgctctgtaagcctgtgatgccattgtatttcagcctgggggacagagcgagaccctgtctcaaaaaaaattatatatatttacagtatacaatgtgatattttttaattatctttttaataacagctttattgagacatcattgacatactacacaattcacccatttaaagtgtgcagttttgcagccataaaaaagaatgagatcatgtcctttgcggggacatggatgaagctggaagccatcatcctcagcaaactaacacaagaacagaaaaccaaacaccgcatgtgctcactcataagtgggagctgaacattgagaacacatgggcagagggagggtaacaacgcacaccggggcctgtcggggggtgggggccgaggggagggaacttagaggacaggtcggtaggtgcagcaaaccaccatggcacatatatacctgtgtaacaagcctgcacgttctgcacatgtatcctgtttttttttttagaagaaataagaaaaaaagtgtacaatttaatatatttttagtatattcaccaggttgtacaaccatcaccagaatcaattttaggacattctcatcactccatagaaaaaccctgtacctgttagcagtcactcccctctgtccccaacccaaaaaccctctccccaccacagccctaggcaaccactaatctactttctctctatatagatttgcctatkctggacgtttcatataaatggaatcagatcacaggaggtctcttatgattgacatcttccacttagcataatgtttacaggttcatccgtgtggtaacatgcagcaatacttcagttccttttacggccaaataatattccattgtgtctttggtttttaatgcagaaaaatatccttgtggattatggactccgacgaatcacattcttgattgcccaagaggttagttcacagttcatctctatgagtctttcccattctccaagccttggtgtgtgccatttatttgatatttattttgtagatttgggtgaaagagatcattagaaaggagaaggatttccaaatgattcattctagaagtgaatgtaatcgtttacaatcactaaataaggatgtacatatttcagtgcgtcttgcttgatttaattgtcttgtgtgtggatttctttttgcagaaagaatttcccaagtttttcacattcagagcaagagatgaggtatggccaaaagtaatgatgttttctcttctctagcatcttgttttattttttaagagatgggatggggccgggtgtggtggctcaagcccgtaatcctagcactttgggaggctgaggcaggaggtttgctagagctcaggagttctagaccagcctgggttatatagtgagaccctgtctctacaaaaaaattaaaaaatcagcctggcattgtgatgcaagcctgtggtcccagctacttgggaggctgaggtgggaggattgcttgaacctgggaaatagaggtttcagtgagccaaggtgattccactgcactctagcctgggtgacagagtgagactctgtctcaaaaaaaaggaaaaaaaagagatggggtctcactatgttgcccaggctggactcgaacttatggctcaagcgattctcttgcttcagcctcccgaatagctgggactataggcacatgccaccgtgcctcccagctccctggcatctttgatattcatgaagaatatagtctgcagtccttaaggcatccccatattcaagaatgtagcaacttttgtgtagactgcagtcttcctctgggattgtatttccattgagagccctctgttccctgcatggcactcagacctgagaatcttgccctttcagcctcactacaggtttctgtcttgcttgaataattttcagtacttgctgatgtactcagtaagacattttttccaaactgtttttcttatgctcgtctagaacagtggttggcaaactcacttgcagaccagctgcctgtttttacgaataaagttttattggaacacagccacacccgttggattccacattgtctactctggctttcactctaacagtagcagaattgagtagttgtgacagagcccgtatgatccatcagcctaaaacatttactctctggccatttaagaaaacgtttaccgatccctgttgtagaacaggtaggtttattcccagcactgattcaagaccccaccaaattcagcattttgcattttaatttatccaaagctttatttttctagctaagacacatccttttcttaatgtcttcattttttttttcagtttagtttccagtactgtcagttgctttcttttcsgggaccaatttccaccaagaaaccaggggttagtggcttcatgagaattgccacaggctgtgacagatggagaacagcctggtcacgctggcaggtgatagggactagctaggttcccccaggagccagcgctgcacccagcacaacaggcttgcaatgcccatagctctcctcagatcttagcaaaaccccaaatatctggagccctgggggtagcttacaattagggaacatcatgaatgctgcattcctgagtgccaaacccatggacaccaggggtctgcagagtagggtgtggaccaagcagggacgcagctccaacgtcacgctgtgtgtgtatgtgtctgtcttctctctctggtccgcctacagtttgcagaagatcgcatttaccgtcacttggaacctgccctggccttccagctggaactyaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggtaagatgtcgcagagcatttcttcctctctcagaacctggccctcccttccttacattcctgctctgtgctgggtcctgggctgcatgctggggatggagagtacaccaacacccagggtcctgcccttgctatgctccagtccagggcaggaggcggacagcaaagtggcctgtgatcacgtccaggctggtggcacttggatctgtttcttgtattatgtgggtctctgcgcatgagaagaaaatttccaggatagaaaaatactggtttgttcagggaatttcttaatatttgctgactgagtgatcgttttccattgtttcttgcatttagaaaagtaatccatggccgggtgcagtgacccatgcctgtaatcccagtactttgggaggctgaggtgggcggatcacttgaggtcaggggttcaaaaccagcctggccaacatggtgaaaccctgtgtctactaaaaatacaaaaattacctgggcgtggtggcgtacacctgtaattccagctactcaggaggccgaggcatgagaatcgcttgaacctgagaggcggaggttgcagtgagctgagatggagcccttgtacttcagcctgggggatagagtgagaccctatcacaaaaaaaaaaaaaaaagaaaaaaagaaacagaagtaatccatgattatattgtgaaaattttaaataagactgaaaacgatttttaagaacctagcgcaaggaccgagaatcctgtcactgaggggccagcttagttgttgactgtttctagacacaattccgtccctgaaacctagagttgtaggcataagttgcagataagagctgagagtggacagatcatttgaatatattattctttaattggtcagtcacttgtggacctctttcattgttaataaagagtggtccaccacatattatttccttgcatggatgtaccgtgtataattttttttttttttttactaatcccctattgatggaaacatatatatattattatatatataattatatataataatatatataatatattatataatataacatataatatacataatataatatataatatgttatataacattatatatacataatataatacatattatatgtatttatataaatatatatttatataaatgtatatataattattatatatatatwtttttttggagatggagttttgctcttgttgcccaggctggagtgcaatggcacaatctcagttcactgcaacctccgcacccccgggttcaaacaattctcctgcctcagccttctgagtagctaggactacaggcacaccccaccatgcccagctaattttgtatttttagtagagatggggtttctccatgttggtcaggctggtctgaaactgccgacctcaggtgatctgcccacttcggcctcccaaagtgctgggattacaggcgtgagccaccacgcctggccctattgatggatattaagctaactgcagtttttttgctacctgtcagctagatgttttatttttattttgatacagagatttgctcttgtcacccaggctggagtgcagtggcgtgatcttggctcactaccacctctgcctcccgggttcaagcgattctcctgcgtcagcttcctaagtagctgggattataggcgcccaccaccatgcccagctaatttttgtatttttagtagagacggagtttcaccatgttggccaggctggtctcgaactcctgacaactgatccacccatctcggcctcccaaagtgctgggattataggcgtgagccactgtgcctggccaagccgttttaataggttttattattgttgaggtatggtgaggccaacagataaggagacaactgccatcaaaaagacagtttattactcatagttcccaagaagaaggggttttccctgccatggggccacatggggaggctctggggttggtcaggcagcagagggacagaggggaagacatggaagacgtggacgagagccttgattgtggtttcctggagaagaaaaaagtgaggctgagtaaacaggtttaggattggctgtgaatcatctcagcagaccctggcatatagaagctgtctctggttctcaggaatctggccctgggtgattagagcaggtggtttgtgtccccaggtatgatccagggtcagcaaggccccaggtgtcaaagtgtcagaatgcagaaaataggacacatgtcaatacactcaacagctttgcagtcccttcgcctctgagaggcagggctctgctgttcttgcctggcacactttttggaggaggggaatgttttcctcctgtctctgcctctttggggctgagtttccagccagctgggagtaggcctgcacccctggcctgagcagctgcccctcccactctttggcaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaaggtctcgcctttgcaggggggctctcaccgggctctgggttcaccctctgagccatgctgctttggggtattgtctcttgccactcaagacctgggttccaggatgaaaccatgcgtatctgagcctcagttgctgcgggaggagagcaaaccttctgccattcaattctagagctatgttttagccatgccctgcacgggaatgctttactttaaggatgacaagcatgctcaaaatgtctttcaaaacaaaattttgtcctttccctggttccaggctgcgctggggactgcatgtgggtggggagagacgtgagaccgtgaggtctgtggctgaatgttccctgtcaggtggctcttcacgagcagacagacttttatggtggtgattctggaatgaaagaagccccacttgtaatcccagtactttgggaggctgaggtgggtagattgcttgagcccaggaatttgagacaagcctgggcaacatggagagaccctatctctactaaaaattttaaaaattaaaaaataaaatattaagattattaatcaaattaatattaatatcgatatattaatattattaaaatatataaatgtattttattttattatttaataatatatattattaaaaataattaatacaatagtattattaaaaagagaagtcctgatacatccgtttggtatctgggggattcaggggacccatgtggaggctctggcctcactagttcaggtagttccagaaggaagcagtgcaatggcttgagtcaaaggcatgtaaagatagtataacatagcagtactagttcagtcacttatcagcctcagtttccttatctgtcagtgagggattagaaaagctcgcctctcttgagtacttacgaaggcaaaatgaggtagagttttaaatgcttagcaagagccgttgcttgttattagttaatactttttgttggatacacactatgtcccaggcgtttttgcagtcagtatatctcatcctcttattagtatcagtgctattgcaaatgtccttgggatgtcttggccctgaaactggaattgctgtgttttggggcagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatgtaaggctggcccgcgccgtgggggtctaagtcaaagcagaagcaggctkcttgggccatcaatttgtagattaagatggcatttggaggcggtcttgccttgctctcccatgtcattctgggttggggtagccccctctgagtgttatgttaaatgtgttagcctttgaatcttggtttttcactcacctaaaaaggagagtgaatctccaagtttaatccattctgtggccatgttggatttttgatagagacaaggtgtcaccatattggccaggctggtctcgaattcctgacttcaagtgatctgcccgcctcgacctccaaagtgctgggattataggcgtgagccaccacgcctggccatatggccatatttgggataagttgtgcactactgtggttgactgtaatgcagtcctcagattggttcacttagggaaatactttcccaaccatgttctaggacagacttttgtaaagtgaattaaatgttcttttgactgccatttaaattcctatgtgtgtacataaaaatatacatatatatacacgccattttttaaagagatattgcctagactgggcctgaactcctgggttcaagcaatcttctggcctcagcctcccaagtagctgggactacaggcacatgccattgtgcctggtctatgcactttttattttggagtaattgaagactgaagactctcaagcagttgcaaaattagtacagaagaaaaaaaatagtgcagaggattttcacccagtttcccccaatggtaatgttgattgaacttcaccattgcacatcattaaaacaggaaattgacattggcacaggactgttcgcaccaacactgaccacgttcggatttcaccagcgtttccatgcatgcctgttgttgggagtgtgwgatgccttgatcactgtatttttggaactgcattccacagcccctgttgtcccttcttgttctggccctccacagtggtgaagaagggagttttacrtagcccaggcactcactttgtcatgccatgtgacatgctttgcttcccccacctgcattttcattgaggactgggcagaaataaattgggggagatgtgtgattctctctcactckctgttttcccycctttctggtccagatcatgtttcactccttcggcaacaagcaagggcsccagcacgggatgctgatcaatactscctacgtcaccaaggatctgctccaggccaagcgattccaggcccagaccctgggaaccacctacatctatgacttcccggaaatgttcaggcaggcaagtccggcggctcagacgcggtaccccctgggtcctcccagcagactccaccagaaccaaagcccatccttaattctccttctaaagacctagtctaaaggacaaggtcttgccaggtgcggtggctcacgcctataatcccagcacttcgggaggccgaggagggaggattgcttgagcccaggagttgaagaaccccatctctacaaaatatacaaaaattaaccgggcgtggtggcgcatgcctgtagtcccagctacttgaaggctgaggcaggaaggatcacctgagcctgggaggtcgaggctgcagtgagccatgatgtcaccactgcactccaggctgggtgaccgagtgagaccccgtcttcaaaaaaaaagaacaaggtctgcattgaagaaaaagaaatgaatgtgttgagaacgacttcatagtatttttctccaaataagactaatttatcccaatgataaaagtcataggatatagaaacttcagaaaataaaggaggttggaacaaagaaaaaataattcctagtcccacactctgatgacaaattgcttaacattttgatgtgtttccttctggtctttttaatggtcatttattaagtacctgctacttaccaggcaccattcgaagtctagacagctgtgggaaagaggagggggtcactgccttgagtaatttttagtctactcttaaaaaataatgttttgggttgggcacagtggctcacgcctgtaatcccagcactttgggaggctgaggcaggtggatcatttgaggtcaggagtttaagaccagcctggccaacatggtgaaaccccatctctactaaaaatacgaaaattaaccaggcgtagtggcaggcacctgtagtcccagctactcgggaggctgaggcaggagaattgcttgaacccgggaggtggaggctgcagtgagctgagatggccccactgcactctagccctggtgacagagcgagactctgtctcaaaaacaaaaacaaaaacaaaaaaataatgttttattatgtttttctgatgattaaagtatacataggaaactatggaaaggtaagaataaggaagtaaaattctattcatatgtaattttcccaccatcaatgcctgaaagaacatttgggtgcattttcttcaagtattttttatgcctttatatgtttatgccctaggggctttaaaggagcctgaaccactgacattggtgatgtgaatgtctcttcattttccaggattgctttggaatgacattatatatatatatatwttatttatttatttatttattatactttaagttctagggtacatgtgcacaatgtgcaggtttgttacatatgtatacatgtgccatgttggtatgggatctaattaaactaaagagcttctgcacagcaaaagaaactaccattagagtgaacaggcagcctacagaatgggagaaaatttttgcaatctactcatctgacaaagggctaatatccagaatctacaaagaacgcaaacaaatttacaagaaaaacaacaaccccatcaacaagtgaatgacgttcatgaaaccaaggtcaaggaccttccagtgtaggcaggaagcatctgttcctacctctgcctatgcctcatgcatagaggatatgaaagagtaggaaaagctgctctttagagtaactcgggcctcagctcgaatgctggatctgtccccttgcttcctgctgtccctagccaagttccttcacctctctgggcctcagtttcctcttctgtaaaataagaataataacagtacctaccaaaagttgttggaaaagtgtatgtattcagtgggcgcttaataagtggaaacttatgattaagaatgtcattgtctgtatccttttgcctttgacctcaagagctataagggaagaaacatgactgaaccagaagcaaatccatcgtctcttttttagataaatccattgtctcttttttacaggcatgagccaccatgcctggctaatttttttatttatagtggagacagggtttcactatgttggccaggctggtctcaaactcccggcctcaggtgatctgcctgcctcagcctcccgaagtgtttggattacaggcatgagccaccacacccagctgtctgtctgtctgtctgcctctatatctatatctatgtctatatctatctatttatctatctatctatcgagagaatggaaaactgaacagcagaccagagctaaatttatcaatatggataaatctctcaaacaaagaggagtagaaaaagtaatttgctgccgggcgtggtggctcacgcctgtaatcccagcactttgggaggctatggtgggtggatcacctgaggtcaggaatttgagactagcctgaccaacatggagaaaccctgtctctactaaaaatacaaaattagccaggtgtggtggtgcctcaacccgggaggttgaggcaggagaatcactgaatccgggaggcagaggttgcrgtgagctgagattgcgccattgcactccagcctgggcaacaagagaaaaaaaaaatagaaaaagtaatttgcggaaggatgtgtacagtgtggtactctttatttaaagtttgcagtgcaaaacgataytgtatgtttccaatgtatgcatacaggataaaggaaaatgaaaaaaaaagcatgcataggactgggtaggcactgaattcaagggaatggtcacctgtgggttggagttgggaggaagaatgagctggggcttcaatcgcatctttcttctttctttcaaaaactttaaacaactatggaaaaatcaagatttgacagagccactggatgggtgctcatatttaaatatgctttaaatatttcatgattcaaaaagagagagtgaactacagaattcaccctggaatcatgacagatcatctctgtctgggaaagatagttcttccctactgatgacttcaagttttttctctttcctcttctctccccaggctctctttaaactgtggggctccccagacaagtatcccaaagacatcctgacatacactgaattagtgttggactctcagggccagctggtggagatgaaccgacttcctggtggaaatgaggtaatagctcagcggagcctarcccctggctggagtcacccccttaaaaatatttttgggccaggtgcagtagctcacacctgtaatcccagtgctttgggaggccaaggtgggtggatcacttgaggtcagaagttcaagrccagcctgggctacatggtgagaacctgtctctacataaaattttaaaattagctgtgtgtggtggtgtgctcctatagtcccagctactcgagagactgaggcaggagtgattgcttaagcccagaaagttgaggctgcaatgagctgtgattgcaccactgcactctggcctgcgcaacagagcaagaccctgtatctaaaaaaaataataataactaaaataaaataaaaagttttcccccaaagaaacaaactcattttccttgtrcattcatccccttgccaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccragatggcccgggcagagggcattcccaaaatttacgtggcagccaacagtggcgcccgtattggcatggcagaggagatcaaacacatgttccacgtggcttgggtggacccagaagacccccacaaagtaygtcgtgaaactggcggggcagggtgattctgctcagctactactgtattttcagtgggagtgctagcacctgcaagaggtgaaaaaaatctcacttatgtataaagcacagatgtacatgtagtgtataaacaggcatacagtgtatcagtgatactaacatttcactgtggcgggggggatggtgatgagaaaaaaaagatctaaaaaggctccttaacggggataatgaaaaaagtctataaaccctgagctgatatacactgagcgctcctgaatgcagtgtgcactgagaatgcagaggtgattgtgtcaactccctggcctcatagcgttcttagaattatggctcacacctgtcatcccagcaactcaggaggcttgggtgggaggatagcttgaagccaggaattcatgaccaagctaggtaacctaggcagcatagccagacttcgtctctactaatgaaaaaactaggtgagcatgatggtgcctgcctgtagtcagcctcagctacttgggaagttgaagtgggaggatcacttggagcccaggagttcaaggctgcagtgagccatgatcatcataccactgcactccagactgggcaactgagtgagaccccccatctcaaaaaaaaagaaaaatctttggggagttgtatagataccagcttgccataaaaggcaagatgaatgagggaagcgcacgcattctgtgatgtgaaatgacaggggacagtcatcctttccattcagagcatgcattctcgggggcgatattgcccactacccccaagaagacagaaaaataatttttggggtggcaataaaataktttttaacatatatacatatacrgagtatgtaaatagtggttaaacagtgtatcttgaaaattaaaatttcatgttggggtgctggcaataagaaataaaaatgagatagtccttagaggagagcttagctcaaagcagaacttcagtttatggctgttattaatacggtatttacatgagatgtgttaatgtgtcattgacatgttactaacatgttattaacatccatccctacratgttcacattaagaaaaaaaaaacagtggctttcagtgcagggaactggattcgtagcctcactaaagtattttttaagggatttaaatacctgtacctgactccccaagactacaccagaatcagctccctgaactccgtccactgtaaacacatcgaggaaggaggagagtccaggtaaataacttatcaggtagctccttarttttgctcrtggttaatttcagctgtcttctttcctcggggcttgtggcgatattttccagtggggtggtggtgtttgtatgatgggaaccaatgcctgttgggggcactgatgccttaaacatttgttaaactctccaaggtgagtccatccttgtcattctaaaatgagtgactcctttcacaaaaaatagcacgtcatgtagggagaatgagattggattctcgtgaatctcctaggagccgcaggctcacattttgtgaccaaactgatgcagcggtgacttggcaaactgggaaggtatgggtggggcagagagaggtctgttcttcgagagcattcaaaggctactatcttttccaggacaagttatgtttttctcagtgggattaactgactcaggatttcctagactgggttttttgcaatgttagtgacaagctggggggaaattccatagtcagatgagtttgggaaacactgggttaaatgagatctcataaacatctttattgcagaccttcttagtacctgtagcatgctgtattagtcagcgttctccagagggacaggactagtaggatatatgtatatatgaaagggactttattaaggagaattgactcacatgatcataaggtgaagtcccatgataggctgtctgcaagctgaggagcaaggaagccagtagtggctcggtctgagtctaaaagcctcaaaagtagggaagccaatagtgcagccttcagtggccaaaggcctgagggcccctggcaaaccactggcgtgagtccaagagtccaaaggccgaagaacctggagtctgatgtttgagggcaggaagcttccagcatgtgagaaagatgaaagccagaagactcagcaaggcagcttactccaccttctttcacctgctttttctagccgcgctggcagctggatgactggatggtgcgcacccacattgaggatgggtcttcctctcccagtccactgactcaaatgttaatctcctctagcaacaccctcaaagacacacccagaaacagtactttgcatcctaaagttgacacttaatattaaccatcacacatgctaaagtgcattgtgaatctctaacagaggctggcgggacagtgtttctcattatgtggccctggaatttttgattgattgattgtgaaygggtttcctctgtgtacccccatctctctgtagaccgttggaggaatatgggccgagggtsatatttcactgagacagcccctgaacaggcagatatctttggttgtataaaccaaaaagtatctgagacaggtctcaatcaattgagaagtttattttgccaaggttagggacacatccagaagcaaagaacacggaatcatagaaaccgtctgtggcgtgtrcctttcttcaaagatgatttggagggcttcagtatttaaaggagaaaagcaggctggaggggaaagagggaagttctggtaatcacatgttgcaggagaaaaggcgcaggcaggggaagtcagttatgtattcttcctgcgctcagtaagtcagcactttctataagataaggtggacatagaggaactacctgtggagatatttcagcttttatctgtatctatctgcttactaaagaaacaaaaggaaaggcagcttgcacaactcagcttcagcttaaattgttccttttggcattgtgaatcgtggtcctagtttttattttcctttcacagatgggagcagtgtgatgatttatttatttatttgagacagaatcccgctctgtcacccaggctggagtgcagtggtgtaatcttggctcactgcaacctccacttcccaggttcaagcgattcttctgcctcagcttcccaagtagctgggattacaggcgtgcaccaccacgcccagctaacttttgtatttttagtagagatggggtttcgccatattggccaggctggtctcaaactcctgacctcaagtaatctgcccgcctcgtcctcccaaactgctgggattacagagcagggtgatgattgttgatgctgcacttgcccttttagaaatcttagcactcattttgagggttctagatgccaatttcattttgcctctggatgctttgtctgcttccaatctctcaccttgctgcccagtcagtcccttcttgggaaatgcatccaccttggattttttggggctagagcccagcctttaacctgtgcttgcttttgaagatacatgatcacggatatcatcrggaaggatgatggcttgggcgtggagaatctgaggggctcaggcatgattgctggggagtcctctctggcttacgaagagatcgtcaccattagcttggtgagtcttcttctattttctcttacttttcaactttccattatagaaactttaaaattgtcacaaaattagagagaatcaataataagccccatgtgcccgtcacatacctcctacagttaccacatgccagcccactgatatttcctcaatctcacccccatcccctgcacctgttttagagtattttaaagccagcccccatcatgtcttttcatccataaatacgtaagggtagatctttaacagataatgactctcaccctcttcccccrgtttttaaaaacataactgaaatactaatattacacccaacagaatcagcaatatcattgaaacccagtgtggtttaacagttatctcaaaatacccttttctagtggtttgtttgaatcagggtccaatctcatcttattttcaaggtactgaatgtttagaagaacttttctctgactttaactggcatataaggagtagtccccatcccatccccatggcctttccaaaaatgttttctgtttctagtagtagtactactgtagtagtagtagtagtactagtagtaattctagtactagcagtggtggtagtagtggtggtggtagtagtagtagtggtagtagtgtttgtggtggtgaatctgtatgggtctaaggcagagtgagagaccgaggcaagtytctcagcaggagtgaaagtttattaaaaagttttaaagcaagaatgaaatgaagtacacttggaagagggccaaacaaggcaacctgagagatccaagtgcctcatccaacccttttgaggttttatgcattggcatgattccagggtttgtgtttcttctcccctgattcttcccttggggtgggctgtctgcatgcacgtggtctgccagcacttaggaggggccgcatgaacagtgtgtttactgaagttgtgtgcatgctcacttgaggctttcctcctttaccagtcgagtgttcctagaagaagggcacggtaccagataaactctgccatcttacctcttagcatgcatgcttgagcccacccacccagctcctgagatcttatggggaagctgcttatcactagcttcaggtgttttctatctatcaggagattgcctttccctggagscagctgtgaccaatattaattttagagagacactttagcaactgcctaactatcacctgatggttgccttcctctcctgccctgctcatgtctgcttaactacctactctaacagcagcagcagcaggaataatagtactctttaatgataaactgccttggaaggccttatttgtacatgcaatgttgaatcttcagtttccaagtggaaaatgttggtcataagcatcttccttgggcttgttttctagattatatgtatagtctttttattttgaagtcatctaggacccaccgtaagttataagatactacagagaatttccaagtacccttcacccagcttyccctatggtacttacataaccgtagtacattatcgaaaccaggaaactgacattggcacaatattgttaactcagtacagaccttattttgaatttcaccagtttttacatgcactcctaggtgtccttttggttgttaagaggctgcaatggcccatgaatgcccaggctcagaagagctgcacacaagcctcttaaaatctgaaacattcactgtctgctgcttgtctttacagcaatctttgttaaccatgttatttccagataggaatccaagctcaataaagtggcctgaagaataggcttttgcctctactgtggtttggctccaaatygggttgccattggtcaaaacataacttccatttggtcccagcaggttcctggactcttccctgctgtggggggtgggtccctcgccactctccagaattcagagggggtcctctctccacaggtgacctgccgagccattgggattggggcctacttggtgaggctgggccagcgagtgatccaggtggagaattcccacatcatcctcacaggagcaagtgctctcaacaaggtgaccaaaaaggggcctgtgcagagtggatccttgggggccaggagtcattttaacattcccattggtctctggtgggggatttttctcaatatgaagccagtttcattcctactgatacaagagctctttttttccaatttgcagctatctgggtccttatgagaaaaaaaaaattagttttaggcaattctggtcgatctaactccctgtattactgacattttaaaacaaattattgaagtgccattacacattgcagaaaattagaaaaggaaccccccaaaaaagtaattttgcagcttctatcattctggtatagttccctctcatcttctgtctttatgtggttwatttatagtgaatatgcagttttgtattctacttttttcactgtattaaaacattttccttgttgaaaagtctctatacttaatgtctgctcaaatctcagccaaagtctcaaagcctggttcttgaaccaacagcatcagcatcagatgggaacttgtcagaaatgcacatcctcaagccctgctgcagacctgctgaatcagaaacactagctagggttttgcttttgagatggtcaaggtagaagtcagctgcatcaccagttctcaaattggcctgcatattggaattatctagaaactaaaaaacaaacaaaacacaaaaactaattcctcgaagattctgatataattggtctggatgtagcctgagcatcaggatttgtgaaatctcctgggtgattctaatgtgtagccaggattgagaagcactgagatgatttccaaacaggtggtagagccctgcaccgtgcaggacattgctaaccatgttgtgtcaaagcaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggtgcagtactccccctgcagcttagaacctggaaractcttattaagctcattggctaattctgtccctgtcacctcctgggtggtgtgggaggctgaggagcaggaagcactgcacatgtggctggggttgatttttcttactccttcttccttctctgatgcccagccctgtactaggtgtcctttgctcttttggtggcactaatgccattgtaaggatgctatctgttaatcctttagaaagaggtagtattgcctcttgacaagaggcagcattggacaatactgagtctttaagctttacagtcaggctggatttgattcctgccttcctcctcggtagctgtaagacactgggagagtccctaagtttttctgagcctgtttcctcatctgtgaaatgagaataataatagcacctaactcatggtgttatcatgatgattaagtgaagtgatatttaaagcacaacgtttggtaggtcctcaccaaagtaagaaggggacaatcgtgggcacagttcttggttaactgtaacattccttacaaatgagtgaggttgtcattcttcattataaccatttctgagaggttgggtttacagagttcaggtcattccagatcttctgccaagaaccccaagtcacaaatgtcagtttgtattcccaagtgccccttttccccatctgcatgccatctgttaccaytctctgcaaccaatctctttttctttcttttaagatgtttttcctcctatctgaccatatatagcagtagcaaccctttcctgcgtttctgtaacttcccagcatcagtgacaccatctgaaccgggaagcacactcaggagttcataaactagatttcagaagaatccatgggatggccagtccttatctggcattttccaatcagagcagtggcttcaggagccctagggaggggatattgctgcataaccaggcataatcatagtcagaggagcaaagtgctgatcagaggtattattgacaagcaccacagactragtcagagacttggctttcttttttaggataatcacagccctgtccctatcatcacacccaytgaccccattgacagagaaattgaattcctcccatccagagctccctacgacccccggtggatgcttgcaggaaggcctcacccaagtaagttctaaagtattttgcctaggacctggtctcgggtttctttctagggcttgagacaaaggagcactttgtctcaagcgcttgagacaaaggcttgatattcgttctcatatcccagagaggtatacctgaaatcaaatgcagggaaagtagagaaatggagattttactctaggcttttcctgagccattgaccaagaaggggtggaaacagcctccagtttctggagctaatagatggaggtggggtgcaatggtggtcctggtctccctcccctgatgctccatgctccgtggtctctaactgccccactgtctcatcagtagaaaattcagtgctgaaacatcagagtttcaaagagaagactgcatctttctctttctttctctcttacaaaggaactctgtgagtttacacaggataggcaatctggtctcctcttctttttttttttttgagacagtgttgctctgtcgcccaggctggagtgcagtggcgcgatcttggcttactgcaatctctacctcctgggttcaagtgattctcctgactcagtctaccgagtagctgggattacaggtgcctgccaccacacccagctaatttttgtatttttagtagaggcggagtttcaccatgttggccaggctggtcttgaacacgtgacctcaagtgatctgcctgcctcagcctcccaaagtgctggaattacagacatgagccaccatgcctggccaattttacctcttctatacctacacacacacacacacacacacgcacgtggacacgtgaacacacatgcacatgcacacacatttttgcacacacacattctctctctgaaagggatgagtttctctcttggaggtatattatttcagtctgagcaaccagaacacaacaggaaagttgagctgctcccgtcactatatcccaaatctagaatttcacatgctgctacctttagacttggctgctccttggctgtgcaatgcaggagaggtgaccctcgggagtgtgctagactccagccagtgcaaggagtcctgtggcttccttctcttgcttttcatttctcttgggctttctggcctgtaaacactgagggggctgcttatctcaattaaaaaatgttcggcttctcactgtcaggccagtcctcggcagatgctgaagctgtgctgttgcatgcctgggtgccgggcctcccatgcctgagatgcctcttactctggctgccccctcctggtcagagccacagccatttacgctgttgcatggatttaagtcatcatttcttccccaccaatggctgtcattgacatcatcatattctctctctgtctctctgggaaattgaaacttttttcccaattaagtggttatgaagctgcagccagcagctagcaggtgagggatgagtttttcgggaaaggtggtcccttcctaaaatcccaccttctggaggtgtctgtccactctctgcatcttaggaagagaaggcagagaccatgattagaatctatgtgtttggagttggctggctgttgatggtagtcacatattccatacagactgaattcttgacttggtatatttattgcagccctgtttgtcttttgaggcattttgggaaggagggaaggggttgggctgtgtggttttaggtagaaaggggtatctgggctatgaggttaaagccaggctgtccttagggagcttttgcacagccaggagtgtcctgggggcccccagccacctggccctccagcctgggcttctgcccttctgtccacagctctgaagggaacgtggcagagcggattctttgaccayggcagtttcaaggaaatcatggcaccctgggcgcagaccgtggtgacaggacgagcaaggtaatcatgaagacgggagcaggctgcccatgtctgactcaccaggcattggggccccgaggtgtgaggccagggacctccaggggcaattttcttcttggcctcaggattttctaaaagaaaaaaccaatttggggaatgatttctgcagtgtctgtgtgtgcccttagaaggtatctcagccagcctcctcctgaggcctgggaccctgtagtcagtccccaggccacaagggctaacaacccctttgggcatcagaaggtggccttgggtgctctccccagaaaacttcacagacactggcactctgaattccatcttargagagccatggacaggagccctgttgtatgccactgttggtgggaggctgcaatgcttgcatgctttccaagctgggcagctcacccttcagccttgtagctttcatctctttggacagctccacctgcctgaaagttcctccttataatgagccccgagctccctcctcatcatttaccactcattcctggtacgatgtcgcagctataagtccaggctctgcattagacctgaggccaagccccatctccatcactcaccctctctggtccttcacatctgtaaaatagggataataattctaccccaaaggattattgtgatgattagatgcaataacatgtgtgaaatatttaaaatcgacatactccataagtgggaatggctgctatcatttacatcttcggcaataaatactaaagtgcagccagggccgggcgtggcagctcacacctgtaatcccagcacgttgggaggccaaggcgggtggatcacctgcagtcaggagttcgagaccagcctggccaacatggcgaaaccccgtctctactgaaaatacaaaaattagctgggcgtggtggcaggcacctgtaatcccagctactcggggggctgaagcagcagaattgcttgaacccagaaggtggatgttgcagtgagccgagattgcgccattgcactccagcctgggtgacagagcgagactccatcttcaaaataaataaaataaaataaattatatttttaaaagcaaaaaataaaaaaaaaaaaatccactccttcttccatgtgaaaacactttgatttgaagactgctctcccccacccctgcatcatagggtaaacgagaaccatgtagtgatgcacagttcagtagcaagtaactgatgtcatggcatcccctgagctgagtctctgtccagttcaatatccctcagccctttccaagtgcaacttgatgtctagaccagtgtagtagctgctggctacatgtgatgctttagtttcattattattattattattttgagacaaggtcttgctctgtcacccaggctggagtgcagaggcatgatcgctgttcactgcagccttgacctcctgggctcaagcaatcctcccacctcagcctcccaagtagctgggactagaggtgtgcgccaccacacctagccagtttttttattttttgcagatacagggtctcactatgctgtccaggctggtctcaaactcctggactcaagcaatcctcctgcttcagactctcaaagtgctgggattacaggcataagccaccatgcccggctccttcagtttaaattgaactaagtcaaagtgacagaggatgacctgttccattcctcacacttgccacgttccacgtgcagcccacagctcctgtattggacagtgcagatggagaacgtggccctcgtcacagaaagttctagtggttcatgctgctccaggccctataccatcccagccctcctctgatggttcttgcctcaaaaagggcaccrataggtctgctacctttcgaggctcttaccatttgggggctttttctttgccttccaataaaataatccgccagattaaaaagagcattctcctccacgtgccctcacccccacacccagaggtccccaaatgcacctggggtgctgcccagggcctggctcactggtgctcattttccaggcttggggggattcccgtgggagtgattgctgtggagacacggactgtggaggtggcagtccctgcagaccctgccaacctggattctgaggccaaggtgagggggccgggagctgtggctgctggtttagccagcggtactgtcgagagtgggtcctgggcrtgggggtcccatccctgccctgccaacttaggtggagaagcaggggacccagtgcagtccctggccctggggggctcagtgcctgtttctctgacactttctctatgggttgcataaatggctgcaccatcttgcttcttcctcagcagatgataaaggtccctagaaacccctcccacctcctgccctgcctctgttgctgtttctgcgctaggccagggcacagactgagaagagctcaggagtcaagagggctgggttccagggccggctttaccccaactcagtgtgaccttgacgagcttggcacccctcggagcctgtaaaggagggcaacgggaaccttgctgggctgcaatgggagggtcagcctggtcctgagcggaggagatggggcttccatccttctgagccctggctctggtgctggggccagcacagatcagatcgcctgccatccagagcgaggttctggcagccgtccctctgtcctgggttgtggttgtgcagagacatctgatccccgcagctctgtgttccagataattcagcaggcaggacaggtgtggttcccagactcagcctacaaaacygcccaggccrtcaaggacttcaaccgggagaagttgcccctgatgatctttgccaactggagggggttctccggtggcatgaaaggtaagcccctccctgcctatgttaccccaaagccttggggtcagcacccaggacagcaccctctgggtggtgatgctaatgtcstagtctgtgcccatcatcatcttagctgtgtctcccaacaaccctgaggagaaaatattgttcaggtgccccactaccccgttttaaagatgaggaactgctgggcacagtggcagacacctgtaatcccggtgctttgggaggccaaggcagaaagatcatttgaggccaggagtttgagaccagcctggggcagtatagcaagaccctgtctctacaaaaaaacaaaataaatgtttaaaaaattagctgggcatggtggcacatgcctattgtcccagctatttgggaggctgaggtgggaggattgcttgagcccaggaggttgaggctgtactccagcctgggcaacggagtgagacccccatctcaaaaaaaaaaacaaaaaaacaaaaaaaaaacaatgaggaactgagggttggaggcaaagtgtcactttctagaggtcacaccatgaggtgcaggtcagggaggggcagccccaggagctgccgggtgacctgggcaggcacctccccatttggcaaggtgaggaggatgtttgtccacccttccctctgcagaaagctgctctgagcctcatgtgaccttacaattgtgtgagggctttttaagccaccaagcatgttttgggagagagtggctgttggatcactggggtgttgaggacagagctggatgggaggcagacagacctgctgtgagtccttgttaactgggtgacatcactgagcctcagtttccctcctttgtaaaagggggttaagaacaggaccaacctcagagggccgaggtaagrgtctgatgagctaattgctgacatgcagtgtgattgtcagtgctgttattattgcattcttgttttcatgtagggtgcctggggacctggagagatgtgtcttggtggaagataagggccatgttgcccatgcacattggggaaggatcagtgtgactgttagtgagggttttctttgctggaaatggtggggcagggcagggacagtcatgggtgagggcatttcaattccagttggaaagaatcctagagattggtttttccctgtgccttcacagatgaggccactgaggcccacactgggtgaatgacctgttcgaggtcacacagccacttagagagtgatcagtactctcaaatcccagcccagtgctctccaagcctctcagctgggctcactctcccaggacccccaggacaactagggcagtgggtttcatgtgtggatgagtgagggccctgaactgggaggctgctttgcttttcagacatgtatgaccaggtgctgaagtttggagcctacatcgtggacggccttagacaatacaaacagcccatcctgatctatatcccgccctatgcggagctccggggaggctcctgggtggtcatagatgccaccatcaaccckctgtgcatagaaatgtatgcagacaaagagagcaggtgggtgtgttgcccttagcctggcttagccttttcttgttctcccagccttgagagcccatgaccttgggagatcatggagggatgcagtggctggaacctgaaagtggtggagaaatgttgtctcttctttcatggtttccacttccccttcccaaggaagtttgcaatcaaaaaataaaaaggaaagaccaaaagcacttgaacttcctggcagccaggatgaaaagggaaatatgatgagccatttatctctcattagactctgagctatgagttcctataggaaatgttttattcagttttatatcccagggtctagcacagtgccttactctcctggtaggtggtcagaaaatactggctaaacaaatgactgaatgaatacttgcatgagaggataccggttcttcgcgggagaggtaacctccttggcactttccttaggaggaatttattccagagattcttacagaaaggatgatgacaataatgttcacagcacagtgactgatgactttgaagtgaaaactacatgctacacaggatgtcaaggcctcaagagtcattctactccaaatataggcacggcattcctgtgttcactccctcattcatttgctaattcaatgaatatccattgattacctcactgtatgccagccattctggtagacattatgatatggtggcaaatgggccaagcttgtcctgcattcagggcacttagacccttgttagggactgctgaggtcagtcctccaggaagactcaggatactgagcagcacttgaatggagtcattgctaacttttcatgctggccaccaggaagctcagagctactgatagcattcttcagggcttctaagctgtcaaaagcaaaagggggcagggggagaataaggggtaaataaaaatgttggaaatgaggccaggcgtggtggctcacgcctgtaatcccagcattttgggaggctaagggsggcagatcacttgaggccaggagttcaagaccagcctggccaacacagtgaaaccccgtctctactaaaaatacaaaaattagctgggcatggtggtacacgcctgtaatccaagctgctcggggggctgaggcaggagaatcacttgaacccgggaggcagagattgcagtgaaccgagatagtgccactgcactccagcctgggtgacagagtgagaccctgtctaaaaaaaaaacaaaaaaaaaaaaaaagaaagaaaagaaaatgtatgttggaaatgggaggacagctcacacaagactacactgggctctcaaggtgcttttgtgagatttaaagcgatcagaaacagtgcccctcctctaggagggcagaaattagcaaagttagagaggactgtggctggagagcaggagggttatgctgccatggaaaaagtcgtacactcttagacctgaaaggggccctccagagttcagaaagcattattttaaacagttggctcagtctttccatctgtgggtaaagatacagaggcccagagagggaaagtgacttgtctaagggcacacagcatgtgtgggggtaaaagagctgaggactgacacccagatcttctggctctcttccctccagctccccccacatccattagcccttgcttgctgggcaatgcctcatatacccccatccctgcctcttctcttttaaggggtggtgttctggaaccagaggggacagtggagattaagttccgaaagaaagatctgataaagtccatgagaaggatcgatccagcttacaagaagctcatggaacagctaggtaagggggtcccaaaggcttcacctctcagaggtcaagagaggcccagctggcccactgctgggggtttctaggatgttmaaaataaaatgaaaaaataccaaaatacagctataataactgtgagatttttaaagatattcacatttgtctgtttgttttgttttgtttttttgaggtctggctctattgcctaggctggagtgcagggtgcaatctcagctcactgcaacctctgcctcccaggcataagccatcctcccatctcagcctgagtagctgggactacaagtacgcaacaccatgcctagctaatttttgtatttttgtagatgtggggtttcgccatgttgcccaggctgttctcaaactcctgggctcaagcaatccacctacctcagcctcccaaaatgctggggttacaggcatgagctaccatgattggaggacattcacatttctaaatcaacctttttaacattttatatatatatatatatatatatatatatatatatatatatatatatatattgccatcgtgaatttatttctcagcatacacaaaagatagcaattgaagtatttggggctgatggggattatcagaattttggtggcaaaatgttcctttagaattcccaatcagagataagatattttactaattttgtttgaatgacagctttgttttacttgtcatctttagatgtaattatctttatttatttatttgtttatttttgagacagagtcttgctctgttgcccaggctggggtgcagtggcgcaatctcagctcactgcaacctctgcctcccaggttcaagcgattctcatgcctcagcctctcaagtagcaggaattacaggtgtgtgccaccacacctggctaatttttgtgtttttagtagagacagggtttcaccatgttggccaggctggtcttgaactcctggcctcaagtgatttgcctgcgtcagcctcccaaagtgctgggattacaggcgtgagccactaagtctggccacaagatgatatttaaatatccattttaagtgtcagtgtctttataactgtgctattcacaagattttttacagtgtgtgcgtgtaatttctttggctggtatcagggtaatgctgatctcatagaatgagttgaagtgttcgctcctattttctgagtttttgcagaattggcattatttctttatgtttttgatagaggtttttacctataaattcaacttctttgttatatataggactatttgtgttatctgtttcctcctaggtgagctttggtggtttgtgtgtttcaaggaatttgtctatttcatcttaagttgtcaatttggcatagagttgcttataatattcccttatcatattttacaatgtgtactaaaaatcattgatatagtatcctacaagcacgatgggtctgatggaaggggaaaatgtagagttgcatgttgaatgctgtcttgcaattgtgagtgcatttctgagactgtactagctatttgatctgagacaaagggggccatcaagatgggcctggggtgggggccaggccagtggactctgggggacctagggggctgagggcagcctgtgtagcagcaggggtaatatcagagttaaagctcagacctctcacaaggcaaggcctgtcctgcaaatcctgatttgtgccttcttcaaaaaaaaaaaaaatctccaccccatcacatatgaccagcttccatggcttgactggcctttctgctcacctgcaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgtgagagccacagctgccgtgtagggtgcaaagagcccaccctgttttccaaaacatggaggacatttgggctcgggggcggggagggcggtggtggttgggatgggtcaaatgctgcaggaggtgggagtcacctgggaactttaaaataatcccgatccccaggtggcactgcagaccagtgaaatccaaacacctggatggaagccaggcggtcgtattttttaaagatccccaagagattctaataagcagcaaagttcagggaccactagtctgatggctcggtcagtttggacctggaccaggggtagaaaccgttgttcctgtccagcattcacccacccctcaccattgcaaggactcccacagtcacctcctacccatgtccagtgctcattggttctcttgctgcattgttctccctcccagctgactcatgcctcacacgagcctgtgtttgtgtcggttgaggtagaagtgggtgccaggtttttatgggggacattttttcaactatggccagtctggagtcctggtgacgtcctgcctctgagcaggtgccttctcctccctgagcctcagcttacttgcctgggatgatctgggaatgatctcagagcctgggcccagccccgggcagccactgtcatgggtgtggtcagagccagtgtcccgtctcctccttccctttccggggattcaagcctggctcgtccacaggacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggtgggcctggggtgagaacgaggccggtgagcacagggggtgctgggggctgagacagctggcccacagctgggtccctctctgaggcatcctctgccccctccccaggcctacttgtgggacaacaaccaggtggttgtgcagtggctggaacagcactggcaggcaggggatggcccgcgctccaccatccgtgagaacatcacgtacctgaagcacgactctgtcctcaagaccatccgagggtgagtggccaccgcacctgcttcccagcctcctggcaaggacccgagcctggattgacccctagctacccgactcctatgcagccacttgaacccgccaccctgtgcagtctggggttgtccccrccccctccccgctccccagcaaagagaccacactccctaatgtcgggtctcccagcacagtggctggggtgggacagagagcctagaggtactctgaaggccgtgtgagatgcttccaactcatgaaccttgctggaatatggacttgtccaaagtcacagctggagcagggttggtcacagaacccacatttggaaccgctagccttcaggctgctgtcttccacgccagtgttgacctttccagagggtcccctcccccaattgccatggggtcaccccgtgaaggagggagtcgagcacaggggaccccattttggggatgaagctgagactcaaggcagtgtcttgtctcaggtcatgtcacaaagcagtgaccagtagggacggtggtgcctcaaggcattctgaacttcaggtcacagcccctcctgctgcacaggaccatcacccccatggggaccacagcagggactcgggagctctgggttctggggtgtggccccacacaaggactctgccacccttggggccactgaaaaagtggctggagtgatcccagccctcctctcacctcccccacagcctggttgaagaaaaccccgaggtggccgtggactgtgtgatatacctgagccagcacatcagcccagctgagcgggcgcaggtcgttcacctgctgtctaccatggacagcccggcctccacctgaccgtggcccrcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaayaaaaggcccaggagtgcctcttccaaacaaaaacagcctcctctccatagctgggaagtttattttgttttgtctctgaagacagcagttttattgcatcactaaatctaatcaagctaaaacatccctgtttccttttgcaaaacagtgcctggcatgtgggatccaggcgttctttaggatccttggataccacatcgtgaaatcttttatttttttactctgagaccagcaccagatgtaagtaagcatctcatatatttcagccaaataaatgggccaagggaaaaaaatatatatatatagacaggactagagaaaacctatttttgtaatgatgtttctttggatactgtctagtcacccagaaaaatgtatggatgaattttttttttttttttttgagacaaagtctcactgtgtcatgcaggctggagtgcagtggcatgatctcactgcaacctccatctcctgtctcagcctcctagataactgggattacaggtgcccaccaccatgcccggctaatttttgtatttttggtagagacagagtttcaccaggttggtcaggctggtctcaaactcttgacttcaggtaatccacccaccttggcctcccaaagtgmtgggattacaggcatgagccaccatcttcagccagatgatttttttattgagagagtgaaatgctattttgttccccaaatggcgctagtgaatcactaggagggtcccactgataggccatgtttagcactggttgccagggattctctttttgagagagggaaagcaaaatgaatggaagtacccagctggaggtttcagggcttctggaggatgctctcgcatagctcgaggtcctctgcccacctcttctctccaaggaaaatgaggactgccccttccccctgcaggattggcccccagcctgcgcatgcaccctcctcttgcccaagtggggagcacagaggcggagaggaatcccttaccacacccacggcccagcttgctcacgagtgtcacctctgtgacggtcaccactgctcccttggagggccacttgagttactgttgcttcctcgcctgctggcttgatgagcaccgatggtgggatctgaccccgaggggcagagctgtcggtgactgaggactggactgtggtgaccatgccgatttgctcagggagaacgttgcaatgcacccagcagctcctggctctgcaggcggcacagcctggggccctgtgatcctctggtttcttccaytggggcggagtcggggrtggagggagctggccacaacccactgctctgatgggtggtttgtccaargatgctgaatgtaatgcctggtcaatgtggaagcccatgaggttgcccagggaagcctccaaaagctgggatgcttgagggtatccaagttgaaaaagacaaaatctgaccatcagccagtgacagtcctggcaaatgaaggtggggcggggcagtgaggggtgggagaaggtgaatgattcattattccaccccgaggtttgctggggtgaggggaagaatcgatgctgctttgggaactgaaggtttttctgttgggaaggccctcttggttttggagagaaagacaagttatgagtagctgctaccctggaacggtgggcagagagcctactaggaaatgtgcagaataaactattttttgaaggaaacactttggccttgactttattatctggattggagaaggcaggttgcctccaggagcaaaggtaggcgttcacctttgcaccctccattcctgacaccacagctgagaccttgagtgagttcccatcacaggggcagacggggatgcagtgaaggaagctgaaggctagactgaaatggacaaagtcatccctttttgaaagcactggggaaaaatgttttagaaaattatatgcaagcctagtctataccacaggcaaaaagggagcttctctggaagaaggggttgggggttggcccaggcacttcacgtgcgagttccattcctttccaccaccttgatccacccctgttgtgcagatgaggaagctgaggcacagagaggtgaaggcatttgtccatggttatgcagagacggaatcaagtctgcttggctccagaacccagccctttccttttatgacctaggtccttggtgggcaggcttaagccacacttaggagttggttttacatggacccaaactgcagaagaaccccctacccgccccccaccgtggcttctcagcacacagtgactattcaattttgtctccaaaacacgtaacaacaactgttaccttgattctgcctgacaccttttccaggcaattccccctcaccagggatgggccaatcagagttctccattccccctgacagtgactgacgcaggtatgggcgtgtatccccagtagagccgatcagaattctttagggatggctgacagtgctgatgtggagagaacctaccaatgcagggggaagccaagcccagagatagagggggagatccagtcctgttggtggtacttggatgcctggatcaagccatgcctgaagtcagtagcccagtcccaggaacctatccatggtttttgtttgtttgttttaatgtttgcactagtttgagttggagctctatccttagccctggagatggcccagttagcccagaagacagcagttaatttccacccacagcagcacctaatggtggtctgtatcagcagaccctccaggcagggaggcgaggacctgagaacaagctgaaatgcagccctctgggatggggaggaggaagctctgatttggttttgcatcctgaagactacaggtcaattgtttgttttcatccggatttgaaacccggacacaagttgctatctgctgctaaggatgctggagtttactctgtggacatcagctgaaagtgctttctctgacaaggctaacttttctcccttgaaggacttagtgtagccagtcacaaggggaagggagaaaggatcagacaactgagtgtggacagaggtcttgttgggcaggttgggtgctaactgaacactccctacgatggccactggtcacgtgccaggttctggcctctttccacacaatcctcatgtgacccttggaggtggctgctacatacactctatcctcattttttttttttatgagacagggtctcgctctgttgcccaggctggagtccagtgatgtgatttcagctcactgcagcctcaacctcccaggcacaaataatcctcccacctcagcctcccgagtagctgggactacaggcatgcaccaccatgcccagctagcttttttggtttttgtagagacagggtctatctatgttgtccaggctggtctcaaactcctggcctcaagcgatcctcccacttcagcatcctggagtgctagaattagaggtgtgagctgctatacccagcttctatcctcatttttatagaagagaaaacccaggctcagagatgagcagacttctccaagtgcacatagcaggtaaaaggaggggccaggctaggaacccaggctggctcagacccaatccccctgggcttaatgcctttccgtaaatcctgaacctttgcaagggttagatcccaaaacatgagagcatcctgtagaccaagctccactcctcctgcctccctgacttcctggctaattcagccaatggcatcattcagatcctcatcaaaagcctcatgctctccatgccaagagcccacactagggtgggctgccctctttcccgattggcagatttttcagcccttgattggcagattctgtagcccctaaaccactcagaggaacctcacatttctgcatgcacagtgggctcctccacatcacaaatgtaaatgtggactgggttatccccatttctactcctttctttggcctccccaattgattattttatttattatcttgttattttgccttcctctgctccaaaagtcagttggccttttttctcagggtcattcttttcccctaacgttttactatgaaaatttccaaatgccaaaaagtcaaaatatttcatagcactcaccccaacccaccatcttgatgccaccattgacatctgactgtgcttgtaccttctttaacaccattctctccatctgtccatctctctgtgaatgcatgttattattttgtcacatttcagagtaaattgcagacattaatacatttctccagagttatttttgcatttcaaaaccagttgtttgttttgtaaatcacttcctgagcttttttgcagctgagagcacatccagatcaacagagctgtgttgagacgaagcagccagccgcgtggccagagagggagctccagttctcacagtgcacacagcaccagaaaaacgctttttttccattattttatgagcatatgccacaggctgagcactgtgagagggtgctgccatgagcaaggcaagccactcctgcccttggggactgatatcctggggttcccaacaggtagaaattgcaagtggctaaccataaggagatgtttagggtcacgactagtcaaaacagtgactgttaaatccagaaatgtccagggtccacttttcagagttcttgtgacaggaacgtgatagagaagagaacaaggaccatccacacaggccacagaaaggttctgaatgaccaccacgcacagcaaagcctccctatggcttctgctaactcaaccagtgtggacaaatcagccctcttctgggcactggccgtgcagccgatgcaccgagccacgctgcttgacgtccagacagatctgccgaaaatgccacttccttgtactaagtgcccttgggacaaaagtatcactcaatcccataagacatggcatgagtcctggggcccaacttcagctatgcgagagcatcttgttactaccgtgaaccaaccagtctaaactgtcagttcacctccaggtgagcactggctgtttctcctggggaacctcttcccccttggcctttgtctggctgactcctactcatccctcaaaacccaactcaaatggcacttcccccaggcagccttctttgaccacctctcccatgggttgggagccctcctctgtgctctgacagcccctgttctctctcttttgtgcaacatatgtgaaacagatttctaactaaaacacacagctagggatccctaggtgtttccggttgctgaaccagggctggattttggagaacagtctgctgacagagaggtggtcctctcctgggaggggaggtgagaggatgctcctgaggatgttctgtattttgtaataccctgaccaacgcggtatgtctctggatggaatactgtgtaggaaacacaggcaaagagcctacatgtttttttgtttttgtttttttgagacagagtcttgctctgtcgcccaggctggagttcagtggtgcaatcttagcacaccacaatctctgccacctgggttcaagcgattctccaccctcagcctcccaagtagctgggattacaggcacatgccaccatgcctggctaacttttgtatctttagtagagacggggttttgccctgttggccaggctggtcttgaacccctgacctcaagtgatccacctacctccacctcccaaagtgctgggattataggtgtgagccaccacacctggtctagtattttgtattttgtatatttttattgtggtaaaatatacataagaaaatcttaaccatttttaagcgtatagttcagtagtgttaagcgcgtccacactgctgtgcagtccatctccagaatgcttttcatcttgcaagagtgaagctctgtaccattaaacactaactccccactcccctcccctcccagcccctggcaaccaccattctactttctgtgtctatgaatttgactactctaggtacctcatgtaagtggaatcatatagtatttgtcctctttgtgactggcttatcccacttagcataatgtccttagggttcatccatgtttagcatgggtcagaatttccttcctttttaaggctgaataatactccattgcgtggctagagcacagtttatgtatccacgcatccatcagtgaattacttggtggcttccaccttttggtggttgtgaatactgctgctatgaaaatgggggtacagagtcaggtgcagtggctcgcacctataatcccagcactttaggaggctgaggcgggtggatcacctgaggtcaggagttcaagaccagcctggctaacaaggtgaaaccccatttctacaaaaaatacaaaaattagccaggtgtggtggtacgcacctgtagtcccagctactcgggaggctggggcaggagaatggcttgaacctgggaggcagaggttgcagtgagctgagatcgtaccactcactccagcctgggcaacagagcgagactacatctcagaaaaaaaaaaaaaagcaaacgggattgctggacctggcggtaattctttttaattctttgcacaatcagcatactgtttttccaacgctgctgtgccattttacattcccaccaacaatgcacaaacttccctaatttctccacatccttgcccatactatttgttttcctctttttgtttttggtttttatgtgtttgtttgataatagccatctaaggggtggagtctagaagcaattgaactcaaaagtcattgcacctttttacttgcatgcctcgatcgtcacggacgggatatatagaccccacctgtgacccggacatccaattcctctgcctcttgcttccctcgctcacccagctggccccgccccgctgcagccacgcctccctctcttctctcccacctgctccccattctgcgatgatgctgaaatccagacgcccgcagacccaggcggtggcagaactcctgggggccggtggagaaggaagcagctggccagccaggctcattctccgtgaggcggcacccaaggtactttgttcatctttccccatctcactcccactgcctgaacctttctgggagcctcctcttccctttagttgccgccagggtcacctgcaggccgcacaagtgtaaggcctttctcagttcaagtcagaggaatgttccgtgtccctagccctcgggtctgccttatctcagttcacaggcccaccctgcgatccgctcctcactctgtcttagaatcttctcacccttcccctcaccagctcccaagcgtagcaggggtgcttgtttaaaaagctcagattgactctggccctgcctcagtctctctctctctctctctctcttttttttttttttttttttgagatggagtttcactctgtcacccaggctggagcacagtggcatgatctcagctcactgcaacctccacctactgggttcaagcgattctcctgcctcagcctcctgagtagctgggattacagatgtgcaccaccacacacagctaatttttgtatttttagtagagacggggtttcatcatgttggccacgctggtctcaaactcctgaccttaagtgatcccgtcaacttggcctcccaaagtgctgggattacaggtgtgagccaccgtgcccggccatgcctcagaatcccaga

SEQ ID NO: 17652 - DNA, 122814 bp, Homo sapiens
  misc_feature (1)...(122814): n = A,T,C or G, or insertion/deletion polymorphism (see Tables 1-2)
ggaaggagttgatggaagagttcacattaatctccaacatcgtaagacttgtcaccttatcctgctccaaccaaggtagcaaagcctgcaaccctaaccaggcttggtagtgatgagaatattgggagttacagcagatgtaaatggtaccccacccatagcccctcgcctgtgtcgtttctgggcatgctagcccaagttctaattgcagcccctacctacatcttttagcttattgctttcagtggttccttgtcccttgtggaaataaaccagagcccagtctgcctgtgcacagggcagaaatgggagaggatacacacccactggagaagccctccaccagcaagtgtataaatacttcagctccctcacctctcagatgggatgcttctgaggtgcatgtctgttctgtactgttcctgagcatttctaatgggaataagcgccacttactcagtgcaacctgctagaaatgctcctttccccatcctccttcccttccctgcctcatttctcacttccctatagagggttgttgatctcacctcttaaataaactatttgcatttgaatccttgtcacagggtttgctgctgtgggaatccaaactaagatagttaccttgtgagatgatatgggagggaggaggcaagaaaagacagctgccacaagagagaagataaaacaaaaagtggccaaaggagttgtggaaatggggataggaaaggccattacacattctcaagttcttttgtgagggaagcctatagattggatattatattttaaatcatattattttaactttatgataactaagaaggagaatttttagcacattgttcttttctcttgttttctagtgactccatttgatactggtgcccagtagtcagagaccctagtacccttagagtattcaatttccctgagcttcttttcttattaggatgacaaccaatgcttttctttatcattctcctttttttcacatagtacaaatgttggatttatcacttacaatgaaccctgacaacatgttggggttttaaaataacatgttgttattttaccaactatattgcatacaccagtgatatagttgtatatagttgctaaatatatgtaccaacaacatgttataagaaaataagaaagatgattttgtcacgtgcaataaagttaatgcctgggattcagtgttaatagattatgtgcatgaaagagattttccagtaagggagatagatttactgaactattatccttccttcatccatttgtagtcaatgggatgttttttaaaatgatgtctagctgaaccagccaatggagacaaaaatatttatatataattttcctctaagttcactagtcattttatagatcagttataactttggctactccaatgagttaatttctttctagagacattataaactccttaaagatggaaaataattgttacttttttgaataatgcctactatctaaaacaatgcacataaaagctgctcaataaacttttgttgaattgagagaaaatataaaaaattgaaagcagtctgtttgtaataagtrtttgctaagtcttacagatcttctcttttttttggaattattgcaacaaatatttgacctttgatttgtaggattaaaatgtgatttctcatattttaataggagcaagcattagtcctgcaattctttttgtcaatagaataaaaatggaatgtatgcttgctgcttctacatgccggttgatacccatgctgaacacttttcttacaacgcagaggtttccttgttttctgtcttgcgttctacctttgctcaccacagagacattaatgatgccatgtgtctttttgcaccatcagtgcagcagctttcattatgctccttgtctcggtcccactgtagtctaattaaataaatggaaacgggtagtcactgaaaataaacagcaactgcaaaagttttgcctcttaagaaaccttctgcattgtattccgccctgcctcattgattctaagatctctaccgcttccttgtgttcagaaaccagactcttcagtttgtcttgcttcagtcagacaaatgctttataaaaatgacctatatttttcagactgtggggagagaagaaaaagactttgagaaagtgactaaggagggagtaagagtgatacaatctttgattcaatttagttggactgtgttctttatgccttcatctttttctttataaaaaagatagcgtttttgatgctctgctccaggcagcctcccagggtgagtgcagatgtgctgagccatttggctgccttgaggaccggctcagagagcctctcttctcactaatgaagtcatctcctctcggcagcccggcctctcccatcactccatgttggaacttggctttggcttgcatagttctgtcgtgatgtagatggtctttcagttaagttctagagaaatctgctcaaccatgaacaggacatttacagcacaggagaaaaaaaaatttattaaaacaaatattttactgtaacattttgatttgggggttggagagcaaaaactcaatatctgatgtctgggaaaaatctaatgttttatggctttctaaggaaatttgtctgtgtttaatttatcagagcaatttatatacttcgggttaaagcacaatgagattgccaccatcactttgccttttgcaagatttcttttttaagaataaaaagaaggcaataaagaccttatatttctgcctttcctagaaagccaaagagaattcaaagtgctggatgaaatgtctgtccctaatttgcagtgttttatttaaaaaaaaaattatgacacaatcttagaggataggcttcctttttccagggtctttgaaagttaaaagtacatttttaatctgtagcattactgtatcatccagtgaggataatttgcttagttgtgcctaggaccagtcagatcaaggagttgaaactaagctctttctgaatttgaatgggactggaatcttgtcatccctagagcagcaatagatgatgccatgtctaagaacacttcacctgatcaataaaaaaggagaagtctgaaatgtaatcctaaagaacctcagaaggaggtttagatgaagataataaaattccctggagacacatctgccatctacacctttcctctccaagtcattggcttgctgcccctgagctcagccaaattcccaaagacaagatcaaagcaaggaagcaaggcacatagcttctggcttatggtttcttttagacacaagcattgtgaatgaagatcttgctttatttatacctgggatcttggagttttcacaaagaatatccccagtacaaggatgtgatttaaagggggactcacagaataatattttaattactgtttgattcatacttgagtgtaatggacaaataaatacaattttagttataaaacctgaaaaatatatattttcccattcaaaaacttctgatagttttgtcaggcattggagaatcagaaataaatgctctctcattttctttctcttgatgaaggaaagtcattaaaaacagttacatagaaataataatacaactgtagactctattctaaatatagctggtatgttttcctttttcttttttatccattctccattttagacagctagaggggaaagtctgccctagagatagaaagaagatatccatggggtataatttcattttagttatctgatagcctgaagaagtatttaattttctgaataataatgttacaagtcaaagaagagaaaagacaggcagtttaaagcttttcaacattgtgcatattctaattccttaagtcagccctgagaaagtgcctttgtcctgtagaagtatttggtcaagtgttgtgaagtctattggcattaaaagaaactaaaaattttggaggattagagaatcaaatttggcaacataaatgaaaacatctcagaatgtaaaaagtatctaacccatcactttcaatcatgttccattatatacagatggcattatttatagtgaatgttaactattaacatttccctaaaaatgggcattaatctgctattagttgcttgtttctgatctagttctcctttgttgaaaggttttacttaactgtatcataaagggacaaaagggtaaaagataataagcttttcagactggcagatctgtcacttacaaaatggccttgggcaggttacttgaactctttgaaactcaactagatttactcaaatttaagaatgagaatacaaatccacatcttgaagtgtttcacagaaaggtctatcttaatgtctggagtatatatttcaatgaacattcattttattttatttctctccattcctgaatcaagcaatcttgaatctaaagttgctatgattagcactgaaaagaccactggactattaattgtgtgactttgggacagtaactttctgcaccttagtttgtttacatgttatacatgaaggttgaagtctgattctgctctgtgactatcattctaaacatctgatgaaatcaaatttcagtgtttggaatggtagtacaataaatttactaagaataaataattcactgcaaaaacacattgatttccaaatgatgtaactgacagttatattactgcagagggctgataaataacaaaagaaatgaaagatgcacatggtgagaactgaaattatcctgacaagtcttctacctgtttatcacttaaaatcaatgaccatgctgaatgcctacaaattacaaaatataaaagaaatcttataaatgcgcatgtacaggagtctaagttactaaaagttttaaagcataagtttaaaccaaactaatcaaagaagttgagaggaaaaattggctttcatctttaatcactactgttttgaggtcctatgtttaatataattttctaagtagaggcttcagagagaagagttgtgaggatwctttcatatttgtgtagaaggaaaagtttgccatccattctagtatccctagtgttatactgatgtgcaccttggatttattttgttcctattgtataaactcatacttgacttcaaagaaaaggaaaatccaaagtccctcttttctaaggggacagaaatcctttgtgtcaactgtttgacccttttctctgtaaggtcctattggaaatcttttgtaacacaatgcaggggactcttccatgtgttgatgctgtttacacagtggggtgggcctgactgaagaaaaaaaatcgcatatacgcatgaaagattatggtcttatttccggaaagcatgaaaggtgattgatacttccaagaagtccctgttactcaggaaaattatcaaatattctactcagagatacttggaaagactgaaggaaaggaagaacgaagaaagcagaatctagacttatgtggggagagatttgtggcagaggaaaagtattctctttgaatccgacaagggatttgcctgggggaatttcctgtccagccttttattaccagggtcttttgaagccgggctccccattgggcagttccctgggagtgcagtggggaattcttacactttccctctaggtccccgaaggatctcgttttctcagtgtctctttcaggttggcaggagccttgagcctgacacttccctttgatgggacaggcaagctctgtgggcgcgtaaacacgctgtaaccaagttctttgctgattttacagttttgtgtgctcccgagaagaagtgatcgtactcaattgtctattgctggcctgccccctaagagcctgggggctcctttcccctaacccagaactagctgcacggggggcggggaartgggggtggggaaggagtgggagggcagtggtttccgcgagcagagcgatgttactgagtgagtccgtgaatggggagcgctgctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggtaatcacgtttcttttgttccccccttaaaaaacaaaaacaaaaaacttatagaaaaaaacccgcgagcttagaaaaaagaagcaattggtagaaggctttaattaaggcaaagagctgtaaggcgaagttaagaaaatgtaggcacttaaaaaatgcaggtaactttcataarggcttttggggagaggcatacagagggaccttggtgttgaaaaagattcagacaaaagaaacccagggtggggtgggggtaaaatgactaacggaattgggggaagggagggaataaattgtaaagaaatcatagaaaagtggtgggttcttgagctggagagaaragagggacctttggcactttgatttttttkttgttgttgttcttaacacgctcgaggcaaaagtttgaatggggactaccaagacttgccacagacaagtccccgaagccgccttggtgcaggccacctggtttcccagcccctggtgtgtggtcagtgcctggtgttcctggaaagccactcccgggcagctcctgacagtgcgacccggcgcccaagcagcctgggaccttgcgcggacctgaccccttcagaccgcaggcagtctgggaggaggtccggccgggggaggtgcaggatccccgccgtgtctctttgacgacttggggactgtcacggttctctcccggcgcccctgggttcttttgtcctgcacgcggtgcgaaggggccagcagggaaggagcagaggatggggggtggggttgttggagccccgcggaggtctgggaggcccctgggcgggaaaagcctgttctgaatcggcagggatgtgcaacaatttttctcaccctgaagagtgaaatagggtctgtcgctcccatctcaacaagcaaaccggcacccagagcgcactgcagacaaaggtggctcggggacccgaatcaggggcctctgggtcagtcctctcgcccagactacaggagtcctccgtttccttacatattccccaccctctcctagttctccgctctagttgagcaactttactggcaggtctagcggcagcggcgcgcgcgtgtgccgggagccccgggggacgtcctcggctggagcgccccaccgtcctgcagaggcgtgggcgctgtagggcgacatccctggtgcgtgcagacctagggcatccgggttgttctggcccgcggtctgtgtcactgggcgtggagcggtctgggtgttaggcagaggagagcggggtagaaaaatagtgtcatagcctaaactatttgctctccaatccaactgcgtctcggcaagtcctgcatgtccctgggagatgctgcgggaagggggagaaatctacacggcgcctggagagttgtcctgccgcgcgcacacccgcggcagagtctctctgggtcgcgttcctcatctttgtgtctccctctgtctccatcttctctgcctcccttcccctctcccagcctctgttctctctctctagcttctgcgtcccctcccccacagctgacaaatgaatggctagtgtgaaatccctgcctttcccgtgctccaaggcagcagggagggaggagcgagggaggcggtgcgctccttcggatmtgcccccagttcagctcacaagacttgcagaacctagatgtctaggaattgggagttttgcggcgggtgtgggcgccccctgatggagaagtcccgcacaggcggagaaaaacaagccccccagaccaagcgwgcatctttcacaaccttgtgttcaaggatggaaggccctagttttcccttaagtcattcattttgcactccacaatctgcggcgtacatctaggagtttggaggaccctgaaaaaaggtcttggtctgtgcaaagtgcagagatgccttctcgcgagtcggctggaacgcacgcggcgccctgggtccagttcgccgcttagtggacgaacgcacatggccrgggtggagccaggtttcggaggtctagacgcgccaccctgggcgtctttaagaaagataatacacataccgtgctctcaaaacccatgaccacttgaacccaacgstagggccccgccccaggatattgcaaaagaagggctcctaatccaaaacttaaacttcctcaacttcagggcgggcgtcggacgggaaagtggagagaaggcgggcagtgggaggaaaaaagaaagggaaggaagggaagtggaaggaaagaggaccgtggaggggaggaaaaggagaaaggaacggagatggggcagatggcattcaaacagccaggaacggaccggaagggttcgtttcggggtttgggtctgaatttcgagactcgttttaggatactcttttccctttcccagcggcaacaaatgtgactgcagaggcgtgccgggatggaagggtgggaaagaactagacaagcggaggtggtccagccccgcccaaaggggctgggtctggggcccgcccccactcgctcacctcgcgccaagggaggacccgcaacgggcgctccccgcagcggctgggttagccagccgccacgtgggttggcgcttcggctcccagccgagacgggtgtgacttcctgggctcagagactgcagtacagccgcacaggcggccggcgcagccgaggcccccacccaccgaggccaatgggggcggggcggggaaggcagggcccakcttarccgagagagccgagtggcctcgcccccrggattcggggccggctgcttctggagctgacccgagttccatccagacagcgctgaacactcttattaaaaggctatttaagttttattttattttattttatttttgcttgcttcttgggagtggtaggaggggcatcgtgcttttgttttgaggcaggggagaggttaaaatttactccaagcaaactttttgtcagaaaaatgagactttataccgtattccatttgttgactttttaaatacattcaggtcactctaaagcccattcttagtcaattaacagattaatttcgttccagactgtcataaagagttcgcctggaatggcaaatastgccattcgacaagactaatagaatttcatgggggcaaacatggaagggctgcgagtgtaactgaggttcctgtgcctcaatgaggaaccttagcggggacctggcggggactggaagctcagcacctatttagggagtgactgagctggaaacctggagaagcttggtgcagacgagacggtgcttcttagagctgcattttaagtcctcccattttgctgcatattggaakaactggattttaaagatcttttccatcacctcagattctgtagctaacagccacgtctttttctttttgtctgctgaaagctgtgacctaattgttttaagcacttcttgacaatttcgccaaacccatcctgaaaatattcacataaagtcctaaaataggatgttgtgagtgtaatataaaaataggaaggtmccaatggaagcaacaattagtgttctgagatrgaagcggttcccagtttgtaacttggaaatgttaagagcagtacatcagggagaaggtctccaagagtctgacttcttgytctgagctctgagtaaagaaagaaatatgttagaattgtattgtctgcccgcagtaatattgtaaagggttccaatggattccaatgtgattgagcaattacttcctccagcaccaagtccacagtccttaatcttcttgtgagaagattaggtaggaagcgggatgagattcaagacaatcatttaggatttatgtcagaattcaaagttttgattcttttggtagataaaaacagagttggttttaaattgtatttcctgctttcaaaaaaacgaggtttgaaaggaatccccctagatttacataggtttacagatgtaagtttcttctttttccctgtgtttgcaaactggagggagatgcctttgatattccagaatacctgtatctatacacttgtaaattctgctaggaaaggacctaaacagctaaaccaaaggtgaccatgattaatgttaaagatactacccattgttctctcttttgttgtattattaggcttaaatactttggagttaatgattggtcacttaattgagtaacagagcctttgagagcgcaaagatcaactaactctgtctcccaaagtctggcaactaagccctcctttcctggtgagatttaaacatttttgttgacgtcattcatggacaaacatcggtaaacactgtatttaaaatgggatattgccctgtgatggagcagaacttctcaagacacatggttcttttgaaagaaagaattaatgactgtagtaaggtattttttcaccacccacgtagagaaaccagttaggactgacaaacactcattgtygggagttacttgctctggtctgagaaaatatgctgattgttacataggtctgtattttaccagaaaacacaaagcatgtactctccctgatttggaatcagaaaagggggattagatatggatgtcttggccaagctccatttcaattagtgawtttttgccagtttcctcttgtagcctagacttggtaaattacatatatataaagtctgtgtgtgtgtgkggggtgcgtgtgtgtgtgtatgtatacagggtttttaaacactgctaagttcttaccattgaatgtgttagaggtggttgtatttcagaggtcagtacaragaatctttgtttaatgtgtcagttctgtttcctgaaacacacctctgggtagatttaccaactataaaaggatacaaatgtatatactttccacatctgtatacatcctacctcattcttctaaggattttaagaggtgtttatgtctataaaatgagattacatattttacaataaacatatttgataaattataatctttttattattaaattattgatttgatattacttgaggtatagtggaatgagcactagacttggaatcagaaagtttgagttggactcactagctgagaaaaccaagcaaagatattacttttggacctttagtgtcataatctattaaatgaatatgcagttataaagatcaaaagagtaagtactttgaaaaactatacaaaaaagggatgataatatattatgtcttgggattcatattgatctaattctataattttaataataactgcattacccaagccatgtagtttctactgaatctataaaataaatcagagaggggcatattgttttaaaaattgtttagtttcattaatcagaagacagrttacagaaattgactccaatgaagttggacattcagtggaaaggaagaattattcaataaatggtttcaggacaattgatgggtccatgcaaaataagaatcagtctctacctgatttctcatcctaaaagaaatataagatgaatcaaatatgaaatgtagggaataactttttacaaaatgataaaagaaaatcatgggattaaaaaaaataagttaggaatagagaaacctgttctaagcaaaacataaaacccagtgccattctaggaaatactgataggtctgactaagtaaaaattacacaaragcaaataatatatttggaaaacatctacgacatttgagagacaaaaagctaataactcttgatattccatggacttttatgaataactttgaaaagtccacatctatcaaaatatgagcaaaaattatgtacaggtagtggcagaaagagacatagagttttaaaattatagaaaaaatcgctcagcctcatctgtaattaaataaatagtaattaaaacaccaatgatatgctacaccattttttcaccaatcagaggagtaacaaaaaaaaataatttttttctttttttttttttttgagatggagtctgttactcaggttggagtgcagtggcacgatctcagctcactgcaacctccgccttccaggttcaagcaattctcctgtgtcagcctccctagtagctgggattatgggcacccaccaccatgcttggctaattttcgtgtttttagtagagtggggtttcaccatgttggccatggcagttgatcttgaactcctgacctcaagtgattcacccacctcagcctcccaaagtgctgggattacaggcatgagccactgtgcctggcaaaaatraaattaaaaagtttgatgcaagtttgtgttggccaggttgtggagaaactgggtctctcatatactgttgtatgaaagtaaataggttcctctacttcaaaaaataatttggcaatcacttttttttgattctttatcaaaagtttttaaaagatgtatatactctttgattcagcaattccacttctcgacattattatatggatggatattggtaccaatatcacccaagacaaatggacaaggatgttctttgcagcattgcttctaagagcaaatatctggaaacagtgtaaaggctcatcatagggaaccatttaaataaaagttgctgtatccacctaatggaaaactatgcagctgtcaaaaataacatggaaaaattgtatttgctgatttggaacattctccaaaatatattgtattctaagtgaaaaaattgatagataaaactgagtatatattatacatctaattatgtaaaatgggtgtatattcattcttttaacaaatatttactgagtgttctaggcattgtggatacaggagtgaacaaaacatcaaagactgctctgttggaacttttactatggtaggtagagaaaggcaattcccaatcacatatgcaaaatggtgatatgtgctaggatgaaaatagagcatgggaaagggaatagagtacagtatgtcttaggtagagtaatgagaaaggagttcaccaggcagagaacagaggagtgctaaggggcgacaatgtgaaaaagcttagccaagtccaggttcaggaattcacatgatgctattacttgtatgaagtaaattcatgaaatttcrcacctaaatcacgtgatttctctctgctgtacaatgattctttctgtgagaaagaaccagtgagcaatatgatatgtgatgctcattacatccactttgtagctgaagtatcctagaaagttggttgtctagggtacctaattagcagaatggtggacaaaaccaccgtgtctctgtccttaagtcaccccttgtcagctgagcttccccaaaatcaagggagaatactaaatatctatttaatagaatcttggctttctctcggaggctgcccatccctggtgtgtcccttatcctccctgcagacatttctcatggataggagttccattgaccttgtcttttatgtctcccaggcaattaaacagtctcagtaccctgtacctggattgttcaatgactttcttcccttctcattgacttcactggagtagaaggctaaatataggcattcactctcatatctctcaggtctttccatgcagacagagttgttatcactagtagacggtgcttataagagagacatggaaaagtggaagaatggaaatagggatttggagtggtgctaaaaacaaagaaagaggcttctgaaagctttccatttaatatgatcaaacatagaagacaaaagatgtaacttaatgaccaaggatagggacatagccttgagaaaattacagaagtggaatgaacgtcttggactccaaagaagagggaatggaaatgyagttctgaggcagctaaagtcaataaagccctctgatatatttactgtagaaataaatgatcatcttttaattcaaggtttgcaaacttaggtgactacaggggcgaggcatggagtggaaatgggtaagagactaagtgggggcagtaatggccttgagcacacagacttaaggggagagactgctgcttggttaatgctcatgatcagccagctgaaatatagacttagtgttgctagaccttctgattttttgaaagaagttagagatyttatatttagtgtaaacagtctaatttttaaattgagtaacttattcaaacatatttatgcaacttattcaaatgtatttagagcatgtctgatctcctccttgtattcttacctagtcttaggggtaatcttaaggaaagtgatgcgtatacttgttgtacctatgtagatggaggaccattctcctctccccaacaaaagacacttttataaggattgagtgtggcacaaagagttcgatttttagtatttaaattgagtaggaaactcaaatacagaagatcctttcctgggtcacacctttggtttttttwaatgagatttgactctctagatattgacaaacatcatattattgggtcatggtaaatcttcaagtggactgattcaaaagtgttcaaaagtatttcaggtgttaaggaattgttggcacggagtttcaaaggtgtttctgcataagaaatagaggcgttgatcatgtatttgatctacaaacattcctcaaggatataccctgaacctggcaatgaagaaatattgtgggaattattaagttgaataaagtactagctctgccttccagaagcctactgttctacagaggagattagacatgtttacagataatttgaagtacatagcaataaattataggatgatttattccaagcataaagtgtatattgctactatagtggtaacctaggttataattttcaaatgtaagagccccaaatactattctttttactcttagtgatatgaaactatgttagaacatctgcagaaagtctgaattagtaattttaataataaatattgagtactgatatattgtatatcactgagatttattttatatacattattttatcaattcctatgatcacttcggtaagtactaattttcacaactaagtagtgacagaaaatgaggtttagagagatatagtattttacccaaagtcacagaatataagtagagaatgcagaacttgcattctgggctatttgacagtggagcccagacttttaaaattaggcttataaagatttcctggaaaaaaagaaaaataaaaaatagagaacaaattttcctgaagaaaagtaggaaattattatttataagtataattaaagagagatctttaatttcttttttttttttttttttgagacggagtctcgctctgtcgcccaggcgcaatctcagctcactgcaacctccacctcccgggttcatgccataaagaaaggtttcttatttggattcagctaatactcatggaatgcattttctttaacacctttttatcataaaatacaatcttttactttggctgtgcaattgatacctttatttttccttaaaatattgtaatagcatagatatatggtatatacttcctgcttgctgtgctgtcttataagaaatccagaaacatagaaacattatggcatttcccagttagtgtttaacaaagtctattagcagatcctagtgattataggataaataacaaacttaattatcagggttaatttaggattatcaaccatatgtttttcattgtgaattatcagttggtctatagatggaaaatataagatrtataatgtattagcttaaaaaatgctcttcagagagtgtctagaattatagaatttaaaaattttgttttgaaaaggtctaattcttatttcaaaatatataaagaaatcaaatgcaaaaaaattaagagaaaaggtcttaattaattaaatgctgtacaactccaagccctatttatgttcaagatcagttttgtaatttatgactaatttcagcattagcttgttttcaatctaggtttgctaaataatatagaatttcttttccaatgaagtttttcagggtcccagctgaaaaatatataccagttaggatgctttcaactgtaaggaacaaaaagtcacgattttattgggtttaaacaataatgacatttataatctcatataaaatgaagttcaaaggcatggtccactctaggtctaatccttaaggacttacgccttgcctttgctgattctttctcagcttcatttccagaggtatctcacttactcatggatgcaaaatccctacaacagttccagcagaaagattccagcatgataatgtccagggaagaaaactgaccacctcttcctttgttctcttctcaggatgaatctatctttcccagggacccttcactggaggaagagatcccctcacatctcactggccaaaactatattatatactgttccaaatccaatcattggaaaagggaatggtacctctataattgacttaggatatcargatcatcccttgggctggggtttgacccaggattctccaaagtatgtgactgagggtaggcactagaatggaaccagagttgtgttagaaaggagaaacgcatggctattatagaatagttctaaatgctaccgaggagggcacaactgtaaaaaccaaataatcttttgccattcttttgaagttggcactttgatttctagatggttccccaacacaggttcttctcctcctcatcattatagctgccttgaaatttgagctggaagggaacattctgagacccagattgttaaatgtcttttccaaagtcatgcaataaattaaatggcaaagccagggcagtttcttgactcagtacagggtattttctttcattctttactcttgagackttagaactgttggtactgctttaaaattcatggcaagaactggtcacttttgtaattaacacctccttataatacatttgttttgtttgcttagccagctagaaactacatggagtctgtgctttaaaaagcctgccgaagtccttattctctgttttggtattatgtgcatgaaccaccaattggttccttctcaccttacacttgatgaagatgyctttctttcaacatctttctctattgctccccatcttctcttgctctatttatgatcagctgtctgtttctaaatagactttgtggtcacccatttctttttgtgccagctcctatccactagttacttgaactgtggtctctrttgttcttcatacagcctactcacttgtggttgtcacacacatccacattgttatatgttcccaaactgtattctggaatgattttggtaatggctgcattggatgagattcaaactaataattaaagcattgagatagcttctgctattacaagtttactcctgtttttatagtccaagaggagctacttcttctaytcttattacttaatgcttaatactacccttattacatacaatgcacaaaaagcatgtgatttatgacccactttaaacctgaatgcttgtgatttactttgtgtttttcttcatttctaggccaagatgttcataaatataaagagcatcttatggatgtgttcaaccttaatagtaacccatgcgctacataaaggtgagtgtgctaacaatttctttggtgttaattgaaataaaaatgtaagtgctggaggatgaaatggcaatgtggaatcactggaataaaagattgatttttaaaatctattaagtgctgaaaactatcagttaaaatattattggaccaaaaacattagttttaaataaataagtcaaaacaaaataataagtaggatgctaaagatgcaagtgagcttttagtaacttccctgattactttcaggctttgcaaaaaagctcatatatggtattgggcatattttaaaattctaacactatttctcaaaaactttcctatgcaaaaaaagaaacactattaaacacccagtgggctagaatttgaaaagaattgagaagataaagagaaagctgacagccatgtttttgcccttagttccttttcttttcttttttaaaaaagcagttggatatgcatatgccctagttttttaatttgaaattttatattcttccaatgagggctctataattccaaatttattatttaatatattcaaggaatttgaagaaagatgctatccaagagtttcactcatctgcttctgtctgtctagtgtacctctccagactcagattccatttcttcctcacacttatattatgcatcagactcaccttttatgattttccagatgaattccttttgctaaagtttaagtcatccatctattcattacccctccatccatccatcatctatctattcatccatccatacctccagccatccattcatctgtccaaaatctttccatctgtttgcttatcaacatctatccgtgtattcatccatccatccatccttccatctgtccaaaatctttccatctgtttgcttatcaacatctatccatgtattcatccatccatccatccttccatccatccatccatccatccatccatccatccatccatccattcatccatccatttttcccactcacccattcatctgttcacccattgatgatattttttgaataccttctttgtgccagatattattctgggtgtctgggaatatacccatggatgactcataactggcctatcgttctttaaacttacttctctagttatgggagaccagcaataaacaagtaaacaaacaatccaggtactttcaaattgatgaacataaaacagagtgacatcatagagagtggcttgagttgggggaagttgataagacctccttgagaaagtgaaatttaaagtgagatgagaatgataatgaggaaccagccagccaagacctgtctgtaagttaggaagaaacatcgtgtgtttgaatagcagaaaggtcactatagttggagagcagtgatcaaggggaaagtaggagacatgaacagagagattagcagaaaccagctcatctaaataataataacacccaaaacttgaatagaactccctatgatccaggaactgttttaagtgcttaacactaactcactgaaacatccattacccctgtattctattgaggaaactgtggtaccaagagaggmtaagcagcttgctcgaacgcccatacccagtaagaagcaaagcttggagatgaaccaattcataggagtgtgtgctctttaccaccatgttatacttcttatctacatggaacactgtaggctttaaaaagtctagaatttttactcaggaggctgagacaggagaattgtttgaacccgggaggtggaggttgtggtgagccgggattgcatcattgcactctagcctgggcaacaagagctaaactccatgtcaaaaaaaaaaaaaaaagtctagattttattccaagtgcagtaggaagtattgaagggtttcagcgaagaaagatatgagttgatgaatgttttgaaaattcagtttttgataatctatgcagatttgattgtaggaaagcaagggtagcagcagagatatcatttaggaggttattgtagtagcctgtgcatgaaatggggtggggagtagtttagatcaggtagcagtrgagatgaagagaagtgaattggatatgtggagatggaggagtcagtccatccactgatggattggatggggtgtgtagtgaggacatgagaggagtcaagaataaattgactcctgggatggctctctttccccttttcacctccagattcccctttctaaccaatttaaaagctcctccttgggtgggtgcagtggatcatgcctgtaatcccaggactttgggaggccaaggtcggaggagtgattgagcccagtagttcaagaccagtctgggcaacacagtgagaccctatctctacaaacattttaaaaaattagccgggggtggtggcttgggcctgtagtagcttgggcctgtagtagcccagtagctggaactccacctactgggagggctgaggcaggagaattgttgatcacagggggtcgaggctgcagtgagtcatgatcgcaccactgcactccagcctggatgtcaaagtgagatcctatctcaataactagtaaataaataaataaataaattcctcctccatgttccccttgtcccctgtgctgttgcagatataataacatcgtccatgctcttgggataagttattgtttttcttcccaagtaggctactataagctgcaaaaaggcctttcatcttctagcaaagtgcctgacacactgacagcacttagtcattttgtgtgttgactaaatgagtgaataaataaataaatgccacagtggaccacctggatagtttttagagtctaggttccaccaattggatcatgaagacatgctaatcagatggtgaagcctaggagctgtcttcctcaaagtttttgggaggtgaaggtgaaggtcacagagaggaaaggacaacagcaaccagtgaagatggagaaagggatatgaaaaggggagtggtatttggatgggctgtattggaagggaatttacagggaaagtagtaggcgaccatccttcagctgaaatttagactttccacttaaagaaagaactcatgcaatgaaaaacaacttgtgttgtacctcctttacagtatttacaacaataaytttgatagccaacaacattgagtaatttctgcatgtctttacctattctttgtaaatccatgatcactattattagatgtaattagtttggggctaatttcaggagaatttttttatatcagaggtgaaagttacaaatatacgatccacataaaacagattttctggatttatagtggaaaacacagtagtaacttgttgagtcaagacaagtactttcatcttaaggtttttttctgtttattcccagtcactgatgaggtcaacgactaacataaatgaacaccttgtctattgttatgggctttattttaacccaagaagaactatttcctttaacaatacacattatattatcttayaaactgtcctaatcgttgattatctaccattggcctagttattttgatgttccccttatagtaggaaaaggagtcatgcacagtcgtgaataagtgaatgaactagakagtgatatttgtcacttgaaagagtgataaattcccatattctcaatttgacatttatttggccaaggtctgtgtgtgtgtgtttgctcaaattgtgcagatggaatttacatcatctttactctaaggaatctgctgacagagaatgaggggtaattggttattcattatttagtgatttctccctcactgtactcatttggaccacaaaccatctggtaacagccaatgttttgttaggattcatttttattacttgaattgtcagcatttcagacaaattcctgtaggtagcagatttcttttaaacatgcatactctgtaaacattatactctgaactactgaatttctttcttaaaatatttagatttagtgaatttcgtttttgtgacccagtgcattaagaccgaagatttaatacacaaaagatttgaccacacagctttttgttaatcttgttaagtttgtattcacatcaatatattatttatatccaaccaaagcttttaattttcttatatatataaacatctagaacagtaaacaacccttgggaaattgctttttaaagttatttttttccaacataccttttctttacagcacagctgtttagcaatgctctatgtttcagaaacctccctattggatagattgggttgaatctcatgtctgtccctatatacttcaaattgtgaagagaaatataatttgtaagaaatattgaagaattggaagacatatattttaaactaattttaaaagacatgataaagagtttcaaaattcataccagaattaaagttgatgataaagctgtttatttttgcatttgaaaatagtactttatttgtggcaaagttagtcatctaaataattcttcaggaaggaagatgagattttctrgaacatatgatgaatataaatttggagatttttagagcacaaaattctcaccctttctcttctcagaacaatatctttgtgttatcatcatctccctaattaggtccaaattaaaggaatgtgaaataggtagaaggtactttcagagagtcctctgtgaaccttacggatttattaaaaagatcatgaaattactaaaatatttcagttcagatagtaattaaatacttatagaaataggatgcatctagactttgaaaaggaactgaaaagaacacttcttttacttcatttaggggcagaggaagcacaccagagctaaaagattccttgattaggtgtcaggagacatgtgttctgactcaggtctctcaccagccatctgggagcttatccttcctctcagtggaggatcctttgtaaggaattcgaccagttttactttaaggttgagctaagttagagaatttactttgtaagccaaggaggccattaaaagtggaattattcccttgcaattttattccaaaatgataatagtcttagcaatatttcaaaggataatttagtatagctaatagcacacttcactttgtttttatttaatttcattmagtgccttaagtctgctttggataagctacatgtagattaataaaataataaacaaatgcataacagcaatggttattatacatttgaaataaattagtgatttatattgtaagtacattaaatatgatactatattaattattttggatttatttgcatcacatgaaatgttttataggccaatctctttttaggttaaaattttaatctttagcaagacagtatttttttcttaaaggatatatctccatagtatcttcttgcaattttcaaaatgcttttctccaactgtgtttacattgagaatccacagtgtttacattgagagtgatatcatttccaatgcatgcccatgttgagatgtgtgtttccaatatgtttgaccactagcagagtgttagatatacatcattttgttggttaaaaaatcattatttcatttcacctagaggctactattaacttgttgaccatattttcatgaagtaagcattgtttgtgcattatcaacaacttccattattactaacatattgtctagcctaattaatagaggctggaagatagagaggagagtgggagagaaagggatggattcctctaagagtgaaaaaacatttattttgcaggtaatggtgttaaactgtagtcaatatattctttatcattaaaagtttaaaagtttaaacagaaggacattctgcagataaatattttaggacggttaggtgaacagaaaccaacctttccccattatataattgaaggtaatgtctcactgcaaagtgatggtagctggatttgttataattatgaaagcctttggttccaacacaggaccaaagtgcatccttcaaatgttaggctttccctggttccagtcctatgaagcacttttttattttcacttcatctttgaattttgttttcatttcctctaaggtaatgtggcagttattgtaacaaacattttttgtctttcgacctgtagacataattttcatctttcagctgctcttcctaatgttggtccagtcctttaaacctgccctacggattctagtctgcccttctttgcccttaattgcttgacctcttatgcttgcctttttttttttatcacttattttgttcatgttaaacactaagttaaaaaattttaaaatgaatgatgccacatttctatataaagaaatgagcattattaatccctgttkttgtaaaacatcattgaaattgtatgctattctctttatataaagtcattctaattatgtcacatgttgaagatgtaaccaaactattataaaggctgcttatccattcacatattgaatagattaagtttgggttttttaagattgttaatttgttattttctctttcctctagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcacygtggtcaagctgctggcaagtgatgcgggtctttaccgctgtgaygtcatgtacgggattgaagacacacaagacacrgtgtcactgactgtggatggtaaggcttttattatctgcaagaaggtagtataacatgacacctggttcagaagcattgagaaatagcactcagaagtaactgttgtttggggtttggatgagcggaaaaacacctgtcaatccagtagtccacgtctttcaccaaaaatgaactggtactcattcaaaagtcaaggcaggtgcatttttggcagccacttcattgattccatgaaggaaagtattgtatactgaaaataacgaatacctcaaggcrtgacacataatttaataatcattacttcagtgttgagtcttatcagtgattctttttcaagactctgaaggcgaatctacattttaaaaattattacatatgtgtgtatgcacatgtacatacatatacacacatatatacacatatacacatgaaaaacctttcccccttttttctctcttaatatgattattaaaatatttgagtttgcttttaggaaattctatcttaacttataccgaagaaataaggtatttaataaaaaccatggtacatatcagagtcttaaaaaggccaagacttaataaatatttgaattcgatcaaacagaaatttagtatattttttaagattaatatcctagttgttatccgttaagtattgcagtgagacattttagtttcaccctcttttcaggggtggtttatatgtcatttgaatttaagttaggagacaaagcaaagaaaaattgctttaattgggtacacacataatgccatagcccttggaagcgtaatattttggcaagttattaagcaaaattctaatacccagacatgatggaacagattttcttccaatcctccatttccctataaaatatttacctttcagaaatatatacaaagggttttattaaaagtctttcttgtgtagccaaaaggaaatactttgaatttcagatgcaacacattaactttctgatacccttttatattcaaattccattgcttccttctataaatctatttttatgttgtctaggcatccactaagtatcctgggttcttctaacctttttatcattatttttgttagcctcactactgtgatttctctctctctctctctcttctgtttacgtatcactttttaaaatccccaaaggagtttaacaacttcttaccatttttcatcattaaagaattagcaatggatttgccccttgcccctctgaaacaatgaaaatcctccacttaatctccttagctccatggggtcttcaaattattccagcaactgcagatacttatacagattgaagttccctgccttggtcgaggaggcctctttgtgcccctttactgccaatcttcagtgcacatggaagatttttaattaccaagaagactatttgaagctttgatcaacattaaactaatctaaatctattcaaattcttgcttaagccttagagatcattttaagctatctcttatattcaccagatagcaccatatatattttctggcaattttagagaggttctataaaggtacaaattggcgtttgatttttttttttggcaaaatctcctatttgagtcataaaatatcagaaatgagaaaatgaatgccagttgtcattgcatctacttagtgcccgtgcaggtctttttgcrttggcactgatctgaggcacttatctatgagatgggtagtcttttcccctgtagtcatattactacagtaatataactctggaagacagagatgatctaaggatgaacacatgggagacagtcttataactagaagtcaggctgcagaagataaactgttgtccatcccaggaaattactagggataagaagagtggcacgtatcttggaaaccacagtttatcccaaataacaacaacaacaaagtgttcttaaatgggatgactcttaataaaatctcattcataagacccagttgcctcaatttctatttttcagtgacttctctggcatattagttcaatccactttgatgtcttgcagaaatgagtcatcatatttaccccagctaaaaatggagagactcttgttgacatggcaagagaggatccagagctccacccccttgcttgctctatccttatccctttgaaaatttcttgagccctggagcacagttcaaaaccactagtttataccacccctaaaatacaacaaagtggaatttgaggcaagtatcaggagcttctactaggaagaatttgagaatttatttcaggctttctttggataaaaattatacatgttatctgtcatagcagagaccctacgttatgctggtcaggtaaagaatatgataaacatttgaatggtacatggtggtctactcaacattttaaaatcctttacctaatttgaccttcacaccaatcaagtaacatacatatttttagttccaccttatgggacaggaaattaaagctcagagaaactgacttgtataaaagtaaggagtaaattagggattggaacaagtcttctcactcataaatagtccagtgtcttttccactctagtacattgtctctgaaggtaaatatctcattgttttacatttggaggaagtggtgttagtgaatatttttatgagacaggtgagtgtttcatgcataaatattgggttgaccccggataaagtcctgaagtagaagttgatcttgtggtccccttaggtctttgtatcttctgcagaatctactccctttaggtatctggtgttcccatgattgcgtgaatactgcctgcaatcaggacaactattgggattcagtgacttaaatctcttccttgatctaggagatcccctaggaaattttctggtggagcagaatgggatgtctagatgaatggcatttttggagcccctcaaatcaacatgattttgcataatgctgcatgaagtaaaagtaaataattattatgatattattactatgtatccaactaagttgatacattgctccaatgagaaattttgcacagtgcartgggagatttgaacaggctggcaattgtttgctgttgtttttgcaggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcaggtaagaggtctgggggccacaggcttcattattaacttgagagtgagaagaaagtgccactaactagccatttatttccccagatatcccatccgggctcccagagtrggctgttatggagataagatgggaaaggcaggagtcaggacttatggattccgttctccccaggaaacttacgatgtgtattgttatgtggatcatctggatggtaagatgtttgagtttctatatcttcgtatgaactgagaaaactgagggaagaccagaagttcattggaatagagcaagtcttcgtgcttgtttggattccaaacggtggcattttgtttatacgactgtatgattttgtggtaaaataagccgaaattaaagtggaaaggcaaggaggagtgtgtaaatggttatgcaggttagaaatgtcttcagttaatggcaggttttcttacagtcatgctgctcttggactgtttccaatacacttttagatcattgagaatagaaagctgtaagggtggtacctattctggtgagagcataagataaaaatcatgtgatgacaatccactgtgaatccaagtactgataaacaccccagagctaactaaataactccataaactagcccagcaggaattttcaagtttgacttcctgtttattttgttacactaatattcagagcaatccttccttcattcaaccagtcaatacgttaaaccagttaacacattaaaaatcacctactgtgatttttgtaggtactctgctggttgttagagatatgaaatcagttaagatatagcccttcctttcaagtcgcttacagtctgatttcagcactgtcatttctcctttgcctgagttagagattcttaaagacaaatttgagttcaatagtaccgacattatctaaagagcatggtgcagctttattataaaggcacagggaggtgggcacagtggctcacgcctgtagtcccagcactttgggagagctaggtgggaagatagcttcagttcaggagtttgagaccagcctgggtaacgtggtgaaaccatgtctctacataatgccaaaacttagctaggtgttgtggcatatgcctgtagtcacagttacttaggaagtgagagaagtgtgggggtggggggtcctgaggtgggaggattacatgagccagggtgtggaggctgtagcgagctgaggagattgcgccacagcactccagcctaggtgrcagagtgagatcttgtctcaacaaatacataaatataagtaaaataaaggcacatggaatagaagtttctacaacttttgaaatggattttcatttgtattaacagctattattagaatcctaaagtatagataatagtgttaaattaaattatacttttaattttgagtaggtgcatataaaaagaatgatctgaattttcttatgtttaaaatgaggaggctggactagataatttctatggtctctttcaacattaaaattctgtgattccctgattctgtgaattgaataagcaatcttagagcccgaaagctagaatataagcagcttatattttcctaatgccttgactaaatttgcatcggaaggcctgctttcaaaaagggtgcttaggtgtggttctctagtatcttagcattcttattttcactatcactgaagattgccagatgtattttctaaaccaaaagtgcagatgtgagcaaattttatttttgtatataggaaaagggaaaacataacatccaagctatggttgaaatacataaaactagagcttttctcttgcctttattttaattgatttaaaaaatagaagaggagatggttggtaggagaatctgattaaataaactaggaaataaattggattattgctattttggtaaggtgggaatttgtatcactattgttttaatttagtgtaatatctacaagggtgatagttataaacaatatctgaaatgctagtaatactagaaatgatccagaggtagcttttgcaaaagtatatgtaagatctaattaacctaaaagatctttaccaaatattatttaaatggtgggctttcgtgattcaaatatgaataagcatcccaagccagattccttggtggaaagacaggcttatgtacccatgaagccaccagccagagagccctagagaccccccgtgtgtttgtttttgagtttactctgatagagctactatcagctcttagctctctaaggctctagactgcccaaattcaaaattattttttcaagcccagggagggattttatagaagtcccagaaatttcagggcctctgcaagtactgtttgaagaatttttgacaagtcttagtggtgggagtccttccagggatttcctagccacactgtcttcattgaacgatggctccccacagtctgctcatagtatcataaccagtgttcaggaactggactctgtcagaagaggagctctgaggatgtatgcatatctcccatgacgagggatttactagtcttatagacgtcctctcccacttccataaacacaatcacttctaaagaagccagtttgtgtcccaatgtaacccaactgtattttataaagttattttggataaatctacatacttggtgactgaaaacttgtaatgtggaatatagcataactttacttaggctctttataccaaatcaacagaattttcatctttttgttttaatatgtaaaaattggaagagaaatataaaagagtcagttcaaatattaattcaagcactggctgaaatcwgtgtcagcaaagtaacaaggcatttatttgtttcatagaagaaacttgacaattctggaggatattcagcatgtttacaataacactgttcctgacatttttttcctccttgtttattggctcttggactaagtatcaaatctttggacactgttcttttctttcttggcwtgaaagtgagcaggaatgggggtgaaaggtaacttttatggctgatgaggtaagaggaagatcacaaaatcattcttgtaaggcttctctcatttcttaactgamgtatatgtcttcccttttgaagtacagaccatggctaatgagtgaattaataaaaaattcttgtggaaagttgactacataaaattacgtctggtatttcaattgtcacgttgataaaagattatttgaaggtgagtcaagattccttgtaagaggcattgctaaattcatgagtcaaataattcccacctatattttattatatttgggggagtcaagtgtgtgtgtatgagaaatggtggggacagtaaaagatttggtatattcagaatgcatgtgatggaacacacacataggagttatgaaccaaggtgcaattaatttagatcagaagccatatattccagatggtctgatgaaaaagccaattaagtataaaatgaaaacttgctcaaaaaggcaattaattttccgttttaatttaattatttattgtgaaagatatatagttgacagtatgttgacctgtttttttctcctttcttgttttataatgtcatatcttcctgacatatgtgtttctctataaaatttgaataattgcactaaattaaatcctgctagttttgggagaaaaatctagtagggttctttttctaaggtggtgattataacagttatgcatattcaatgaatattcaattctgcttttcaaaataacctattaagttttaaagagtaattacattagctatattcactagtaaacatttcaatatcagctcgtgttcttagaaatggtctggaaattatgatggcttattagagatgattcaatcagtaatagaatgctattattaagaaattaatggaattaaaattttaaaatgggaatctagaaattaagatccacaaaataatccttattaggaattttaatctttgtttcccagtaagacagatttggaaaacattgggagggttttaaggtagagttgagatgattaaatggctcaagaaattaggtaaaggatyggaattatttaagaacgaaattaatagactgactatttatttggtttcctgatggtagcagatactttaaaaaataagtttcttttttaggcatttaatttatcctgcagataaattggaggattgcagatgaggtcctattaccttctttcattgttgacccacttagtttccttgcaaatgagtcaatacttccagtcttgtccccagacctgacaaatggttggttcaggagcttctctcccctgtgacataggcctatcctcttatggcctgcattttctatgtagccctgccttttggtatttacttcacctgggttaactactaccctactattccaattctctgtttttttacacaagcttccagcactttgacaggcctatactgtgggcactctctttcatctcatattccctcctgaagacctagktgattcttctcatctttaccatctctgaaccttgaatgtatgactataattaccctcttgcaaatatttgcttatacttctttctctcctactaaactatggattgggggaaagaaggaaacatacaaattcatttttgtatgcccaatatgtccttagcatatagtaggtgctccataggtagagctgaataaatgagtgaattaatgaattaacttctaaaccattaatgccwccctactcaccttgatttacaattgctttctggatagtttcacacttctccaggatccatcagtatactatctgcttcctgatttttttattgctttaattttcttattagtttgtttaatttcatttttgttctcttgtacataacttgtaagccaaaagtcttgtgggacatatggggcatgaaagaataccaaaagaacaaatacgtgaacaatgaagatgttaatttctagttttgcatgtttagctcctgaattcttttctgaatttcatacccatatttctagtttgtgaatcacttttgagtttcatttttggttttggttgtcacaaatagtccccatcactttaagagtccttcaggggatctgttttactaccatcaaaacagttaaacaccattgccatgtaattctcctacttaacgttgtgtgttggttttgttggcttcttccacaagcacatactctgcctggtcttcaaaacctatacctgctctactgcaatctattcacccttcattcccacactcttcaatgtgaccccacacacgtgcatctcgccctgcacagaccctttgcttgctcctgcttgcaagtctgctctgttcctctcagggaacacacacccttcatctcttcaacattgtgattttgcctgtgcttgaagacttactgcttccaggatcccccttttggctattgcagctcacactgaaatttcttgactctgaacttctactttacttagagttagttccatgtgatttattgcttaattgttttctggtttctttgtgttcataaaatataaaatgttatatgtttgttttatttcagcaaaattattgtaagctcctagtagagataagaccataaacttctatatgtttcccaactgcaatcaagagcctgttccaattgcagacacgtaatagttatccaataaatagttggtggtaattatagtatttttccaacctttgtctcttctggaaactgccttccaccaccacctttccatttatctataacacttgaaaaaatgctttgctttatttaccaaattcaaaaagatctactttttaccattatttaatcaccatgatactattttttcctctttgtatttctcctctcactcttttctcctctcactcttttctttgatgtctcttagaaattactccttcccagagatactcctttctggcctctcatggtaaattattttccttgccttccactccttcccagcaaattgtcctctctgggattgcttttcttgtattaatacctattcatcaattataggttattatttttactgtttcttggtgtcagagtccaggatggctttgtcacctctgtgacttatctaatgcctccatatcattcttgtgcctcacctagaaccaaaaacaacttttccatttttgttactttatgagctcctttagatatgaaaatctaaacatttagataaacatcatcaagtaggtcttagagcagggttagttctagctttttaaaggttttggttggaccaaaatcagatatcgcatctggagattgtgtaatttctttcctatagattctcagattgcctattaattttaatgagatttacagtatgtaatctacagaatacttcactgatgaaggttatttaagaattagtgatttgcgtccttactgggcttattcagttaaaaagccacatatcagcttgaagagcctcttgcacactatgattccgccgatggttaaagtagtgattcttgatttcagaatctcttcacatttgttgcagttggccctagaagatgctaaaaactttttaattatccgtagcttcctatatagactttggagattaacacaccttgcttggagttgcttctgtgtacagtgtttgaacagtctacctaagagccaatgaggaaagcaatcaggcacagcatggtgggagcacctctggaagatgatgtccttatacagtgtagtgactccagtaagattgagtgtgaggtagtttcatgagtagaatgaggaaggaaaacatctactgtgtggtgggagtattatttaacttaaatcttatgaaacctttgtcaggcactttttaaaagaaacctcacttttgcctataagaaaactgaggcacagacaggttaagtgattagatatgccttttttcttcttctactgccataaactcacagggccactaaagattccccagtagagcagcaggcagtcttgcaagccaagaagataaaaagtaccctcaaagctccctcaaatctctgatatctcattagaaaaaatcataattcttatttgagcaatgattgcattacagattggattacaatgattgggattgctgggtcaaatggtaactactttgaactttttgaggaaatgctaggctgtttttcaatgtggctgtaccattttacattctcatcagcagtgtattagggtcctgattcctccacagtcttgtcaacacttgctattatctgaccttttgtgtagccatcttaatgagtgtaaagtagtatctctgtggttttgaattgcatttctctgatggctaatgagctccaacatctttttatgtgcttgctagttatttatcaatcttcttggtagaactgtctactctgaaactttgcccacttataattgtgttgtctttactattaaattttgagtgctctttgtatattctagatttgcatgtcttctcatgtaaatgatttacaaatagtttctcccattcagtgagttgtctttttactttcttgataaggccctttgaagcacaaaagtgtttaatttagatgaaaagtccaatttgtctatttttaaaatttttgtgcttttggtgtcatatctaagaaaacattgccaaatccccagtcatgaagatttatctctgtgttttagtctaagagatttataagttttaactcttttgcttttattttgatccatttggagttagcttttgtatatggtgtgaggttggagtccaaattcattcttttggatgtggtcccagcaccatttgttgaaaagataattatttctccatttaatgaccttggcaccctgttgaaaatcaattgaccataggtagatgcatttatttctagactctcaattatattccattgatctgtatgtctatctttatgccagtaccacaatgtctttattacaattgctttgtagtaaattttgaaaatggaaagtgtgaggcttccaactgtgttcttctttttcaaaattgttttagtattctgggtttcttgagttcccacatgaattttaaaattggcttgtcaatttctgcaaagaagccagctaggattctgatatagattgcaatgaatctctagatcaacttggggtatattgccctcttagaaatattatgtcttctgatctgtgaacstgagatgtctttctgctattttttagatattctttcattttattcaacaatattttgttcttttcagagtataagttttgcagttcttttgttaaatttacttgtaaatattttactatttttgatgcaaatgcaaatgtaattttcttaatttttttgattgtttattacaagtgtacagaaatgcaattgatttttatatataggtcttgtatcttgcaaccttgctgaacttgcctcttcgttctaattgttttttagtggattccttaggattttctttatacactctctttcattttataatcttactttacataagtagaactgtcttgacataaactccttgaagcatgtgacagtcatttgctttaaggttttcatgtcagggtctcctggagttctgaatcaaaagagcttctttggaaatacagtcaccatttacctcccagctgtgaaaagccaaaaaaacccaaactaggctgatactcctgtgttgacctgaggtcattctgtgcctgtcaaaccaaataacacattcaatcttttgtatattttgaagactcagaaacccagaaatttttagaacctctttctcactctaattaaaacctactgctctgtcaatgggaaagaatgagtccaaacattctgaaaaccgtacaaatgtgtttacattttagtgggggcttcctgcatctttaacctctttaaattgacataggtaagatcttgtgtaataacacatttgcaaatatgcagatgcattttcaaatgaatataatctgatttagagaatattaactgactatcatagtagactatggataatactctaataattaattacaggttaacatttttaaaactcaaagcatatgctttaagtttatgctttaagccacgttatgttctacttcagcctaatacaagggagaaatttggagggggccctcctagctttctagtctcattattcccaaattagaaacattaccagcctaacactaactctgrggtctaaaatgaagttattttggcagccctagagttttcttgtcattgataactgaagattggcctttgtgcaggttaaataatcaaatcttagaggaaattgacatgcttttaaattatctacaaatattagcccttaaaagattatatagcagtatatattatgttaaccaatccatgtgcagctgatggactttgtgattcagtggataataagcattagtttttcctgctttgatcttatgtatatccatacagaaaaacaaaaaaacgatggagagagagatagagagagagagagaaaagaaaaagaaagtgttgaaaaagcttaaaagtccaacatttcaaagctaatcattttgttgaattgttgctatcaccttgatacttgatatattctgttagtgattttatcgtatgggtatttagaagctcatttcatgtaactacttccagcttactcatcccatttacttttgcatacatttattacttatacaccattttgacccagatagcaaggtaatgtgaaaacatttacaaatgttgaacttttgtagtaaaataacaacaacaacaagaacaaaaaaccaaaagagcagggagtgctgctcccaaatggacaaaggaaattatgaattagtttataagaactgattttcagaccaaacagtgcagtatagtagagctataagcactaatgaacagaagaaacataatcatgtatcacatcacccagcaaatatactctgctacaaaactggtaagatctcagctttgactgccacagagagcagcccatctgctgcagtcaggaaagaattgtgtaattatctgtgattaagtcctcctttcaccttggtgattgcaagaattgtcagtgggggagaaatatcctatcctagttttactctagactcaggctctttaatcatattgttgagtgactcctgagtataaactctagcttttgaacactttgggtcatttttaatgttttgatttgttttcatcattgcttgccatttcagtatgtgtcatgtttgagtctgccaagaagcagcttttccacttagcaaacagaattgtgaaaaaaatatacatggtccactttctagggagtcttgtagcagctagtgatcaaattagagtattttttcccttaatttctgatgttaattcccacaataaatttagtttgtggaatgtcattaaagtcttacaacatgtctcccgtttcttctagagcatccctggaaagttgaagtaacaggaatatgtcaaagctataagtatttaatttgaaattttggaaaactatggcttaagatactgcatatgttttccatatgaatatgcaaattatcctattcatgaaaggctctgttgtatatcatattttacatgtacactaatctgaatgtatatgtatataccttgatgaattttttttttttttttttgagacggagtctctctgttgcccaggctggagttcagtggcatgatctcagctcactgcaacctctgcctcctgggttcaagcgatcctcctgcctcagatccccagtagctgggattacaggcatgcaccaccatgcctggctaatttttgtatttttagtaaacatggggtttcaccatgttggccagtctggtctcaaactcctgacctcagatgatccacctgccttgtcctcccaaagttctaggattacaggcatgagccactgcgcccagcctgatgaattcttattataacaatttaacttactgtaaacctgacatcttaagtaatgcatcactttgtttatataaaatatatttggtatatttcctgatgtattagtccattttcatgctgctgataaagacatacccaagactgggaagaaaaagaggtttaattggacttacagttccacgtggctggggaggcctcagaatcgtggcgggaggtgaaggggactacttagatggtggcagcaagaaaaaatgaggaagaagcaaaagcagaaacccctgataaacccattagatctcatgagacttattaactattatgagaatagcatggggaagaccaacccccatgattccattacctccccctgggtccctcccacaacacatgggaattctgcgagatacagttcaagttgagatttgggtggggacacagccaaaccatattgttctgcccctggcccctccaaatctcatgtcctcacatttcaaaaccaatcatgccttcccaacagttccccaaagtcttaactcatttcagcattaacccaaaagtccacagtccaaagtctcatttgagacaaggcaagtcccttccgcctaggagcctgtaaaaatcaaaagcaaactagttacttcctagatacaatggggatacaggtattgggtaaatacacccattccaaatgggagaatttggccaaaaacaaaggggttacagggcccatgcaagtccaaaatccagtggagcagccacattttaaagctccaaaatgatctcctttgactgcaggtctcacacccaggtcacgctgatgcaagaggtaggttcttatggtctcgggcagctcagcccctgtggctttgcagggtacagcctccctcctgcctgctttcatgggctagtattgagtgtctgcagctttcccgggcacacagtgcaagctgtcagtggatctaccattctgggttctggaagatggtggccctcttttcacagctccagtagggagtgcccctgtagggactctgtctgggggctccaaccccacatttcccttctgcactgccctagcagaggttctccatgagggccccacccctacagcaaacttctgcctgggcagctaggcatttccatacatcttatgaaatctaggcagaggttccccaacctcagttcttgacttctgtgcacccacaggctcaacaccacatggragctgccaaggtttggggcttccaccctctgaagccacagcccaagctgtacactggccccactcagccacggtttgagtggctggggcacagggtaccaattccccaagctgcatacagcacggggaccctgggcctggcccatgaaaccactttttcctcctgggcctccaggcctatgatgggagtggctgctgtgaaggtctctgacatggcctgaagacattttatccacggtcttggggattaacgttaggctccttgctacttatgcaaatttctgcagccggcttgaattcccccrcagaaaatgggttttccttttctactgcatagtcaggctgcaatttttcaaaacttttttgctctgcttcccttataaaactgaatgcctttaacagaacccaagtcacctcttgaatgctttggtgcttagaaatttcttccaccacatactgtaaatcatctttctcaagttcaaagttccacaaatctctagggcaggggcaaaatgccaccagtctctttgctaaaacataacaagagtcacctttcttccagtccccaagtccttcatctccatctgagaccaacccagcctggaccttattgtcaatatcattatcagcattttgggcaaagccattcaacaagcctctaggaagttccaaactttcccacattttcctctcttcttctgagccctccaaactcttctaacccctgcctgttacccagttccaacattgcttccacattttcgggtatcttttcagcaacaccccactgtactggtaccaatttactgtattagtttattttcacactgctgataaaggcatacccgagactgagaagaaaaagaggtttaattggacttatatttccacatggttggggaggcctcagaatcttggcgagaggtgaaaggcacttcttacatggcagcggcaagagaaaatgaggaagaagcaaaagcagaaagcccctgataaacccatgagatcttttgagacttattaactatcatgagaatagcacggggaagactggcccccattattcaagtaccttcccgtgggtcccttccacaacacatgggaattttgggagatacaattcaagctgagatttgggtggggacacagccaaatcatatcacttgacattttatttactgttttcaattagagaaaaataaaacattttctcatggataggtaacatttagaaacatgttccaaatctgtgctctaattacaactttgataattgtcctatcaatttagctgctttgatgaggctactcctggaacttattaacaggcttcttgtcaaactacaaaaaagatgcttgttttccaggaaagcaactatccgttaaatctaagaatacattaaattgttcaggtacaagtatccaggagcagagatagaacacaactttgttctatgctactaaaatagtcattttctctcactgaaggctgtgcattccctgtctaactctaaaggttgtactgtgattaaaaactcagaaagaacttttattattcacatcagagataaaaaggtggctttatgataccctckgggtaggagcttacacagttgggccaattaaatcatgttgagagagagcaactaagcaaacgtgcctatttgatttgcttgatttcccatgtttgctgtgatcagtggctttctcttttgtctgttcctkggattcytgatttggctttgcctctaggcattagatgttatctttggaggcatccttctatgagcattcatttttggaccaagcctggatttacaattctattactggcccagacttcatttctatccaatttcattccactgtgctatagtttacaacatataatttgacttataaataattcctgactatgggtttaaagactgaaaatggatcaatagaaactttgaaaatgttaacatcttgattgcttttctcagtgtagaaatggacaatgtttagcttaaaaactgcatgtttttaatgagatacggggttgaaagacttattcctggaatttattgttctggagaaagcctgttgctatctgccataccttggtttactttgtgcaaaatgagcttctttttaagtaatgagctctttccatgttcagcttaaattgctgtcttagacacttcatcagggttccctgctctgcctcattcccctttttgctcacttgcagcctttgacataatcctgggaggcaattggcatcatacatattttgctttgtaatctcctgctttgattctgactgggtacccagtctgctcactttgcttctatcttaaacaggttgacacataccagaaacttagtactaagttatgtgtgttgtaagttaattgagagtcctcttcttgattaaaatataggtctttagaacagtgttttccaaaatattccacaaaacaaatttatgtacagatgtccctgccttaataatagagggttgatacatggaaaggacagaagtttggacatttaacttatcacgtttggtatagattgggtgttagttataagagattaaagacatactcaattctatagtgtaaatgcttcactatatcattaggtttttgaggtgagcaaggaaatgttcacactaaacaattatgatttaggaaggcttaaatagttattttttagaacagaatttaagtcacttttttccttttctcattattctgaaataaagtaattattgctgaataaaataactgactgcacgttatcttaacagattaattcttttaatcctcaccttaaagtaaactcaattgattctggttaaatcttcctttttttcatctgaattacaagaaacccaatggtaatgtttcttgcaatatgttttataaaaattttatttggaaagtttgaaaaatttctacacataattgaaaaggataagttgggcacagtggtgcctgcgtgtagtcccagctactcaggaagctgaggcaaggaggattgctggaggcaaggaagttgaggacagagtgtgctatgatcatgcctgtgaatagccactgcactcctgcctggacaatttagcaagactctatcttttttgaaaagaaagaaagaaagaaagagaaagaaagaaaagaaagaaagaaagararagaaagaargaaggaaggaaggaaagaaagaaagaaagaaatggcattagggataacagaatttaatcaaagtagtaaaatgatcattctatgggtatcaaacaaataaatgaatatcgtatacttcaaacaagtgagttaaataattgatagtctgatataaagtcagatttaacaagagtttctacatgaaaagttctataagtaggtctgaactgattaactactactaagagaattctctttgtaacaggccagcacctactgaagcctttctttcttttaatactgcaaacatgtttgctgtttaaaatagggaaaccagctacccatgaaatcatgctgccattttttcctcattagccctttggtctggtcttccttggagaagttgatgttcctcaatagatagactaacagtgcagttggagaagcagagttttactcaattaattatatttctttgcccttccgtggttggctgataacacttgttacttaagaggaatggtagtttygccttaaggtaggagtatctcaggaaatgcaggaaactaaggcaacacaactaatattccagctgtaataacaagtccaagggttctacctctcagggaaaactgttggcacgctgccttctttacacttgcagccctttcaggcctcaggcaagtgttattctgaggtgaaggaggctgttcaggatgacgtaatttctctgtctgcctttctccatgttgctttgagccaagtctattgtgagataaaatgcctgtttcaggcagcagccatctctccaaagctttgtagcagagttagctttatttaatgtgctgttgggaaggatagggggaaaaaagagacctagcttcttaataagaacttgaagtgccattcatttaacaaatcttattgaatacatactatgtaactggccctgtgacccttatgcttttaaaatttattaggaagggagacgttgtgagagccgggaggggaactttttcttagagtgtattgttgtatttgagattactgtcttttgccagactagataatyaagaataaaaagctatgtacacctctaccacttctttcagtcaggtgaaagtaatttctctctcccttcttcaaatagctctcattgaaatttggcctactttcctcratagcaattttagatatatagtgagaaaagccgatatgtgtgctttggccattttccccatgactaatttttcttgttttatagtgctatcacccactcagagaaagtaatagcactattcattttaaacaattgcttgatacatctggatttagtcaggtgaagatccaaatcatgacagctctttggatcccagttgtctaatatatcatagaatcagagatcagcttcagtgagatggaaacagtactctcagctacaatagtgggctatcaacattttaactttctgtttcagttttcatttctcctcctgactgtgatattggcttaggtattctataattctgcttctgtctttggttacttttgctcacatgtgaaaaacataatttaatttgtgtggaatttatttcagcaaactgttatgttagttagctaagtaaaattccaacttaacaaactctgaagtttccagaatctttcattgtaacatgttaaatgataatgaatataccctctgctaattagacttggtaataaacaaagcaactgtccagccttttcttgttaatcaatcagcaaattaaaaaacctctttaaccaatctcaccactttgggaggccgaggcgggtggatcacgaggtcaggagtttgaggccagcctggccaacatggcaaaaccccgtctccactaaaaatacaaaaattagctgggcgtggtggcaggtgcctgtaatcccagctacttgggaggctgaggcaggagaatcgcttgaacccgggaggtgtaggttgcagtgagcccagatcgtgccactgcactgcagcctgggctactgagcctccatctggggcccgagtgagtggggtgttgggggagtctttctctcttttttttttcgagacggagtctcgctgtgtcgcccaggctggagtgtggtggtgcaatctcagctcactgcaacctctgcctcccgggttcaagcgattctcctaaaaaaaaaagaagtctcttgaacctagttaaagcccctactagcacttggggtgtctttgtaagaattagcaaaaagtgctccctctgcacagagcaagtaaaacaaaggctttatccaaagaggctggagttcctttggctggctgagtgggaggcgacctaggccttccctacacactgggcctggtgctcctgtgcaggccgcgaccttcgtaaccatcatggcagccctgtgcctgatacgggaaggcaggaagtagaattctgtaccacttctgagcccttcccatcttcacatttctggaggttttcttatttttttttttttttatttaatggcgttaatccactttgtcggtagttataaatgagaaggaaggccagagaattactatttgattttaggataaacaaagtggaataaccgtggtggcagttcaatgcaaggtttcccttccaatatgcaatgttaggaagcacatagcagactttttccttaaaaaaacaaaaacctggatagtaatctaaagaatcactcagaaggatttgttcattttaaagaatgtattataaaatgttattaaatgactgattctatggccaatgtacacacacacatacacgtatagaataaaacttctcgggtatgtgttatttatgattatgtattcataattataacgaagctaagtcaccattatcttttctgctttaaagtatcagaagctgctaccttgccatgaaawagtattacatgctcctccaattccttccccaccatatttatccaacaggaaaggaatgaataataaaactttgggctttttttcccttcttttttttccaggtgatgtgttccacytcactgtccccagtaaattcaccttcgaggaggctgcaaaagagtgtgaaaaccaggatgccaggctkgcaacagtgggggaactccaggcggcatggaggaacggctttgaccagtgcgattacgggtggctgtyggatgccagcgtgcgccaccctgtgactgtggccagggcccagtgtggaggtggtctacttggggtgagaaccctgtatcgttttgagaaccagacagkcttccctccccctgatagcagatttgatgcctactgctttaaacgtaagtgtttgatacctttttaaaaattacagttttaaaaaaaatgcttcgaagcatgcattgatgttcaactagccgttggagtggattccatgtcttgcagtgtgtgcacggaatggaaacagttcagtgattttcaaaagcaagcaaactgaacagcagtgatatggttaaaaccacaggaattttggcaaatggatttttagaggggtgaggaaatatcaggttaagctgtaactgtgctctgttgtgtccagagccacagagcatttttctaagtattttatattaattgcagtccttaagttttgcaatttgtttattggtgttacaatgccaaggccaactgaggctgagttaaatccttaagattgttgattttgtcttcggtatcactctgtttctttgagatggcaaagaatttaaatttcagtaattacaggtgagtatttgaagctgacatggatactcaaaatgttcaagtcataactaaaaatgaaccatactatcaataaaaatctccatttatgtcaagtaatggaaatacatgccttctaatcattaattctgtagtatcatattgacgtacaatatgtgttctttgcaacctataacagagtatctttagttaggtttactaattaacatttttttttaaataacatttctcaacattcatgatataattattttaattttccagatgtcctcaagtaattttagcagtagtagtcacatgatatagtatcatagttgtagaatgcaaattaaacaagcaagtaatctagcatctcattggaatatttactgaaccatctatactatgctagctaaacaaagatctcccagaattttggtgaccttgggtaatatccaagacagagttaggttatgttgaaacaaatttgtaaacaactttgactaaatttccaatgtatcttgttatagcaatatgtctctaaaacgagtacaaaatgtactagcttattatataattgatttctagagtgaaatacacaggcatttttaagcaaccaaaaatacacagactgtgatgttctaggtagtcagtagaatggatgttaatgcraccaaaaggtttgttttcacacttttatctcctagctaagaagcctctgctctgatctcctcccttaractcaactttctgagtgttaaagccatgtgttctgtattagcttgccacaagctggtcgctccataaagactgtagaaaatgctggcttttgttctcaggccctgaaacaacagaattcttccttaatcattttcaggaaaacaacaatagcataaaccttatctctaaaagtagacagatgtacattcctttaagctacattgtcacaacaatgatttttcaagtacttcaggctctaaaatcagttttacattacgtgactgatataattaaggagcaaaatcagattggtatgctgtggggaaggcattggagaggttaaattagggaacraatagaattatccagcctgacttccttatttgatattttcttgtgctttattaataaaactggcactggaaaacttttaaacaacatttttcgtctctctgtgggtaaaatttaaatcaaagcctgtctgtagccacaaagactattattaaagaattcatcctgatgtgttttaaattatttatttaattgaaaaatacacatgaaataacaaggtacttatgtttaaatagagtaaccaaaatctgcacaaaattcaaaaaatgtttaaaagtttatattcatttttatctctctaattcatttacatgtatgtaacttgtaaatataatggactcattattttgctttccttcccacctaagcatgtggctagattcttatttatttcctacttaagacgttattatattcagaattcatttagtgcgtagaaggttaaaagcatttagccatatagaagcctttcttaaaccacacataatgccaatagttttccaaaatttctaatttatttttcaaaaaattttttagtgtatatgtgtgtgtgtgtgtgtgtgtgtatttttttttttttttgaggtggagtttcgctcttgttgcccaggctggagtgcaatggtgccatctcagctcactgcaagcttcaccttccaggttcaagtgattctcctgccttctcctgcctcagccacccaagtagctgggttataggcatgcgccaccgtgcccggctaattttgtgtttttagtagagatggggtttcatcatgttggtcaggttggtctcgaactcctgacctcaggtgatccacccattttggcttcccaaagtgctgggattacaggagtgagccactgctcctggcctagtatatatttttaaagaatttgaaaaatattttcaaaatgacttaattgatgtccacctttcccacatagtcaagtagtgactaaattctgtagggtaaaattcataagagtcatggcctcagctacagttccaragtgatttcagagatatacagctggctggttatgtagaggaatttagaaatataaccatatttttcttgtttgcttctaccaaacgtagaaagtgttttttaagtcacttggtgaataaacaatgccaaatcgtaccttgctttaattccctttgcctcacaaagtcactgactaaaacattcacaaagacagataaaagacataaaattaggctttattcttttcaaataaatttgaaaagtaagcaaagtaatgtctttgtaagataaagttttcctgtatatcttctcttaatgattaaacaattttgcatatttagttttttacttcagaatttagcaagttctgtgaaagttggagagttatacaaggctttgaaagatcatttcatacatccccaaacttaagtgaatcaaaaccattcaaaactcatgataatctctcacagaatgtgattaattatctccaggagagggagatggaacatgtttcctagaaaactcattctaatattccatgaccttcactctcagataatttttctaattaagtactttgcatttgaatttgaacccatgttttcatttttgagttggagaccaaaatctgaataacagccatttctattgttgatcacaattgtttatttatccctcagcatcttctccaactgaaacagttttcttgttttacagtttcaatctccaaatttctaattattgatatgttcttgctttgaagtttcatcattgtttagcacattcctctatttatgcttaagtttrgaaatcaagatggtggtccagagaaggctaaattaattcccaccactttctatcctatcttatatactcrttcactgttaaaatttgcctgcccttctaacctttggttagttcattatcttttttgtgtgtgccctagttcataatctgaccacatgtgccaaaactaacctttccccgattggtatattacaaatgtttcctgtttattgaatttgaatttgttagcattccatcactcatataactttaaaaagatagtttgaattggccgggcgyggtcgctcacgcctgtaatcccagcattttgggaggccaaggtgggcggatcaygaggtcaggagatcgagaccatcctggctaacacggtgaaaccccatctctactaaaaatacaaaaaattagccgggcatggtggcgggcgcctgtagtcccagtccctaacccaaaccctaaccctaaccctaaccctatccctagcctgtagtcccagtcgggaggctgaggcaggagaatggcrtgaacctgggaggtggagcttgcagtgagacaagattgtgccactgcactccagcctggactacagagcaagactctgtctcaaaaaaaaaaattatatatatagagtttgaattgtaatttcactgctccaatctttacagttttataaccatgtttacatttagttatgtataacaaatttaatatagaagaaccaagttaaaattagtcatttctcaataatgtagagagcatgggaataagttaaattgactatcatgctgctaatgggggttttaagttttattaggaaaatctgtctcatgtctcgcaacagaagcagagaagatggcccataggacaaaaatgccataagtacagtgangtgaaacatctgtgggcagacagctgcaaaggttggaaaggaacttttgtgggaaragaatcgtgttgatttatgttggcttcctcaataataaagttgaaggaatactggtagttttccagagccaaaacttctccatgtgaatgcacctattggaaggacactgttagaataatctggaattgtttttacctttacaatagtcatcagaatacagtggtatttattcttaaaatatctcttcgtagatattgtgctttataaaattatttccttttgtggaatggttgaaacaaatggcacaaatcctcagatacactgacttgtgatcaaaatcagctgttaagttgatgaaaaagccacccaaactgaaaaggaagtctgaggttttccattccaagtagtagaattaattaacttaattataagcagaccttttcttttttaaaatagggctctaaaattattgaaaacccttgtttttggaaacaaagtcacataaatactggctttctagaacagattctctaggacatattgctaccactttattacacagcaggactagaggaaggaatgcaacagcaaactccatagtaataattgacaatgaaatctagttatttagttttaaaaatatgagtcaacttttaaaacactataaacatattttcatagcattgtagaaagttgctagcagagagcttggattggaacataggaagcctggattcacagcccctttggccctaatgcaattgtacctgtttctaagttaatttcatcagccaaggaaatactcagagggaaaaagtaaatttagcttttttgttgttattaataataatatgattaaattttctctaatatgctgtttgcyaagtatttatattatgtttccatgggaactttttctrtatgtatctttttactayttccccaaagaatgcagttataagacaaacatgaaatttggcagttaaatgaagtaatggttatggaatttcagaggatagagaattgaattaaaatagtcatccacattttgggtttttaagttgttcatgtcaatcaaaatagaacaacgcttcttccaggaaatgaatgtagaaaaagcttttctttaaaaaggggaggaaaaggttatttaatgtttttaaactccaactcttttttggttagttttgttttaatattagaaagataaataatgacagactttaaagaatatttaaatgtatcataatgtaaatagccctcaaatgttcatgataaaatcagtgaagctgagctttaaaatggtctggggaatgaccacaactaataacagctcgtgccagacaaaaaataaggaacctgttacagccctagtctgatttacaataaaatcacatcattttatgattaagtttttacagagcaaatggagctaaaaggtagcctgttttgttttttgagggctcctgttctggaattattaaaaataaaaaagaagatactntagatactatggctattacacctcttttcagggcaaacaagcatttactcataaaactagctttaagtcctataggatgtagcaaaacaataactacaggtttcttcaggacagttcttttgagttcagtggcaactattaataggtttttatttttaaaaatactgatttttattttaaaaaaamaatcattatatagtaggctgctgccttttccctgtgttgagaaagaatcttgtttacaaactgttgcttttatacacaatttaaatttctttcaacaggccaggccattctctgtaaatctggagccattataatgcagcattttatgatgacaggttactttatattgcctgagcctgttctttctgatgcttagggttgttcccagtgatttgtaattacagacctaaaatacattatgtgggtactttacttcctgttctacatttgtgtttcaggctaaagtaagcctggaaacaagatccttaggagatacaaacagagtgtgtagaacatagaacaaaatgtagaactacaacaaatgccgactagcctctgccaggcacattttataatttattagaaacaaatctacaccatgaagttgaaagaaggatgaagacaaatktccaacacctgggatcaagtgaagagtggtattaaaaagttttaatatcctgtttttatgaaagtctccacattatggacaatgtaatggtttatatgtaacttggatacatttcatgtggcttttttgttgttttgcaatctgagacacaccctctcccctgagataatatgcagcaacttgaaaagaagggagcatgtggagaaagctggagacagggtacagaagcctccagaagaatagtactaaattctcctgcgaggcttcaagttgacgctgtagtttctggtaaataaacaatctactgtatctaaaatctgcatttatatttttgggagcttttccttatcttaaaactacataatattaattttcctcaactggtaacagtcatgcatacttttaggtaaaagcagtgataacccttataacgtaaaacaactgatcaatttatgactattaagtgttcaattatctgtccttgggttaattcaagtatagttttaagactcctctccatcacagaacatttctgggccacccaaaaatactccctacaaaatactcaggagcacttaacaaacactgggcatacaagtttttattagtgacttgtctaatcaactctttgaaattatttttctagctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactgrcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagyctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggtaagtctttgctttctagactagcattgaaggcaatcctcattttatcttgaaagttacttttggggaaaaaaagtcaacataccaaatgctgctattagaagataactggagtgtgaaaaataaatgttttagcttcatatatttgtacaagaattggaagaatatgttaaacaatgtggaagaatgttagatacaattttatgttaaaagtcataagaagccctgctttgtcatctaatataaccaaatcatcactgttacatcacttcaaaacatgcagaacaaagtgttttaatttcagtgtcttttcatacattactactcaagtgtagcactagactgtgttaacattccattggtctttaactattaaccttcagtacttacaatgtggacggctaaaatcgttttgcatatccctaaggttgacagaaagatatttaaaggtttgctttggtttttctcttccaggattttacaggtttattatatgacttgtgtggtgggtaataggtctctaatgtaagtgttattttaatgtaaatgcaacatattcttatgctattgttttggggtattttactgtggttttatctatttagagcaagtacaacctagcttagttgtagggagtattacagtttattgtattaaatataatttcagaaggtggctatatattcattatccttgcttcctaaaaaccaggctgtagtgttgttcattttatgatttaattgttttaccgctaggaatatttgtgatgccttctattccactcaaatattttagctctctgacagaactcttaaaagctgtttgtttacattgattaatacttggagttgtcatgatcaaatacgatttattgctgtctaaaggtgagcccacaccatcttttacatttgataagctgagttgagaatatatagcaaatgcagttcaataaatcaattcaggtttgtctctttctagtttagaaattacratcatggattttagttaatttgctatattttcattttcatataagaattaaatgaatgagtattcrttgttttcttgacctggctctgagaagacaggatagaagattttttttttttttttaagcagggttctctcttactgttggaatattccctttcgagtatcatttttctgaagactgatgctatcctcattagagtgctcaggagtgcacctattggaaacaaacaagtagcgttattgtcaagtatgtttgcatgtagtgctgttggtggacacttcatggcttctataggtttctactctccagaattttctgtgtgaaagcttttgcttgtcagtgaatagtagagaagagaacacacccacagagtattaaaattaacctccacttcccaatgcagtttaaaaaggacaggatttgatcatgattttcttgctaatgatattgtttcttggaaatcataacatatttcctcttttctacatccttttccatctctcggaactggtgtaggaaaaagaaaatgaattgccagtaagtcggaatgaggattgcgttaggctggaaaagagacaggaatataacggtgaaagaaaaacaaaaaagaggtaaaaggaagcaaaaagtaaatgactaccaacacttagtttcataatttaaaaaaatgcttgaatggatatgcagattgtttttcaattgatactactctgttagtgtagctaataagttgagttgaataatataaaacccagtaaaaatgttctgcatttaaaaactcttccaagtgggaaactgccagttaggaagtcaaattacaaaatggaaaaagtgaaacttgatctctctgaaagaattggcagtcatcaraaaaaaagaactaagttataaatggttgctggaagtggagggtctgagtaagctaaacctgaaacaatttatacaaaggtgtacatttataagtgagttgtggacttgattcagctagacctgggagacgtatataggtgtttcttctccttctgcttctaaaatgtgagactataatccaccttgaaattaattttgttttgcataataatattaggtcagaaaaccgtgcaatacttggttacttccatcaggcagaattctaatgtgagagtgtgtatatgygtgtacaacaaggggatgtatctgtggaataattatgtatctacctacctacctaccttcctacctacctacctgcgtacctacctacctacctacctacctacctacctacctacctgtcatcatctgtatttttgtgtgttctgtatatgctgttctccttaactaaaagcattgtttattgtcttcataagacaatgaagtttactcacctctaactgctcacctatactaatattatttattttctatgagaaattttatcctccaacattttgagctttggcaagggaaaatcctaaagcagatgttcaattaatgaatttcaaggcaggtgtataccttaataaggaaaagtgcatatgtgcctggagaaccaacctttttatgtatcaaggcacaattttccagactggaaagtccttggtgcatgtgtgaacttgtataaatctattcacaggaatagaatacacctttatatatactgtatatccaagtaagcaaaaataccacccatgctattytaaaccaaggcattcaataattttttgctgcactcagcgagtcatataaatcttgtttttttttttttttttttactactatgaaacaaaacatgctactcaggacacacttatgttatacttgctcaaatggatcttaatagcaacttacggtgctctagctagagggcaactgtagttagcagttaaaaaaatctgaaagaacttttcagctcataaaagttttatgagctgaaaaatgctatggggtgtgtttaacagtggttcaggggatactgaaaactttactcctgtctatttcaggagtaatttgcacacctgcattttgaaaaattattgaaaggctttctttgtgaacatgcatgaaggccagaatttgaagctgtaggaagagtttcttcaactccagattttttttwaaagagcactcctctaaatcacctgaaatgttacaaggtagtggaacagaactgtgaatgtttttaaaaactgacaaacaggtatttttaaatcaaagaataatttagaaatgtatggatattaaataccaacattattatgcaaatgctcttagttataaccttaaaataggcagcttattaccttttttaacaaacaaattcatatatactacttattatgtgtcaggcctgcttgatgctgtcttgttaggtgttctttttcctactggttttgtaatttgtatctacccaaatgtatgtgtgcaggtgaaaagcaatattaaattaaatgatagaaagattaagatgttggtaaaattattaatgtaatgctattaaagattaattacattttgagaaatatacaaaaagctaaaggcttattgtctaaatatggtgttatggagaggataaagaacaaggaacattggctctgagggcaggagccatctgggcagatacccatatttacatcattgattgcagagtcatcacttttttttttttgcgacggagtcttgctcwgttgcccaggctggagtacagtggagtgatctcggctcactgcaatctctgcctcctgggttcaagcgattctcctgcctcagcctcccgagtagctgggattacaggcgcctgccaccatgcctggcgaatttttgtatttttagtagagacagggtttcaccatcttggccaggctgggcttgaactcctgacctcatgatccacctgccacggcctcccaaagtgttgggattacaggcrtgagccactgcgcccagccaagtcatcactttttaaaaggtaatgtttatttaagataatctcatataattttttaaaatcacacattttctgttcttacagaattttaaagaacattttaattatagaaaaattactttctgatttgttattataagatccaggtcctttcttcaaacaaaatgttattgagagcccctgtatcttgaacagacaaaagagtagctgtgttggttaatgtttgagggggacatcgagaacctcactcccttgggacctcctcatctcctgtggtggtttttaaaataacatgtacctcacaacacagctagaaaaagaatgatatctagaccattcaaaataaagcaaaaacagttactcattcctgagagaattaagttcttaaaagtaaaaatgtttcaaaaattggtctgattatctatatctttatctcattacaatgatacacatttaacatttacctttgaatagcactatgcatggtgctgaataaaacacattaaacaaatattgtttcaatcttattgatgcctatgtgtcatcaagataatatataatggtatgtcagagtctcacatgtatgtgcaaaactaagtcatcatcaaactcacacttcgggcttcatactttcagaccactttttctatatattatcatgtttaaacttcaaagataatttgtgagacaactagggaaagcagatagtcaaacgaaggtacactgagtctgacattcttggcattgggtctagcagccctggccctctttggagcatttttgccatgaagtgattctctctcctgatgagctctgagaaaacaacaaccccctgcccaatggcttaggtactgccctgtctgtcaattcctgaaagagcaaactctgggaagactggtttctcattggcattctagtggtttgttaagagtatataatttagatttggttgctgctaatatggggcagtatgcatgctcttcagatacctgacatagcaaggaaagagtgtgctgaaattggtagtacgttattctgcagttctgggcagcttctttcctgtagagttttggagcacatctctgaaagtggatgggtctggtgcctgcacacctccgtggttccttttcctgagctccagctgtggctgtctgtcagagaagcacatttttctgcagataattagaatggcttcccccatctctcacggactgtcccaagtctagaaaagaattgagttcctcttctattagtcaaataaaagggaagagaatgtttgtcttcctttcctttctgtagtgttaagaaaataaacgaacttaatgattctaaattatcagtgagcttaacactgtactatagaccaaagattaccttttcaaaaagtcctttgaggtgaaatattttgtatacgtaatacatagatgcacatataaacacacacatatagaatctcaatattttaacacttctttgggtagttgtactaactcactaaccctgaggaaaaagttaagaaattgaaagtgttttcttcaaaagttgagatttaacaataaaaggtgttactttgataactaaaaggaactttattatcctcttcctaaaataaaccaatgcctattctgaaaatggcacttgcaattacaatttgccattatcaaagctaccactgaggtagaggcattatctaaaacaaataccacttatcatttattggcagttacctcgagagrgacccatacaccatcttctagcagagcacagtcaatcaaattaccttcgggtaaagctatagcatgtctagtcgtttgacagatattaaaggtggtcataaaagaaacataaaccataggctgtgctccaaaggcatattggccagctaacattaacacaatcaaatacagttgtcatactaaacatatagttacacagtaggtgtatggtgtgacagattgtgaatggtaggtgaggtcagaaaaagaaggaatcaagaaaggcaggaagttacagaatatttcatgagaaagaggagacttacgtcagtctctgttggagggatagattacaatccaattatgagaggccagttattagccaattgcttcccaacttaggctcaccagtggggttaaggagccccaagtrtaaacagctgtttttctaaatagagtttctaaacagcttctgaaggaggccatgtcatcccagtgctgtttgacatggcctgcttcagaagctgaataccttcttaggcctcacgcagaaactagtacagttcatgaaaacccgagatactctgccagcttcttgaggaagcagtgttgtcacacttttctgagcttcagtgattcacacattttgataagacagcatgttctgtgggttaagtacatttaccttttcaaaatatactcccatgaagtatcatggttcagaattacacacttacaaagttaaatggcataaaactactttgtaaaaagtgcctacactctaaaaggtgatttaaaggtttatgacatcttaattcaagtgaatactgaatcagtaggattatagagcaggtgctctaagttagggaatctggagtcagtctctcctttgcttatgtgcaatgtggacccagggatttctcaatttctctgtcagaatttttaacatggtaaaatggctattattatatggaatgrtatttcctaagctctgacacatactctttctccaaatcacagggtttatgaaacaaagatacacacacacacacacacacacacacacacacacacatatatgtatacacacatatatacaggtaatatacagatatattttttctaatttattcaacagtcaaataattacaatatactaactacattagaactggatttttttgaagtacattctggttaatattctgaaccaacatggagatgtagttagtttgcttygtaggatacatggaagaggcagttattgtgatagaaagagcctttggaaagagacctgggttcactgtcaacattgttacaggaggcactctgtatccacaattctgcatcctctgatttgaccaaacatggataaagaatatttgaaaaaaaaaaaaaaagcaccacaataaaaaagaacaatacagcaataaaaaataacacaaataaaaacccaacacactataataactatatagcatttacattgtattagttattataagtaatttaaatgattacttataatacctgatttaaagtatatgtatatgaatgtatgcgtaggattcctgcaaatactatgccattctataaaaaaggacttgagtaccatggatttttgtatcctcctagaaccaatcccccatggctactgagggataactatatttacagtctgtttggtcttgtataaattacttaacctccacaggcctcagttgttatataattaaamatttataataatactacaacctcaccacattggttaaagaaggggatctttgagtgattgccacatgcaagtcactgtgacaggcatttcacatatttaatactccttcagtgactagaaagcaccaagcacaatgcctgatacatagtaatgacttagtacaaattaatctcctgtgggctttaaaaattatttcatttccaacttctaagtacaggaaaatatagactgttttgttctaaataggtaaaagccaaatgatcttaaaattcaagatcatttatgccacaagaagccaagtataattgtactttagtgtctgcttaactgaaataacttcttaaaaatccgaacccgacataggttgtgtttttttgggtggtgccattttgggtgcaaatcagaagcagctgcagcccttacttaaaatttaaatatagtattggctctataggacctaagagtagaatttattagctttttgcttttcctcagttgtgaaagttgggcttatgattttgataactaccaatttaatttttttctcataaamatcattttacaaattcttgatacatttccccaggtattgagcctagcttcttgcatatttatagaatgaatggacattccctgctgtctttttgttgttgtcaaggaaacccccagttctctacacagggattacattcttctttcttaatagctcttagatcgttcatttgtgcaatgaataaaaaatgtactcacaggtccagacagtgttcagaacttttttggtgggtgaggggcgtagctaaggggagagacatgcctagtgagaggagcaataggaataaaagaaaaggagaaagaaatgctggctgaggttccattttaatgaggtaaagctgaaaaatttatgctttaaaaaagacattgcctatttttgtcactttagaaaatgtataacattacttttcattgaggtcagtgtttcatgtacaaaaatgttagtttttaagtggctttgttaagcgaatagctccaagaatggggcccaggttgrtgagggtgggatggatgagggagtggtgatgcgttttagtagaaactattttttcatttctatagaagtatttgaaytttttttacaacctaattgaggtgatacaaaatataagaatattccttcatcctggggcatcatgtggwcatctgagagctcatttgaktacattaaaaatcgtgttccttagagagagagtgccagtatttagactttttgagtgtgaatcaggagggaaacacacatccattgacaagaagatggatataattatttttaaaaagagtgatttgatcctttggaggaaaataaattctggtggaccttctaagtaactgctagaatgattgggtaatgtatacagcttttgmttctccataaataatgtaagtattaaaaaggagattttaaactagaaggaaggaatctctggagtgagaggaaaagtttaattgtatttcagtatctatgtctatgaaaagttgatatacggtgtcactgtggtatacccaaacttgtttatacacatgtataaccagtacacagtaagtaccatgagtggcttttagtgattttatctttttaccttgtagtacagtctccctggtgtctcacaaggctagtttacttactttggccatatgcttcacatagtaggtttctggaggttttgttttttctaagatgagagagtgaaaaggtaatgtatatttctggagagtatattggaatatagtataatcatcattttcactatgctgcacttcgggacggctgtctattgtattttttaaataggaaaacaaaatctttttgttacacattaaaataaaatccattttaaaaaagaaatgtgatcctaatatatctctgctgagtagattggtgtacatttacgtttaattaaaagctcttaaacttaaattgtaaaattccccaaagagaacgtgaactttaaccagctgcctatgcatcttagcaactatgttttgtgtctggtaacagtatgactggaagacttgtgctctgtctacaaaactttgttatgaagtacttaaaaatacttgtgaataatttgaggtcagctagcaataaagctttgtgtgaaatgtcattaaaaaaagcctattaaccatggtactgttatattcaagtcaagctgttaaaatacattcatataaacatagaaaagattatgcatacactctgtagagttctgtggtttgattcttgaaatccaaacaaaagttatattgccttttgagtaaaattctagaatagagcagtcttttataagactaagagcttcatctaagagcttgaaatgtcaattacaccattgggttgctctgttcctatgaaatagagcacatctccatttcggaatgagatacctcctctcacagtagcacaggtgtaccccccaacccccttactatacaccrcaaagaaacttttctggtttgcaataatctctgttgagattctctaataacgtgtgtggtgggtggaggtggtgacaggaaatggggatgaagaggtaatttcagaggaagaataaactaagagggggcaagtaggatttggtgagatgcaaggagttagtgacaaatatttgggtgatagggcagggaaaaatttatctgcatatattaatagtagataggttttataccccacctctccctgctatgagatgttaaaagtatgggaagaaattatactgacagaataaaatttagattgtatgtataggaaatgtcagcagaaaattttaacttgaaagccctgggtaattaacatttctctctccttcaaactgatattaagaaatccagccaggtgcagcggtacacactgtaatcccagcactttgggaggctgaggcaggaggattgctcaaactcaagagtttgaggctgcctgtaatggtacccctgcactctagcctgggtaacagatcaacaacctgtctaaaaaaaaattcaataaaaccatttgcaagttgtcgcgaacttatttaaagaataataatagttgcttaattgtgagactattactttcagaaaaaggaaacaaaataatttcaactcccattttgcatattttttgaaattaaagaattcccatttagtagacaattttttttctggggatctaatatacaaaattaagactgtagttaataaaattgcattgtattagagattttgttaaaaaagtaaatttcagttgctcttctcacaaaaagatggtatatatgttaatctgcttccttttaccatctatatgcatcccataacatcatattgtaaacctcaaatacacaatagagtttattttagaaaaagaaaatttctatcatacttattaaatgagcatattattttatttatatgtagattttcttctcaattacttaatttattttgatgtgctgccagcttcatgatgagaaacataagatgaaactgcrtaatacatttctgttttctatcattttgaaggcaagtcagatcaaatagttgcgaggtgggtggagaaaggaatcctaatctaaatttaatgattagtacatttgcaataagtacattccaaaagtttcccattaaaataggagaaaagagtttagtaaggccagttctctaacttactggcaggaacatttgtttcagagagagagagaggaagggggcaaggagagacttggaaagtatagttaggtctctctgaagttgacaagagagtgtttgccctagggtctgatacataacaggtactcagtaaattttgagaaatcaatgagcatctgaagagatattacattcwgggcagcatgcatggttgtggtggtagtgaatttaattttgtgtgcaaaaaccgatatgaagcaatgctgtgtttgtgaaatgtatgcaaagattctgtctctgaaatgcttatactgctgtgattgaaacattatcatatttatttaggttagaaaatggaatttactacatctgagttggtttttggtgagaaattctgatatgatagtctaaaatggcaaggaagtccttatagatctatgagcaattggaagtgttagagttcttgatctgagagaaatatgacctaaaagaatattatactttgttaattggagctaaaatcagaaactataaagtgaatgccatggtctttagtagaattaagtattcttaatatgagttgatagttagctaaattattatacagtactgatttacaattagagttcttctttattttctttcccagaggaaaacaaaaaatttcagtgagcattatgaccatccatcagtttcttaccatattgacatgtgacatgttggcatacctttgtgtcttctttctctgcttttctccaccccactttttttagagccaccaacatacttgacagaacttccatctgtaattactcaataagaagatcatgagatatgtttgtatcagtcttatttttttgaagtaaagaatttacttagaaattcaagtaaatctataatagcaatgagtgttcttaccctattcttggcctaggagtttgtaaatatacaatattaatcagatatttccttatttatccttgtgttttgctggagaaacccagctgaatggctcgttttaacttcattatttacaaaagggtacaaaatatggtagaggttctttatatgcttgacactgacccatgtttcttatttaaaatcttttctctgtacttraatgaaagttttggtgtcaccaaacagggtaagtaagaatttagtgtacctttgtctaatatttcttaatcatgaattctagttttatttaagttaatgaagcaaaataaaagagttgcttgcatgtaaaatgrtagtgtgagcagtttaagatatgcacatttttaaactccagttaaatcccatgaagttgtactgaatagtttaactgagtctggcttaattcaactatattcaaatagttttagcaatgagagactcctggcttggataaaattattgatgtgaatatttcaagagattcttttgtacagaaggcattttaaatgcttctgctcatatagtttaaacattttcttcacattctkttttcatagcacaaartttacyttcaatgcaaactgaattaagaggatgttatcatcctctgaatattttatggtgtcctattttaaaacatatacaccatgggtactatatataagatccgagtaacaactttagtgacctaatattgaagaaacctagtctttttagttacctatatttttaaatgacaaggcatttaatcattttcctgcactgagcaattagtaacaattgcaacatctgtgtcagaaataatctgtattcattttatgtttttataacacactagagttatgtatttatctcgcttctctttgtggtagaaatattttctcatttatttgaatacccatatgctgtagtttaagtagttgaaaagctgaatatacagaatggaatggaatggagagagaagaaatgaactgtagtgtgtaaaatttcaataggaagggtgtttagttaggataagaataacccagtcctacacagaagtattttagtgaaataatttagtgaagatgtggtgggatacaaaagagagttttctttcttgtttctattagaataaaagggataaatgtatatgtctttgcattacataaaagtcttattgtctgggttttttaatttaaaaaaaattcaaggagcttctgtggaatttgtcttggtagttcctacacttctrtatttgtcttgattcataaaatagattagaatataagcaacactgattcctcttcaatagggttttttcttctctgatgaaacagcaaaagctagatattgtttcttctatacatagaaggaaatagcttcttgcaacaggaacaattcaggagaaaacagttgttttctcccctttagatgataggttgggaagcagggttggctccgtcataatgatttctcctaaacacttctcaggtttggcctatgcatgtgtgttatagattggggatagtttgaaaactcattctgtagtattattcctatgggcagggtggtgagtagtgtgtaaattctttgtcttctttatgggtcagtatatccacaggcacattttcatactgctttgtcactgaaagtaaggcagctgcagtggcaggaccctgttctaggacagttgaatgcctctatgatgagacctcagaatttcctctttcctagtgcccaagacaaggagctttgctgatgtatttctgatagcagaaaaggccattgagcttagtggttggtaccatatggcaatttacaatctgggaaatattctgatgatacatacttttcgargaatgctagttagaatatttagataggactcctgaactttctttgagaagatgttgatgacaagaactaaaatcagcctaatctgggtcacatcccaggaaggataaaggtctataggtgtggaaggctctttctggtcctttcagtgagctatttccaatagagcccgcctatscagagcttcccactcttgtgcataggatgtggttaagctcatgtctcagtgccacagtaggtagaggatgccattgcaatgtaaaagggctataaataaagctctcttgtttttccataaaacagtctgctctagaacagattataaaggggccagaaggaatctcttctcattttcttattgaatagagagtgtataaattattcccttacataaaggacaattactttttctatatagatcatatatagaaatagagctatagaaaaagtaattaattctatatgatatggcctcaatttttaatttttaaattgtttttatatgaaatagtcttaattttactctttttgcagttcacacaaagatgaattcctgcacttcaagattacattgtatatgtgattccttgcttcattttaaggactatgttgttttcttaaatgtgttgatgagtctttataacctgttttaataatgttaaattgaattcatttttcttattgttaatacaaaaacagtaaatttgaagactgagaaccatataagagggtgattgcacttattatgaaaagatttgaatccttctttgtgtgtgtgggtgtgaccagccttgctatcaatttcttctgtcatacactgccaaattttctatttaagtattgtgaaaactctgtttttttcaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcaraatttctcggacagctctgaaagtgatactcatccatttgtaatagccaaaacggaattgtctactgctgtgcaacctaatgaatctacagaaacaacygagtctcttgaagttacatggaagcctgagacttaccctgaaacatcagaacatttttcaggtggtgagcctgatgttttccccacagtcccattccatgaggaatttgaaagtggaacagccaraaaaggggcagaatcagtcacrgagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaartacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattrctttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggarggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacrtagtcctgcctckgtctttatggagcagggctctggagaagctgctgccgacccagaaaccaccactgtttcttcattttcattaaacgtagaktatgmaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggygactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctmtaccagctgaacatgtagtcacagattcaccaatcaaaaaggaagaaagtacaaaacattttccgaaaggcatgagrccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactwtaacagaatggaaaatgtggcaaaagaagttggaccactcstatctcaaacagacatctttgaaggtagtgggtcagtaaccagcacaacattaatagaaattttaagtgacactggagcagaaggayccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcamaactgggatccctgctcctagcacagaaacagaattagacgttttacttcccacggcaacatccctgccaattcctcrtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcractttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaacckatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggtaagatcacaacattgataaatctgtttccaaacctggaaacagtcccttggtgctaacgtttatatgtatgtaatttttattgtgatgttaaatcaatggagagtttcatattattcacataacagcaggccaggccacagtattgagttcataatgagatgaaatgacagtaagtatagattagttttggactttagaagtagactttgtatttttctgggttttagaaataatatacaattacaacatggaaaagatgaaattattaatgttataaaaattcaatttgtttttactcacaactagartattgctttgtcatatgtctcatagttatacatgttaggtttaaaagtagaaaaaaagtcctatttttaaaaaccctcccattgatggatgctattgctgtagtatcaaaatctgtcaggcctttaacatttgrgagtagtacgtagctctaataattatttcagagtttgtgcagtatcaatatcagctcatacttatatgcaatgtccttgtttaagacagtctacataatgcatcaaacacagtgcctaccagtagtgagtagtcatttattatataaacatactgcctgttgagagaagttttctgtgtatttactgaatgtatggaaagcatgaatttgatactgattcatataagccatctcttctgattgccacgaaaaggctataaaagccctgtgtgaaagggtaagaggtgaaggttcagagaggttcagcaacttgcccaaggtggcacagccacattgtggtaaaagtaggatttgaacccagcttagctccactctaaagtccatagtcttttcactgctctttgctggtttcagtatagtataaaaataaacaattgatattgaataatatatgaaccaggaatcttggaatatttactttgtagaatttattttcctcttaatctagcctgagaatgttaagaaatcagctctaatggtgttttcccataatgttattatttaaattaacaatgtcagtggaatccacaaatagacatcaccacctagctgctacctgcaaaaagaggaagaaaaatcagtactttaatgtctgtcttggttgagaatatatgttttattttaatatgttttatgccrtgactatcgttaaaattattcttctgatcatatcaatattaccttttgtgccaccaatgctttattttgatgtkcttcagaaagagtaaaatagaaagtacaatttttaataaatggcttgaaatattttgaggaaaattgatcaaaggtagttgacattgggttttttgttatcactgtgtgttaaatctgtaaatgataatctagtaatttggctaatatttattgtttttwaatttagtttaatatacttcagtttgttaaaaatatgatgtaaaaataactggtaataactaggtacatatagagttaagtttgatgaatgagaaatatgtaccaattwtccagtttacaatatttaccaagatttatagtttgcgtcttcattgcaaaacaaatggtcactttagcttaattcagtaaacagcagctcatatgggattacctggtctatctgttgcagattcaactttcagaggttaatacgaactgtttaggggagaataacattcataaaaactgaagtttcctgttaattggaacgacttccagttcacaggaagactcactcactcagtccttgtttcatggtctcagcatggtgtctagtgtcagtggtaggaatagtaatagtacttcttcacatttgtgtggcacatcacagtctgataaagcactttcacctagtgtcatttggattcagcacagagggcagcatgtggctatggcgtgtgttaactgcagccttgtcatcctggcagcgagcgtacttgtactttaaaattcagaaagctaaaattgttagggagatttcaaatagttttggaactataggaaaaagtgtcttagaaaactcgggggagtttttggagaagttgatgtactcatctgaattaacctaattttaacgtgaatcccaaacatgggaatgtgtacctatccaggtttatagtcattcagaatttacttaacactcagaaagtttgagtttgactttctggtgtggggaagtctcagttatcttttayagcagtaccttgtttatcctgatattctttaagctaatgtttcataagaagttagacatctttcttctttcatgtgtaattatttcagggtttcaggacttaagattcttgaaagtatgggtgtattccatagataatctattttatttcaattattttgtaaaactttcaactctcatttggatctttgaagatttagaaatgtaagcaagtctgaaacaatatacaaagaataagtataaactcaatgaaaatacacttatccaagcaatattgcaatataaaatatatgcttcaagtggtgtaaaagtgtttgcacttagaaaatatatttaaactgtttgtcctcataaatttatgtcttcggccttcayatttatctcccaggagtgtcggttttatttgtattttaataagaaaattataataaaaacttggggtttcattttaggtgaggtttttgtatttgggtttgtttttctacagtagagtttaatccatgtgttgcttttcttcaagtatagtttaaaggagtacatttggaacgtgtttttggaaaaagcatgttaatgtagcagaagagacttcagtgcacactttcgaagaaaaacagtttctgagcattaagtggtaaaaggcaataataattcaaatgatgataacaagccaacctgctaaaaagaatgcatgttctgtgtatccagccatttcacatgaactaaccccatttaaaagaatacattttccattcactgtgcacatatgtgtaatcatttttgactaaaatcaattgccattatcatgccaactaaatctgcagtagaatatattagttgccagatacagtacaaaaaatatcatttaagagtaatcgtgattgaatcccagaaatgaatagatgcaatttgtaacaattagttataatgccaagaaacactccagagagtaaagttaatgttaatttttatatgtagtaactctaaattgctatggtaaagcctataatatggtagcaatatggggcgttttatgctaaaatacacgcaaacattagagacgagcctaactgcttttcttactttcctgaatatggtaggacctgatcgctgcaaaatgaacccgtgccttaacggaggcacctgttatcctactgaaacttcctacgtatgcacctgtgtgccaggatacagcggagaccagtgtgaacttggtaagayggtacttggctgaaaaggtgcagttctttcacagaagatatattgggggagaatttatgttgtcgaatcaatcagagatttcaaagaaacccatatgaagattaattatatgttaaatgaagttaaaatctgagggtaattaactaggggctggaaaatgggtacagatattcagtgaattctgttaacgtaaccaagactcagtgaggcctgctgagtcttcttgtgttttttacaggtagaatttacaaatgtaaaaatgcataaatattaacaaaaatgtacatytatcccccaaatctgcatataaataaaaatcaatttcagtataaaaatctttttagaaagctagacttaaaaattaggaaaataataaaagttagagagctttgtccttagttttgggataatttttcttctcatttggaatgggaaagacccttccctgactcccagcaaccagcccaacgtgcctcggcctcagggagctgtgcaattgcwgttccctgcctctcttttggttccaaggaatataattgaccctcacactcccatattcttatttaggcatccttctctttaaagaaaaaaaaaaaggcaccagtgttgatttggctacatatagacctcacttctgagaaaagaatgatgaaatatgttgtccagatgtcccttttagagatatcatgaaggtttgcttaatttgcttacaatgattgagtaaagaaagctcaccaatarcactttaaattatacatcaatattgcgatacaatcccaacattcatattaaaagagtacttaaaaaaagtcaacgaggccagcgcggtggttcaagcctataaccccagcactttgggagggcgaggtgggcgaatcgcttgatcccagaagttcgagaccagcctgggcaacatggcagaacctcacctctgcaaaaaaaaaaaaaaattaaccgtgcctgtagtcccagctacttgggaggctgaggtggaaagattgcttaagcccagaaggtcgaggctgcagtgagctgtgttcacgctactgcactccaggctgggtgacaaagtgtctggcactcagcaagcaccataaacatgtttggtattattactatataatatcatgtttactaagaccatttctttaggtaagaatacattatatgactaagaaatttaacttgctttgtatattcatttaaaaatattcttaaacattaaatttttagtgtaattgcaaaatgctatggaaataaagtcactaatttcatcaggggagatcatatgtagaaagattagaatctgtgtagaaagattttatttgacatagattttaaagttgggaagatttgacaggtggtggagggagatatggacacaacaaacaaaagcacagaggccaaaaactacagaaggcatttgaatgacagcctcgatccaggtatgcctacttaggggtttgggagagggagacgtattgggagacagtaccagaaggcaggttgggtctagaaagccctgacagtctaagaaggtcctgagttcaggatactgaatagtgttacttcacactctagtcaagtgattctgagaccttagcatgcatcagagggctggtaaaacagattgttgtctccacctcaaagtatgtgattcagtagatttggggtggaattggaattgtggatttttaacattcttaggtgatgctgatgttgtttgtggtccagggagctcacgttgaagactgctgccctgggcaattgggatccatggaatgtttggaagtaaaagaataaaattatcatgactgtgtctaaaaaagatgacatttagcagagtgatggatatattggagaggaaagggcctagggatggtgaggccagttagatactttgagtagtccatgtgtgaggtaatcagagaatgagccatgattggaggtgggaaggctggggstgttgattcttcattcgttttagggcttatctgattcatttatcagcaatggagacaatggccctactctgaatacctttgacattttcttagggttgccaaatttaggaaataacaattcaggatggccacttatatttgagtttcaagtaaaaacgaaataactttgtagtataggtttgccctaaatatggcacggacatacttatgctaacaaattatactttttttaaaatctgaaattcaaatttaactggctgtcttgtatgttatcttgcaacctcacactaaatggaattctttgatactttttgaaagtattttgtgagcttttactattttgtttcagattttgatgaatgtcactctaatccctgtcgtaatggagccacttgtgttgatggttttaacacattcaggtgcctctgccttccaagttatgttggtgcactttgtgagcaaggtaagagctattgcaacatttgtatgatgaacattattgatttttttttagcaattttggcctcaatgcataatctttcctgcagtggaaattcacatttccttaggtttccttattcagggatagctcaaaacatctgaatcatagtgttgacttgattatggttgtttagctgatagattggaattgcaggcaggcaaactgagctgaatttaaagacatccagccaataaaaggaatattatcgtatgtatttttcttggggacaaactaagcactgaccttactgtggctcatgtacgaaggagtactgaattcaatattagctgtttttattttctcctcctaagcacttgagactcaatggacttatttttcatagtcaatcatatctggagaatgagttgatakagttgttagaatacatttgctttggcacatgctaagtagaagatattgtgaatctgctcaccaggaaattttcctactaaagaaggattgactttttctgaatgaaagaaagccctatgttcatgatggcttgaatctcatgatccctgtaatttgcattttacggccaacctgagggtgtattttaggtggttaatgggagcatttcttggtccatcaataagaaacagattgcatgctaagcacactcagctttggaatgtcgatttcctctacttaaactcgtacagtggtttggctttgataaaagtgttcagtgccaaacttccattccaccagacaaactgaaaatgcattagacactcaggcacattggtctggtcccacattctgcttcatggtgttaatctggaygtcactgcgatgaatgcaaatccaaaaggagcatgtattgaattgctgttccaagtggatggatgatggctacatttttaggtgttggtttttttctttttttattgcatagggtaaatctgtttgttttagattttgaatataaagatagaccaagcaagatcctcttcttaaagtaaaaacattagaaagatggcatttgttgaagaaaacaaaagcctgagacagttgagacattccaatatgttaaacatgattctggcttctgttagttccaagtacaagaagcaattcaaaaaatcgttttttcaatgtgcatttactgtcttccaggcactgttctgggcattggagatagaaatatgaacaaaacaaagtctctgatcctggtgacttagcataactcttggcagagaataaaatttagttctttacagactatcaaatgcatcctggcacattgtttcatttggttggcatagcatttctatgcattcagtgggctagaaattaaggctcagagaaaaaaagtgatgtgtttaatgtcacacagctagtaaatcgtacaatgggaaaagtgaamctaaatggcttaactctacagcccaagtttctctgaatatcttcacacttctaaagtaactctcaaagataaacactttatttatatgtttatctgatgsatkgagtggcaacagatttttggaagggactttggtgccattgaccttttctctttcttttcaaaagaatattgaaaktaaaaagtgttaattaattttatttctggtgccacctgactttcaggtactttttattgtattttcaagcaagtttgattttcatgcacatttttttgctgagaaacatcgatctcagtctgtttacgcagtgcagctgtgctcctgtgatttattgccaggatactgaaagatttttttcctcttttcaggttgcctaagaacaaatgttttcttcattaacagcagctttgttgtctaaacaattttctatccaaagtttggtgatgaccgtgtcagtgttccttcagctgacgttttctgttctctgactagtaacttcccaagtcacagttactccgaaataggggacacattttggtgcaataattacagatacaaaatctagaaagggctattggaacagtagagaggcagttctggctgcacaaactgccctwgccaaagtcagtgatacagcttgcctagtgagaagtgtggaggatgggcactttcttaggactygacagctatatgtcagagaggttgaaaacattacctgtacagcatcaaaagaataaatttttggtgaatttgtttgtgatagtttcaccttctatgttcatgaacaggagctgtgcacactacaaatctgggtttgtattgtaacccattgaaacaacctatttttttgtaacctctttaaaacctataggagttttaaagcataagatgtctttccatgcattgaatgatttttaagaaaatgtcatccacaaaggttgccttttaataaataaaaagagtttcacataatttttaggtaaggttgaaaaaacaaatagactatttctatgaatagtatctcctatcagaatagcatcctgggagatgcagcttgacaaatgatccttcattacatatttgttgaattcatgaataataaaatttaagtggccaggcatggtggctyacgcctstaatcccagcactttgggaggtcaaggcgggcggatcacctgaggtcagaagttcgagaccagcctggccaacatggcgaaaccccatctctactaaaagtacaaaaattagccgggtgtggtggcgggtgcctgtaatctcagctaatcaggaggcagaggcaggagaatagcttgaacctgggaggcagaggttgcagtgagcagagatcatgccaccgcactccagcctgggtgacaagagtgagactccatctcaaaaaaaaaaaaaaaaaaaaagtgaatcaatgtggatagttggctttgttttttttttttttacacaaaaaccactctaagtggtttttgcagatatatttatartcattgggaagctatgatttagatagtacaaataaatgcattttcccagtttggttttaacagaaaccccgcctctattttttggacctgtgttctgattggaatgtatgcatctgctaactgagacaggcactgttagtagtgaagtggtcacatatctaaattttgtgatcatctgggttttcttgtttaggaggaaaaatacttaatgataaactatttagaagacaaaaaggggctgggtgcgatagctcacgcctataatcccagcactctgggaggccaaggcaggtggatcacctgaggtcaggtgttcaagaccagcctgggcaacatggtgaaagcctgtctccaccaaaaaatacaaaaattagccaggcatggtggtgcacgcctgtagtcccagctactagggaggctgaggcaggagactcrcttgaacccgagaagcagaggtygcagtgagccaagatcatgccactgcactccagcctgggtgacaaagcgagactccaccacaaaaaaaataaaaaataaaaaagacaaaaaaggggaaaccaaactaaaaccaattgggttaatagcagataaaaaagggtatgtagaaaagttttttctgatgtattattcaaggggttaagatcctccataattttacatcatgtatcttaaattaatgtccatggttaaggaaagttatgccattataaatcacattatttactttggcagtaagaatgttctaaaagtttttttgattctcctcctctgtaaactaaccccctcatataggaagagctgtgttcttcctagccctctcaccttacctctaaattcttacaaatgaacttccccaaagcagaaatactacatccaagtagccaaaatttgcttcattttgaggcactgagtgctacttttataccaaaccatctagctgtgtcttgagtcctttcctatgagacttggtgatctccaaacaacactttaataaacgcaaagcttccagtgcacattactcaaaagaattagtcagctggctgcaactaaacaacaggcctgatagactaaactgaaataaatactgctctcagataagctgcatctgttgtgtgagtatggttttaatcactgaagccaggaaagaaatgaaatctttcagaattcatactttcccacagttatagaaagaggagtaacaggaataagagtcaagagacaatctgagtttcaatttggccaccaaaactaacgtataaagcaaacatttatttaatttagtagggttgtgttttcttctattaatcagcaaatttgggtggggggagatacttactaggtcatctggaaggttttgttggtgcctgaaattctataaactgcagttttgttagtttttacatgtaactacttcaatataattgtggggtgtattttgtgaaagtcaaccccacctgtggatgagcaattctgtgggaagattgccaatgaagaatacagtgctatgaacaatgccactttcttgtggaattatgtaaaaattggcaacctagaaagtgtagctgatactgccagtgtaaaatttagatatatttgaaaaatattattgtcccactggaatatcagttatagtgtgcttattgtgaaacacacacacagacacacacacacacatatgtatatgacctggtggaatgggggggtgagttaaataatttaatttatttcatttttaataaacttaaaatcttgatgcattttcattgggcrttacctatcttacccttctttttaggaagaaggcatacagttctagctrtatcccaaaacrtacctattcataaaggatttttttctctttgtcagttttacatgacaagagcctgtgacttctcagatatctctttgggaaatgggagaggactacttccagaacctttgaagttgttatgcaaatagggcattcataattctattagccggaactcttatctatcacttgaatgagtctcttagaaaagttgtgttggtaaggaattagccccagttgcttcacaagtaagtcagccagtgctatagcagcccaagagattttggctggcccctcttccagttttctctggctttaatcaaggaagttgctgttagatgctgcctttgcaatccaaagatatatagccatccacttggcacgaatcagttgggctcacttcataataatttctttgtcatcgtgaccaaattttatgaatcagttacttcagggacattgcacagatactggcttgggtatcctactaacacttggttgggggtgccaagtttgaatgacgtatgtgcgtttaataagctcctgcctgtttcttctcagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtatgtaccaaatagatacgagtttccaggaacttcacttctcatcactctcttagttttgtctgtgtgcaagtgaaaagaagtagctttttcaatcataatacaacttatcaaatccctcatctgtgaattacttaaaatcatctcacctatgttaagtcccccatttggggaaacattcaactataatataggtaggcattggtttgtctgccagcartaatagttgaaacacttgctgtaggttgaatcataagcagttgctatttgatcatttttaaatatacaaaaacagctatttcttatggctcaatagaattcttactatggttayactttcatagtctctattttgaatatttatatgcctgtctaaaattacagttgttttcagttatttttgtcctgctaattaaaattgaattgttaataatagcaccctaatcttaccttttgggcatattgattctcattcaagtttctaaatattttaaattgtggaaagtgagctacatcctaagaacttgaataggtggagattgaaagctaatgaaacttaatatcagagctgtttaataactccttcaactgcagcaraaaggagggcaactagttttcatgtagcaatatgyagaaatttgttgctcataaagcattttcttaagaggtagtgtcttgccatgctgtccaggcttgacttgaactactggcctcaagtaatcctcccacctctgcttcccaaagtgctgggatcataggcgtgagccaccattcccagcctcatgaagcgttgtttgatgttctattaaatattttctcgtgatgcctactatcgtttagaagtttgttaatttgtaatctggatagaggttcatttaactttactgcgtgatatccttgccagtgactcacctcatggtaaaagtaaatatttttgaggataaatctgtagaactgtctaatctaggtgttcactaattaaaatgttttgaaaaaaaggaacaagtggcttccaaaatgagggtagcgtggataagatctggcacattttattgggtcactgaatttttgccaatggcatcgcttaaaaacaacaacaamaaaaaaatagaaaatttctatcataaaaaaaagaaaatttctatcatgagtgagggtgggaaaaaatttaattatagtaaattgctaggggaattattgtctatgtcttgatattttaatgcttcacagggtttgcacattaacyttttcatttaaagcacattgggcagaagaacaaaaggtagactrggagagatttttatgagcaactaaataaaaatccagccagtaaagaggatgcatgattcatgctgaaaataattttctttgatatattttcatccatatatggaaaagtagtacaaatatctgtgtggtttcctatcccttaggtgtgggccatgattatcagtggataggcctcaatgacaagatgtttgagcatgacttccgttggactgatggcagcacactggtaagatgcccttgaaaatgatgtcaagttctaccttctggaaatttggtactgtgcactgattgtgcattacagagggtgcattagactggaggcaagttaaatgacttgctcaaggtcactcagtgaaacagagaagggttagaagagttccaagctacctgatccaacatccagtcctctcttcaatagttgtggttctcttcaaaagaggagtgtaccagatttctatcaaaccagaaaaccagacaattagtagaattgccttgggtctgtctttcagatggttatctttgctttttctagcttcagagcaaaaagagaagaataaaatgtagcagaaaaagtcattttaaaaaaatacctttccgtcttaaataattcactggaaatccgctataaggcatgactcatttccaagcaaaaatatccatttatttttatcttaaagaagactgttgatatgatcttgtgaatttctgccaactaattacatatttcaacttgttttctattttttgaagaaagaagtgacttggaaatgctggccacaactttgagtagactgtaataggttcttagaacaggtgaagctgttttgagtcactcttactaaactcaaataaatctaatttttataaagagttcaaatatgattgtctatactagtggtactcagtgctggctgttcattagaatcacctggaatatgtaattaaaaactggtgcttaggccttatcccaggtccattacagcaaaacctctagccgctgtattttctcagtgttccacaggtaattcttaaacgcaaagttgggatccactgggctagatagtaagtgtaaattaaattctaaattagaaacaaagtgtaaaatattgaagataattttaaaggcctttttgtgtttttattacttaggtattcagtttcattcattatctgccacttgtttggattcaatgagtttggcaaaatataaaattcattcaaaaacagatgtcaaagtaatctctgcttttggaagttctgctctgtcttaagagaagctgctccatcatggacacactactcactttatctatgtgccagccactgtattaagcacttgcttatgtttattccccacaataacttttaagagaggcaatgggttttccttcacctgttttacaggtaaagaaagggaaggtcagttaggttgagctatttgcctggaatcacaaagctgttaactgatgaagccagaatttgaacttaggcttgtctccaaagccacagtttcttctgaccggtacctcctcggctttaaaaagagtgtatcccttgttacattttcgctttgagcaacccaaaataagacctgagtttctctctctgtcaccactgtttatgtttaatcagcactgtttcactgtttgtcattcaagttcttaagtaggttatttggcaagatgtgagaaaaatagggaaaaataggttgttcttaaaatatgttcccagtaagcaataggaaacacaaccttagaatcaataggctcatcttcttctattaataattgtcctggctggatgtattggatctgtatctgcaattgttgcctctttatgttttcattttgctgtacttagggggataatactggcctattagattwatagcrattggtatagcatgaatctttatattacattaattttaattgaagataattttgwtcctattaatttaatttctaagtgaacatatgattcagagattgtttctatatattataagctgtttttataattttattaatgtatatcatacagtgaatgcatttaatgagttttccttgttaaatgtgtacttcattctcatggaatacattgggttttagggtgcccactattaagtctacctcccacgaatttcccttatttatagcccagtgaaaagtgcagggttttgtgagcccccatcatgtatacagaagctggcatgcccaggactcagctggccatttctatctagttactgcttatttgtgcctggcagatgcagcycatgacttatcccaaagtgtacctgttgtctgggttcctgtagattccagccctgagcctagaatagctgcatttggccaggtggagtgtacgaaaaatctttttttcctacacacttacctgactgaaccaagtcccatctatttctaatctgtcattggttacatagatttgatgtgtgtgtttttattcttagcatgtatgtgtgttactagatgtttattctggtctctcccttagcagttcacctcttcaaagaagtaattctttcccctgctttttatttctcgtggtgtctgarataaagtgttatcctttattcctgtgtgcttggttaaagagacttcatattggcctatatctggcagctatgtggattctgtagagtatcttaggaaaattatcttccctgccaagtgccatacaggtgagcttgattcatcatatgtcattattcccctatgccaaagcaaggcaactcaactagtttttgtctgtgtccattaatttttaatgtaggtacacaaatactctgaaaaacataacagtgactatttccatagtctagaaaggtcctaaacgtggtaaattagtgagcatcgcaccttgtcaaaaaagaaatattgatttccctctgaaattttgctctgaaacttccagaggaagataacataagctaacatagataactgtacaacataaacaagaaccctactcttaattagttggcactttcacttgaaacgtaaggattatggagaatgcactgagggcctcagtttgaagaagacacatgatgaaatgtattaacaagcaaagtttatcaaagaaatgacacaagtaaatccagaaaaaactctgacagaccctcggtttcttcttaattcactctctgtgtaaaataaaagtgtgctaaggaatgtcccttaactttgaaaatactggaacagaacagaccatctgtcttagagccggtctccctcgcattcaactgatctcctgcccactttcttgcttttgtaaccaccctttcctctatccttttcctctctgaaacagcctaggtgtcccttaaactcgtttgtagttttttctacagtcaccatccccttaacgggttccatatgtgtgcaggcctttgaataaaatccttctgctttgtttcgctgtttactccaaggtttttgcttttgaaaatatccctaacagtaaagtcttggtcagggggatcagtatctgcttatacttggaatggtgttaacttgactgtgtgcagttttaaggactttgtttatgttttggagtgatttctctcctcttccacaccctctctatctccatttttttctttgaaagatttattagagcttctccgtcttgggtggtagaacagtattaaaacaaaaagaacctttcatatttaccttaaagtgtcttttgatatttagccttacaatccagtaagaagaaacaagtttatattaggtctcaatttcaatgatccattttactcaaataattaaactttgctttcaataaacttacagtataaatgtatcatatttaatgttatgctatacagctagactaattcaactagtatactaaattaatgatgttatttggctaagttatctaaattgcccttattcttgagattctgatggattcattccacattactggcctctataataggatgttgttatcattgatgaaatgccaaattctcatttctgttatatttttaaaatctattactttttttatttggggtgtttgcccaataaatttcacaaaagtgaattcatgaataaaattgtgcctagccttacccttgtgatttatattaagattatttcttttaatacatttcagtttttactttgtcacttggctttctcctaacctagttrttctttaacttgactattgttaacttgacgattgttctctatagcaaaatgtgcctactgctttattggaaaccctaacaaataacttcactaatgaattgctttgcttgtcacccaagtaatatcttcaaagacactcagttaaaccatccaagttaaatatacattaaagctggcaaacttaaacaaacttttcttatctagcttatatactgttagctgactttaaagttctttcttaaaccaactgttaaatgaatgactagtcagagtgttttctttcagatctgttttccagtgctaatgacctttcccttccctggctatgaactcttgtcgctcccttaaaattcttcagtgtctgctcattgccttcagtataaaatgttaattattagtatggcagacaaaaccaatccactccgtctgccacttcctragctatagcatctcaaaatactctcagctcctggaataagccatgggttctcactcctgggcggctttgcctgtactggccctagtgtttagcatattctcacgtcttatcctcatttcatctcacaaacagtcaaataccctgcatagccaagggtctccttccaggaagccttccttgctgggaatgactaagagctcctcttctgtgctcccacatcttttttgtcctccacccatcctaactcaggctcctgtgaaatcaacttcctgacactgagtcttctgagataggaattaactttcgtctctgttttttcagcaactagcagagtagttgacatagaacaggtatttaataaatatttgaatgaacaaatgatcatcagtatacacacattgctcagccaactctatcttttgaatcctgaaatgaacacattatgtctttcagctgaatctctttgtgacattttttgcctaaattaaagattttatttaaagttgtaccagtatgaaaaacatcaaaacataatagatgggttttacggtgaaaagaccaaaaaaaaaaaaagatattccttaaaaatagaagtatatagttgaacatactgcatcttataaatgtatcaacccaaaggaaaacaagtgtttttactagaaatgatgacaattttgtccatggttgtcctagaaacacctttgcaataaactttgggaattaaaaatggaaagtaaactttcaacctctgccacccctgcaggtttgagttatatcagggcaggttttccatgaaactttaagaaaccaacaattactcaaaactttggaggaggatttttttttccagataggcacatattccgtaggtatactttctgaagaaaaatgagttttagaaaccttattatttatatccaaaatggagtgaaacaaacaaaaggaaatatcactcccaaatattatcagctcattttactttttatagatgctttggctaagggtgatttggttgcataaggtgggatagggcttcatttgtaaatccactatctgaggctgtttattsaagtgcagaggaagccagacaggcagggaacgttatggaatcatttatatttatctgtcagtatacctcctggcaaaatgattttcacaacactgttttcaactaaagactatagtgtctatgggacagcccaattaaggagctatcagaaactcttacatgctttcatcatactgttctgtctgayaaacctctccaacaagtggtttaaaatcaaattgtggagctcagagatttaaagctgtcatattgcttccttctctcttggaccctctggagtaagattctcacgaggcgattctctgggctccacattgttcctttcttcaatgattccccccagcaccatcaaagctgacccttccccactggacactggtrtcttcagtggatcagacgcatttacttcaaagggaaccatcactttagatggccatgtatagaggccgaggactgaataaaactgacattgccattccatttttaaaatattggggagtttttggaatatttagtttgttctgcagaaaaagccctgactttattcctaaacattttaaaaaacattttctgcatctccttcactttttttacttctgtcatctctacattgtcaggactcaaatgtcacaccccgtgaggctgctggcttccctgcttcctgggaaattatcacagcttcyttcttctcactttccattctacagttgggagaaaacagagagactttctctcttctacatttgtccaaatctggtcaggaagttctagaacaagttactaaatcacagattcataaatatcttattttctagctctaaccaactcatcttgctatgatagttgtgatataaactaaaaaaaaamctaattgataggacaattagtacaattaattgtacaattaaccttcattacttaaattcttcttaaaaatatttctggaagataactcaattttgcattttgtttttcattttggtaagcatagttcagctttggcaacttaatacctacaatttccaacacccacttgtcccccttcaccagttgattcgagttgatgcacaagaatgtccagatgtgtggatttgactttaaatccagaggctccttcttcttctttcataaataaacacatcagtctgtcaagcaaagtattgtgagaaaagccagctttgaaaaaggtagaaacaataaagaaatagcccttacccaggaagagacacttaaaaggggcagaaaaaatggagtaacaaatcacggaccataaaccattattgtttttctgcagcaatgtatcattattaccctttcataaacacaaaggttcttattccccttcctctcccagatgtcttggacattgaaaagagaatacggagtattcattaattccagtgctttctaagcttgttgtagatttctgctcatttgaaaggatttcacatgatttgacagaaaaacaatgcaaaacacaatccccacaacaaaaatttaagttttccttttcctacctgaagatcttagaagacttyctatacaacatttgcagatggatgtatgtcagctgtgatgtggcattagctctaagtcaaataccatttctctgtgaacaagtcacactgcatatcaacattaatttaattatgttaaacttcacaggctttattgtattaatscaaaagccaaggaaaacatgctcttttctcatyctttaacacattactcatgagtggaagaattctcagattcccttctgtgaaagactactgagttcttaatgaaaattttgacttktgttgtagtttaatttgatttggaatcaagaactgattcttctgattctaaatgtgagatattatgagtcatagagtagttctagaacgcaactctgctctctgccttgtctttcagttcagatagctagtggtgggttgaacagctggaagaaccatatttactcactactggaaaatcattttataattgacaagattattataaagaataagaaaaggagatttagtgcagtagcatctcacagatgcttttccaacagtcttctgtgcaactttaaaatctcatgcagatatttaaatctaattgctaattagtttaaggcaatgcataaccatggaaaaggccaaaaaaaaaaatatattgaatgagctttggcagtctctccttacatttggatcgtcagcccttcatgactggagacctgtgcaaataagcttggggtaaaggagcctactggcaccattcattctatggattaaatgcaagttgctctctgggcctctgcctgaggccccctctctcacagtggtctcacagtgcgagtaactcacatccttctgaaaatgctgttgataattgctgctttgtagggcagtgagctcacactattacacaagattagtgctgttctcaagagctggccagattgtctttcccgcacagaggtttgccagctaggaaaataatgggcrtattgccactttaacaactatcaggagaccccaagttagtttttcttcccttcagcatattcatgtttgtaggatccaactccaggctgccagcatagggtagtgacaccaaaacaaacgtctctttctcctttaaaacaaagctgctcttttcttttcagttgtcggtcaaygaattaccctgttcaactaaaagacagcagcaaaaccataacctcccttaaaacataaataaakaaggacccagactagactaaccttaagcaagtacaaggatcagaagaaggtttatctttaccttgcagggaagtcatttgcccctaacaaacaagacaaagttaaatgcaccactccccctccagactgcaaacaaatgcctattgtgtacaccagccatctagggataaaaaagtcattttaaaggtaccaaatgttttgatttctgtaataagtagtcctcatagcctcttttcagataaccatttgacctgtgttctgaaaggctgaggctaaccccaagtggttattctgtttgttatttagtgaaaagatggtttcttatcggcatatgtttcaaacaggtacctgtcctcttgggaaagtgttttctgtttggaatttgctttcctacttcggtggttatctgcttgcccttgrtatccagtgcgtttggattgaattttgtagctctgggagtacagcagtggcaatatgggccccaggtgatgaaaagagtttgcgcacaaagaagtcagctcttactgcaggtgtcatgttttcatagctaatctagataaatttttacggaaaaacaaactaactgtgactcacgctgcagacattgcatttgtgtgcttaggtgtttatctatgatctgacctctcctaaggatwttaggtggatgttgcacatttggctttggttctgatgcaatttcaccattgatgtaaatcatcggataattttaaaagacagagtggaaaagaagaaactaccgtaggtgaacattttagacagaaagaaaattcagattatggatagaatggcttgcaacagaatagaatgcagtcaggttggtaaatactggttcaccgaggtctgtcttcttgcaaagtgttctctttgtgttttcactcacaaaactgagagaacatatcccagacaatcttttattttttatttttatttttttatttttgccacatggagtacataattacgattttgggggacatattccaagttctcttttgttaagtggtgtagccgttaattcataatgtaagaatggatatatatcaccacctagtggtcgtattgtattttgtgtttcaaaaccacattcacagaactacacccagatacacacaagaataatactatctgtaaatcaagttcctgtagttttgaatagtttcttaattctagtataaattgcatgatactgtgatcctgaaagttaaatgtgaaatgagaggatttttcaaatgcagcatgaagctaacacatgtagtcaaatrcttagtaaaatcctagcaactaaggcaaatattaggacctatctgtcctgtgttttcactttatacacaatagtagaaygctggagaaagttttctttggctagtttccttgggaggtgaacagagagggcttttgyagggttttttagatgtttttttttttttcactgtgaactaaattagcaatgtttggaggaaaacagagtaagtgaagagcagtgactgaaccgttcaagagaaaaactcccaaattatagtttgaagttcagtaagttctcccaacaattaaaataatgtattgtgaatggcttgactacacacatgtcaagaatggtttttctcaaagggatgtgcttggcaaaattcataaaatctataaaacatcatctttaattggccatttaaggtaatctaaactatggcgaattttaaaaaacaaaaggtgactgcacctaagctgaaaaattatagataatatatggatagatagagagagagagttggaaagtaggcccttggcagttacagattcaagatttgccgccccagttatacatgagatcctgaaggtctgcagtatgaaaacatttgtactttttgctcaggcacaaatttgaactgtacccaatgactggctagtgtgtaaaaactctcagtgagctctcaagtctgtgtattggacagctcagttttcccatcacaagaagtaggttgctgtctactctgctgaccattttgtttgttctctactgtatttatggcaggaaattatctgctacacagatgtgtatgaatggaagcattaccaagtcttaggtcttaggcacttctttaatgccaagaagtattgtatgtgtaagggtgtgtgtgtgtgtgtgtgtgtgtgtgtgtgtatgtgtgagagagagacagagtctcaaatttatgactcacaaaaatatgaacttgaattttgtctagtgtctatgaaaattctgtctctttttatttatattgtatgatttagaagccagtagagaggaaaagaaatagaaagattctaaacagkgtctgactcttctagagaaccagtgctcattgattattctttgtagttatttgaccaagttagagaatctcagtgaaaatgacttgaaatgggttgagtattataaagaaaccctagttattgattaggttttgataagaacgattgctcttaaaacttcttagtcttttgctcatagatgaatttgcttctgtatgtgatgtgcagggatcagctgggacttgactgtgacagcagtaactgatactggatggtctggtttcctttcttcaactgaaagtagtactaaagatgaacccaagaaaactcattttttaacacaaggaaaaaaaaaacctcctggtttatttctaagtcttatctatttctgaaaaactgcttttttttttcttttttttttgagacggtgtctcactcttgttgcccaggctggagtgcaatggcgtgatctttgctcactgcaacctccgcctcccgggttcaagtgattctcctgcctcagccttccgaggaattacaggtgcctgccaccatgcctggccaattttttttatttttagtagagacaggatttcatcaccatgttggccaggctggtcttgaactcccgacctcaggtgatccaactgcctcagcctcccaaaatgctgggattgtagtcgtgagccaccacacctggccctgaaaaactgcttttttaacctttgcaaaaaggcagttatccatcactgcataaggaaaagggctattagtgtacattacatttttatcatcagtttgttttgttcatgcttgtgatgctagttatctgctgagattttaggtcatygatcatggccacctggtgtgtgttttaaatgataaaagatatctctgaatgacagttgggayttcctagacactatgtaatcagaaattcaccttgaacagtgtaaaccccatctgaatttggtagattgttggtaactttcaaaagcagagacctctccccacccaccatcatctttttttttcctggtatgttgactgaattaagttggagactttgcaaagaactgggaaggagagaaatagctctccaaccattctgagtgagaaaaatagtcaaatcactctgagatacatggaattgaggtcactctctgagggttaaggatgctggcatgcacagaagtcatgtgcactgcagaagacctgcaggatgagtcttctcttttgtgttattgtgagacagaaataaatttttgacaagtacagattatttggaacaaaataatcgaaacatttagagttcgatagacttcaatgaatagcttcagtctgctctgagttttcaccctgttaggaatggttcacaatgagttctctagtttgtgaagagaaacatacttattagctgttagattttgtccagggttttttgaatcattttattattttggcagctgatttgcttgaattcaattaggggaaaaagaaagaaaaacaataactgaaaagtgactgattccagcttaatcraaatggtagccctttttggcatgttattacagacctggagaactagttatttaattggactctaaaaataaagcaattttatcatatattatccagcattaagcagttatatactagatataaaataattatctcttaataaaatgcaagaaaaatttacatctgagttggctttcctctacatcaactatttgcgtttttgtttgtttgtttgttttgagacggagtctcacctgaccccctaggctggagtgcaatggtgcgatcttggctcactgcaacctccacctcccaggttcaagtgattttcctgcctcagcctcccgagtagctgggattacaggtggctgccactacgtccggctaattttttgtatttttagtagasacgggggtttcactatgttggccaggctgstctcgaactcctgacctcgtgatccacccgcctcagcctcccaaagtgctgggataacaggcatgagacactgcacccggcaactctttgatttttatgtcacaatttcctctgccatcagaagagagtgaaaatgcaaagtaattttagggttctctttcaggtgtagtagtgatctaattcttgtccctggggaggcaacaagcgtttgaggtgtgttgcatgaacttgagtccctgaggcacagacaaacatgcaggggaatgaccagcatttatttttccctaaggggttaaaatgaatttccccaacccatgctggcttctgggaataattcttagtttgcacattcagctctagaagagggttgatccaagatagatcgctcaggatgtttgctcataattcaaagtgaaaaataaagaaatccaaatgggaggtactgagtttttccctgctaattccaagaatctgtattcctgtatatatgagacaccatattgtgcaagaagatctattaccttcttataacttagaattgattccctgagaagggatttcttcttaacatttaactttagtgaaaagaaaagtacgttattgaagctaaagytaattttttttttatattttctccctacaagtaatgttaaataaggctgtaaagaattcagaaagacacaaaggaagttgttaagaaaactggagttttctttgctaagtcagtttggcaataacatgaagcaaaatcaaagcatcctagccaagataaatctgcacaatggaatgatcagatatgaggtaatagtgtgacatgcctgtgggtatcagacattcttgtaaaaaccacagagctaaaatttggtactgcaccattaaactacagctctgccaagcaacaacaggaacactcattttaagtcattgctgcaagccaaatgtaattctcacccaaaacaattaaatcttttaacagaggcctgaatctgggcagtttgagccccgagaatcactttagtggcatggagtccgaatctcatttcagtgtgaaaatgagatggttattgttcagatcaggaggaagtgtcagctgcaaaatatagggcagtcaagtgactttagtaacttgmggtgatatttgttaagattagatttaaaaagggttagttaagaaatttgtattttttgtgagaaatgcacatatcattttataaagttcatttttagcaattagaaaaataatgctcactctagagaacttggaaaatatcataagtaagaatatatagaataaaatattatctcagtctcatatcactcagacataaactctggaagattttattgcatttgcttttggtcttttatatatacacacacacacgcaaacacaaacacacacacatacatccatacacccagctgtatctgagagtatgagtaaaatttggatcattataatgtaataatttaacacttgttttactaccccccatttctttatttattcttcaaagaaaattttaaatggtgatataatattctatttgtctggctatatcataatttattgaacatatgtttactctataaattgttttccctttactgctaataaacgtagtatttcatataaaatgtcattcacatctgtgattattttttagtatagaattttagaagtggaattttggggtccaaaagcaagaactttttgaggctcctgatatgcattgccacctgttttccagaaaggttatttacttccactggctatgtctgtaattgtctgtctcacctatttgctagcagcaagcaggatctttgattaggtattggtgtgggttgggaagaatgaaacaccctctgtggttcattgtctctaaatatcaaaaactatttattaaacaacataagtatgtgccaaacatagtttctggcactgaggatacagtaatgagcaaaagaaaccaaagccctgtcctcaatgaatttacattctactaggagaaaaaaatgyaattaatgagtaaattatgtaggatggtagaatatgataaatgttatgaagaaaaagaaattaagaaagggagatgggacagtgtaggtagggacaaaaaatgagagagtaatgcacagtgtacacatagtattaggatgttggaaaattttccacctttgaggacattactggtttcctgtaagagactagttggaaagtaagctagaaaatattgagctcctaaatccaaatttaatatttggcgaactctggaatctttgaccatagagagtaccaaatatagatttttgttagttttaatggattcttattctttggtttttaatttttatcctactttaactcattcattacaaacaacttagttctgtatcagcaacaggcagaacatgacatatctctgaaatgttgattatctattaaaggagagtatcaaaaatgtaaaaaggaggcttggcgagtggagggtgagggatgataagggaaatgagcaaagaaaaaaaaagggaaataattagaaacccagtgcagagccaatgtgagttcctggttgcagggagacctaccagtcaaggagtacttcagtgagtgtggtcccttgagcatcttttccaggccatttggagagtaacacagtggggccatttaggctacgagttggatttaaatttgcctcacttctggattaggtttttcccccgagaaataaaaccacccttcatgctgtattttgacaaaaaaacaacttccttaagggtctcttggttttttgcaagtttatcactcttcaaacagtcttttttacatagcagtgatctcttgtctcatatcttaattttggcaggattgaggaggactttaaagtaaagctaaaagactgaaacaaaagtaggttttcaaactttagatcttttcacaaattattttatgaaagatctaaattttttttaccatatttaaaagttttgaaaaccactttttctgagaagaaaaattacagacatcctctagtatattaattatactstttttgtttgtaaactagagcttattggtatacaaatccaatttcataggtaggagaataccttttaagttttttattgtgccaagtattagagatataaaacacagaagaaacatttggtattgaaaacactgcagatagctaagtatagtactttggtaaatacagtaaaatggatcagacatatattttaaaagacttaaaaatagtgatagtactgttgggagtaagtaggtagtagagtaattggaccttcccttttttttttttttaatttttgcattcactgatgctctgaattnaaaacaattgccttaaatcttatatacactttattctctttctctttgccaaataaattcacttaactcattgtctcaaaccataaacttattttaaacttaattcaaggaaagactaacagatctgtaggcccagaaaagacagtcatattagccattgtcacataaatctaaatctgtatttctagcatattttggaagtttgtcaccactaatgttgtcatactagacatgataaagcatgagagtagccaaagcatggtgggaaagtgatgctcaaattgacccagaaaggcgctgaacaaacaaacttgtctcataccacattctagttaagaggactcaagactaggaaactggtctcttatttataggccaatattattttcatcttatcaaagtttgttattcttgaataggcacagcgactatgttttttacataattattgttgccaggaaggcaatattttaagtaacaaagaaatgaacctaaaccggagagttctgggtgcataacatctctaaggtccaaataattccctattatgctgcattgttgtaagagacaatgcatatcaagtacctagaaaagggcttcatctattatagatgctaaataaatgacacatatgatggaaggcaaaagatattttcaattgtatattattgctcagagtaggatatatatatatacgtgtatatataaaggtaaccagcagagaaatgtcaaacccataaagtccttttcaatgatctcaacatacattacacacaaaaaaaatctgtaataagatatacttttgaaggtgtattttttatatcaatatgcataaatgtcataaatgtttctaytaaaaagaaaacatttcatattaaatcataaagcacaactcaactgtatggtgcaaataagaatcacatctaaaacaaactagctttgaaaggttgtatataaaatgattagcataggtatgtcagataaatacaaaagataaatattgcaactatctcaacttttttaaccaaatagatgaatttgggtgaaaagcaattacaataaatgagacaaagttactttatagtagtacagataagacaagacaggctgaaaattcgattgaggtatcatcacaattatataaatttatatgtgcacataagaggtagaakaaaacaatgattagagtgatgagattattttttctctagttctacttccattaattttattgaattaataatatgatgaaattcctaaattgaaggttgatgatatatttagaaatctagaataactaggccaaaatttgtccatgatatctcattgccaaatagtagacattcgttcaataaagactttgagacacatatattttctactcacagtttaacagtctttttctgtaccaccaaaataatttcagctatatgaaacaacagaaattgttgagtctattccaattagattgtgatataataccrtcgttgctcttacgttactttttgactagcaagtagttaccttctccctccatttttacagcaatacgagaattggagacccaaccagccagacagcttcttttctgctggagaagactgtgttgtaatcatttggcatgagaatggccagtggaatgatgttccctgcaattaccatctcacctatacgtgcaagaaaggaacaggtaatgatcaccctgttaataatgtgtacttaatcttcatttcaattataaagataattcaggaatttgtgtctcaaattcattgtttgagacacaaactggatatgtccatgtatgtcatctctcgttgctctggaatatttcactcttccaaaacaattgaaaagtttgttttcaacaatgttctcaccttagatttcaggtccttaagataacaatgtgacattaacgtrggaatgctgcctggtaatatctttaagaagaacaactgccagtccaaaggccaatagacctttttatttttwtttatttatttatttatttatttatttatttattattattattgttttttgagatggagtctcgctctgtcaccaggctggastacagtggtgtgatcttggctcacggcaacctcygcctctgggttcaagcaattctcctgcctcagcctcccaagtagctgggactacaggcgtgcaccatcacacccagctaatttttgtatttttagtagagatggggtttcaccgtgttagccaggatggtctcaatctcttgaccttgtaatctgccagcctcagcctcccaaagtgctgggattacaggcttgagccaccgctcctgaccgacttctttttttattttgatgagaacattacaaaataaaatagttgtcaacagttaaaaattaggctatattttttaaatctggattttcagcttttttaagaaataagaagacctggtaccatgtggcccatattcagatttgtcggtggtttgaagtactagagctgagaaccactgccctcccttggttggggctgcaatctccatttattgcagtcctcattgagtccttcctttgytttatgtgagtccgtgtcccaatcctgaaagacacaatcccaaatgccataatcctaaatgttgaaatctcaaaggattaaaatcccaaaaatagaattctggaaaaaaacaaattttaaagacatttatttacattttaaaatgatgatttattagagaaacatataaaaacatgacagcgtgcttcataagccactttagacaataaaataaatagacaataaaaacatacatatattttcaagcataagcactcaggtatactaatggcagttggggaaaaaccaaaatgtatgaatgcacatcactctggttgtaattgtgtgcaccagctttataacggtggtcatctgaaataccatgatgaacaacataaatcttttcacaagattgatgaagaactgagatgggttaccaccgcatattcagtcactcaaagagctgagatcttgagaaattttatctttcataaatggagatgtataaaagaacatctcttcatttattgaggaagtttcaatatttttatattgagaaccaaggaagctgaagccagtactgtaactctcagtctgagaccgaaagcctcaagacctggggggcctctggtgtgtaagtcctggaatccaaaggctagtgagcctggagttctgatgtccatggtggcagaagtctgtcccagctctcagagaaagaccagcttgccttctgtatctgttctctctgggcccctggctgattggatggtgcccatcaacaatgagggcagatcttccccacctcatccactcacgctgacacattaatcttctctagaaacactctsagacgtgccccaaataatgctctattaggtttctaggtattccttaatccagtcatgttgacacctaaaattaagtctacaggtctaccccttgcaacttggcacccatatgcatgtttttaaacmgtatttaaatttccaaataaagacaataacaaggtaatataataatttctcctgacatgatataactatcctgcatacaaccaaaaatgcactaatcccttccctagaatttggctttcaggatttcaacatttgggattttaatatttcagaattatgattttggggactttagatgttagggattttaacctctagggattttggtctttaggaatttcaaaatttgggattatgacttttgagattatgtcttttgggattrtaattgtcaccggtttttgccaactgcctggtctctgtaggcatttgagctttttaaccattcccttagaagtttattttatgcttataaactatggatcacaaatgccatccttatatctgtagttgaatatttacaagatataataaaataagaacatgtgtaatataaattttatgagaattgtttagttaacattaaacaagaaatattttaaaagcgaattttttaaaaggtgtgtttatcattggccaatttctaaagcacgctgtacagactttttccctaaacaaatagaaattctgtaaaatattttaacctatttgcaattaataatggtgttatcacatgaatatttaatccctagacccagacttttacccatctcaaataagagtacgaagtacacatgtaaaatataaacctatttgattaatttgtctttgaatacaaaaataataaaactaaaaaccatactctataaatattttaggaaagatttaaaccccaataatgagaaattctattagaagaaagagaacactaacatacatcaagcccgagtctcatatgaaagtcagctgttagcaataagtacgttagtctgctgttttctcacccaaggtagaatgtattctcaataccttttctacatgagaagctttcctgaccatgtcccttacttcagcacctctgcgatgagatttgtaaaactagcaaatcaagtattttctatttttctttttccggtgtaggaatctttactaaattattcgtctctatccaaatgtcatgtttgccctcttatgtctccaatggtccctggagtcatacttttcattttatgatttaaacattcttacatttcctattttattttctcctatagcagggtttctcaacagcagagctattgacatttttggtcagataattctttattttgagaggctatcctgtgcattaaagcatgtttagcataatccctgccctttgtatactacatgtcagtagcacctttacatcctttctgcattgtaaaaagcaaacatgtctctagacattgccayatgtctccagaagaggcaaactgtcccacgttgagaaccactgccctataccaaaaaagattcacaaaaacaccatgattgtttacatttcccaatggataacaagttttwtaaaatactggttctacctcattaaagaagaagaaggaaaaaaaccctatttttgcattttatctcccctactcgctgatttttatatttgtgcagtcaattctttactaatcagaactctggggaagtttttaaatgtttataggcttttaaaaaagatacccttttctctttttagatattttaaacctacagacctaagtagttttccttttaattaactattacatacttgtaacgatttataatatatacaaaaggcatattttttaaaagaacacctcaatgcatactgcccatgtatctgtggagtatcctgtgggttcctctcaatcctatctatttacttctcaactcccaccagagataatgacttaattcccttgctwttcccttttctattatgatatacacttgtttcactaaacaataaattatttagtgttgtacatttttgaactttaaataagtgggatcatactgtatatattctgtgctttgctcttttttttgttcagcattatgtttgtgagatttattcatgttgatgcatgtaatggcatgttctttgtttttgtttctgtattgtatttcttgtataactatacaacattttacttatcaattctcctgtcagtggacgcttgagtcatattcggtgtttttgcttttataaacaatgtttctatgagcattcttgaacttgttcttggtcaacttttgtgagtttctgtaggatatatttccaggagtgaagttgctgagtcataggatatatgtaccataaaatctactttaaaaagccaaatttttttccaaagtggtggtaccaattttcactcccaccaacaatctgtgatagatcctgttgctctacatcttctccaacatttggcactattggactttgaaatttttgccaatctggtgggtataaaatgtaatctcttgtgacttaattcacattttttgatacgtctctctgaatatcttttcatatatttatcaatcacttgaagctctgcttttgtaaagtttctgttcatatcttttggttatttttgaaaattgtttacttataatcttatacatactaatttgtaggagttctttttatattctggttactaatcccttgacaattttatatgttgcaaatatcttctcccagtttgttgcttgacttcacccttaccttatgatattttctgatgaacagaatccttaattttatttattttttttcctttatgatctaatcttttttgtgttttaagaaatctttacctactgataacctacaggtcacattggcaggcttccaaattaatccgcctgggggaggtcttatgattcatggcttacatcctgtccctgagtaaacaattttatcgtgagttcctcaaatcttatcatgaattccttaaactgttgacatactgattaatatgtagcctactgacagtggaaaaacactgatttgtttctgaatcctgaagttttactgattgttttgcacatagagcattttagcttgtattttgtaaatcgtagccaatgattataacctctgtattgtaccctccaatgaaaatcacaactcgkgtctgaggagttgccctcccttctgaacttccccataaaaaccttccaacttgtagcagattctggaatatgcccaaatttgtggtgtgtcttcccaggtagatcctggcatttggcttccaataagcctttatcaaattatttctgcctcaacagccttaattttggttgacactatcctgaagtcataaagatattctatagtttctaaatgttttatagttttgcctcttatatttatatatttcaaccatctagaattgatttttaatgtcttttctgaagtatggaaccaagtttattatttctgtatgaatacacaagtgttcaaatgaaaagactacactttccctctgctctgccatgttgcctctttcaaatatcaagcatatgtgtgtaaatctctttctggtcyattttcctgtccttgccaataccacactcactgaattattatagctttttaataagtcttcatatttagttttagaagaaatctatacaattatttcctcaaaattataaaaatgagttcaaatttgttagcatagcaccaaatcaagtacattgaattattgaattgatcatttttaaccttccctatcactttggtcttattccatctgatacttgctattgtctggaccctagtataggctttccatattgcaataaaagaagtgtgcaccatggaatacgatgcagccataaaaaggaatgagatcatgtcccttgcaggaacatggatggagctggaggtcatcatccttagcaaactaacacaggaacagaaaaccaaatactgcgtattttcacttataagtgagagctaaacactgagaacataaggacacaaagaggggaaaaacagacactggggcctacttgagggtggaggatgggaggagggagaagattagaaaaataactgttgggtattaggcttagtacctgggtgacaaaataatctgtaaaacaaacccctgtgacatgagtttagctatataacaagcctacacatttacccctgaacttaaaagttaaaaaaaaaagtgtgcaggtatccagattgaggtcaagcagaagtaaattagaagaaccaaacatttaaattaaaccaaaatttgtcattgcagaaggatatggttgtaaacagtcctctgaatatgtaataaatttaataattgtaaacttttaatattaggatgttgacattcaaatatttggtaccaaggtttctggtaatcattttcccactgaatatttgcaatatttcatgagagaatrtggcatgtttttgtgggcctgtggtgtaagaattcttaarcaatagaaatttccacttagggaaaattatatttaagttacatttgtattaaagatatataggtaaatataataatttaatcaaagttcatttttttaaagcatatcatttaaaataagtgtgctaatgttgaataaaactatgttaacacaaattcaattaaatcaattttccaagcttttggatttttttaaaattcaaaattacaaaatttttcattgtaaatttaaaatgatggttaagaattccaagctttaccctcatttgcctgtctcaggagttttaatttatattcattaaggtatttatgaaactcaggcatgaatattatggtctctttttcttgtctcaawacagaagacaaaaaagagcaaataaatataaatggaaccaaaagatatttgtatttaggagactttgtccatatttcaaaactatgatgttattgtagattgtaaggttttttktttgtttgtttgtttgtttgttttgttttgttttgtttttgagacacagtcttgctctgtcacgaggctggagtgcagtggtgcaatctcggctcactgcaacctccgcctcccaggttcaagtgattctcctgcctaagcctcccgagtagctgggactacaggtgcccaccaccatgcctggctaattttttgtatttttagtagaaacagggtttcaccatgttggccaggatggtcttaatctcttgatctcgtgatccaccccscttggcctcccaaagtgctgggattacaggcataagccactgtgcctggcctgtagattgtacgtttttataaggaggtaatagtaatagttaaattcattattgtcccaagtgaaggtaattaaraaataaaaacttagggacggtgatgaagacagtatgctttttaatttggaaattttgtcagaatagtggcccttccagaggggtagatgaatgtatgaccatttagtcctatggttgttttaataaaacaaatttcaagatggcataatctgagattcaaagtaggcccagagcctcaacattacattttctttttgaaaaatttcatattcttaattctaaaagattgcctttgatgaagttgcttactttggtaccataaagaaagagagaaaaataagagactcatattagttgaaatacttagattatttggaaataacccaatttgctttcctttagtygcttgcggccagccccctgttgtagaaaatgccaagacctttggaaagatgaaacctcgttatgaaatcaactccctkattagataccactgcaaagatggtttcattcaacgtcaccttccaactatccggtgcttaggaaatggaagatgggctatacctaaaattacctgcatgaaccgtaagtggtcctttagaaagaatggactaccgtgctataacaactactagacaccttcattttacggctgtggtatcggcagtttagggtatggagcaagtaatattgtgtgttttctttttttctttctttccttccatgtagcatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggarcattttttaggggtcaaagtgctaataattaactcaaccaggtctactttttaatggctttcataacactaactcataaggttaccgatcaatgcatttcatacggatatagacctagggctytggagggtgggggattgttaaaacacatgcaaaaamaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtragactcyttccctaatttcagtttagagcaacttgaagaagagtagacaaaaaataaaatgcacatagaaaaagagaaaaagggcacaaagggattggcccaatattgattcttttttataaaacctcctttggctwagaaggaatgactctagctacaataatacacagwaygtttaagcaggttcccttggttgttgcattaaatgtaatccacctttaggtattttagagcacagaacaacactktgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacactgtgactggtctggttatttacaactttaaatccttatgtgcaccaacatttttacattctggttccatcatggagagcaagcttctaacctggatgaaatgattttgtggcaagcaaagaaatgattatatatatacccgtaaaagttgcgataataattctgataatgttttcatctgaatactatgtattaatttcaaatatggaaactatgcaatgggaaaagtgatagctcacatcacagaaatcttcctatgaaccaaggcaagtattttacatgtaatatatcataacaagcttatgaaacaggggtcatcattactgactgataagggatcgggcatagagggctcgttatttgtccaaaatcatgcagttagtgtgtagcagaagcaggtaatccctacagcccacacagaatttccaagaaaaatgtaaaatattatatccctgattgttatgcatttaagaggttatcacccattcagatatccatccgttccttcagttttcattcattcattatttaaggatttaatgtgtgccaggcaccgtaataggctctgaagattcaccagtggatgcggtagacaggtttctgcccacataaagtttttatactggctgcatcccatggaaattatcatagaacccattctattcagtatctttattgataatctggaagaaccaatacattttatgctccaaagttatatcaaagatataaaggtcaaaggtgagctgaaaattattttaaggttctttctagaaatgtcaaaaatatacagggagtttggcatgaataagtgtggaagagaagagattattttcctttctgagcttgtccttttagtgtgcactctgtcatatcttttacatagaatttaaatatgatccaagggaatatataagaatttataataattgtgcatatatagccttctgagattattggtggatctaggtacaaataacagaatctgtgggatgaacagaatactgggacagagtgagacattaaaaaagacttacactagtcaaaggcagcaagaagtggttctttgtccatttttaaaggttaagtggcatatcagagggaagaatgtgcccctgcgttgggggctatttaagaagaggtggtcttccagggtagctgtattactaaagaggtaagagagattgtatagggagaggtgcatcattttaatgtgatggtaagtagacctttgctgatcttaagtaaattttcaataaagtaccaagagtaggaactgaattagccacaagctatttgcccggaaatcatatatcatgtacaataaactcacagagtttgcaaataaacagaaaaaaataaagtagttgtaaaaaagttccgggttaattttgtgcatgactatttcccatgaaaaggatctatgagagaatatattctagataagggaaaaagatgttattatcaagtggctaaagactcagtgatgaatacaacatttgtaaagtgtttccttttatgtttcttaatattagaaatgcagtgaaattgtttctgaaaaaaaaaaggttggcagtgatatgttagcactgatattggtgcatctttctttttactgtattgcaacttgcattttctctaaacaaatcagaattcatccaaatgattcttttctgaaacaagtctaaacagaacatttataaaggtccttgagtgagtcattcaagattgtataatcttttcccattattactcatttctgtatgtttagatcccagctggacaagaaagagcaaatgccaaaatagaacaagaatggttttgttgaggtgtttacagaataagcaaagcctgggttttaattggaatttaattcagagttctgtctgagtccatcaaatgatccctgttgaagattaaaagtttactgccttaggcagtaagtcttaaattatttttgatagtatttatttaaaaattttaaaaactatgtacctctcacattttaagttgtcaacaaaattttttttcatcataaagttatacaactatagaggatgtaatttttgacctattttaaatattgtcattctaaaataagcatgtaatatcactttcaggatatattcagtggaatctaaatatcatagtggtttgacctcttacatcattcttttaaaagtagtcttttattaagagtcaaaaattttatatttttgttttcgttggactaattctaaaatttaagttcctcttacggaatgttatcaaaaattatatagttatatgcttagaagtcttctattgattaagccatcaaacttaagtacatcaaaatttgtactttaaagtttaaattcttttttccttgtgaacataatcctataaactaaaattttcctggaccaagttatttttgtagtttactaatatacaattgatcaaaacaatataaagctatcgtaacatgtgaaagattatacaaattgtaaaaattttgttggaaatatgtcttaatgagatgattagggctgtttttcccaattcacatttccgtagggaaatattccttaaaactagaatgtggcatggcttagcacatttcactctcattttgtttgatagatgtaaataccgagaaaatctgtttacataagtagatgaaaatgatagttttattgtgcactgctactcaatttttaaagcaatttctgttatatgccaaaaatcacagtgatctatcaaaagttattttcaaattacctctcagctgacatgtcaagtcctccttaattttttttttaaataaacacttggtttgaaaaaggatttgtcacactggcatcagaattattcagtgtgaattgtctcttacttgtcctaattcttgcattccatggcaatgtatcctaagactcagaatggataagagatgtttcatttagtggttgttttttttttttaaataaagtagaaaaggagcaattgtctgaagtattggtcctcaaactttgttccttggaacaacagcattagtttcacccaggaacttgtgaaaaatgcaaatcctcagaccttaccctactgaatgagagattatgggagtggggacagcagtatgggttttcgcaggcactccggtgcttctcatgcattctaaggtgtatgagaactggcataaagggggatgcaaaagcagaagcaggagcctccaccacagacacctccctaggcagatgagttttagaaaagcctctaggtggaaattaaagttctggaaatggcttcacttttatgtatcccttggaaagtcttagggcactcacacagtaggcatactaccctaggagtacattaagttttcccctggtttggagaaagctgctttaagatacagagtccttaaagtgctttctgatttttagtacatcatctgtccatatttgtgagcatgtgttctaccagtctggtggtgattactttccaaccttttaatgggcctctggttttaaagaaaaaaatgagaaaggttttctttacaggaaaaaacgaataaagcagcatgattaaaaatattaatttcttaaagacctgatacaaagttttaagtgtaggaattaagagaaatttaaaaacagaaataaaagcaaagaagatatattgtaatttctcttcaagagcaaaccaggaaaaggaacctcaaattcaatgatgagccctaaaagaggcctaggtgggagaatcctttggagtggattgatctctacattgcttcagttcccagaacatctcaccctctcctatgttcattagccagattaaacccatttttcatataataatacatattgagcacttatcaggttccagggcactctgttaggtgctggggatactgttataaacaagattagctgagtttctgtttttagggagcttacagtctgatgagaaagattagcaatggcattaaagtaggagcagtctgatttctcaaaatgcaaaagcctctgctcttgaccatctcttttttttccactctccatctttgcctgattccattcataactggcttaaatccctacaggattacttccatgtccagttggttggattctataggcacataaagagctttatctttcaagttgaactattatctctctctctcccccaaccattttttttataactagtagtctaagagtcattctggcttctaatttaatgcccatattcaatcaattgccaaattctataattctacctccaaagccttctcatatccattctcttctctctatccaatatcttaaatagctttactatctctagacacactgctttccaaattacctttcaaactactgcagagtattctttaaaatgtgcaaatcagagcttggcattccccagcacagaattcttcagaacttaatgcctacaaaatagaatctaatttcatatgcagagaccttacctacttgtccaatctaatattctgcaaaatgctgtgaaaaaaaaaaaaccaaactatttgatttcaggtcttgatttagaaatcgtaagtggaacaactatcaaatttaagttctaatgtttttatttaattagatcagtttggtttcctgttaagtctctgatcaaatgtcagactctctttgtagcaattgtatgggaggcaaaaatggaagattaaaactgctatttgactgagtaagacataggtgtgtctttccaggtacactctacacccttctgctctgtgctctgagatactgactgtatagattgctcctattgggttcagccatagagagcattgcaggaaatcagaaccagagaggataactctatatcagtgtgtagccacttggctcctcccaatcctgtgggattgccatgggctggtggtactctataataaagttattagatcctcctgggcagcagtctccacagagccctctttgcctcctggttccacagctcctcataagacctttcaggaccggtctagcaagagctctccactgtttttggctccatagatactgtattatgaactgtgatttccttaagcttctcgcttttgtaaatccctttattaaacactctttgactaattttatttgattgtgtcatctgtttcctgttggattcttggctgacagtgttatttgatgcatttcttcaggggaaattatggaagtaaccccattcatttcattcataggataggcatgctacattgcagtctggaagcttgcacactggttcccttgggttgcttctatggcatcttattgtgtacttatatgaggttatagccttaattcctttcttgtaaccattaaacacaaagcatgtgattgttgcaactgccagccatttttctgcctcggctatgcataaacatggccacactacagacttcttggtctgaactttgtgttttctggcttaaatttccaaaacaaaatgtattactcctcaacttgagttcacaatcaaggtcagctttcaatgcttgttttatacttaggaggaaaaaaaaagagtaggagtgaagttatataggtgcataacaagtttctctgagactaaaccccaatatctttgaaactttttggttacccactgagaaagtaggatgagaagggaggaagacattgctattttaaacctgccaacagatttcgtttctttggatagaagtatgcctttatctttcagagatgaatttttccctctggtttttggagaagtcattccgggggacgtcttcaagttacacaaatttaagaccaagctcatacttcgggatgaattggtaaaaggagaagctgagctgctctgcattaaaaagtagatgttgttttcttctcatacaaagtgttgtatcttttagattaaactttaatacatattctgttcgttttctctggggtcttgattccagggcatgaaaaattcttggcagaggctttctgtgttgaag

SEQ ID NO: 17653 - DNA, 39105 bp, Homo sapiens
  misc_feature (1)...(39105): n = A,T,C or G, or insertion/deletion polymorphism (see Tables 1-2)
tggtacgatctcggctcactgcaacctcccccttcctgggttcaagagattctcctgcctcagcttcccaagtagctgtgattacaggcacctgccaccatgcccagctaattattgtatttttagtagacatgaggtttcgccatgttggcaaggctagtctcatactcctgaccccaagtgattcgcctgtctctgcctcccaaagtgctgggattacaggtgtgaaccaccgcgcctggcctgtttgtgagccttcactggaaacacacattctggtcagcctcgaccactcctgtccacttccccctggacagtgctccctcatgcatttccccatcctcccagtgttcagctactgcatctctacttttccttcctctctgtctcagaacttcacaaaatctcttccactcttcatgttttccacacaattccccattacaatctaccttctcccatgactatgaacctgaagctatttcagtcaggcagggattcttagacacctttccctagctttggagatagtttataagaaataatcaccacgccctgcacatatattaatattacctcattcacttctcaaaaacaccgttaaaatattatgattttctaccatttacaggtgagaaacctaaggctcagaaaggttatgcgaccctgccttgcttgggatcacataggtaagtggcagagctagattggaatccaggttggacttactgccgagctcatgttcctgccccacccctacaagggccccatttgctcccactgacccttctccagggactccagggagaatcaactggcaagttagacatcctaacacaacaaaacttcaaactttatgttttcaaaccttgaagatacacatttgctaaggacaaacccatgtctgtaacctacctttaaaactcctctctctgaatagtctaaatttatttaaaagtttgcttaggttttgtgaatgcaaaccacgatatccaccgtaggggcaaaaaggtgtgatgcctttccttacagatgcgacccttataagggtcttacaacaacaaaaagggttaacaagggaaagcatagcatattcatttaatccaagtttttatagcatggaagtcttcaggatgaagacccaaacacacaagtgacactgttcgttgttaggcttaagtcgacgaagactgtacaacagtataaaatgtgattggattaatagggaaagatcccatagtaatagacggtcaggggaaacccagcgaggccttcagtttgagttctccatggcccctctgtgtggcaattcttgcttctgggtatagggcccaatccctctggaatatggatctgaggacctattatcagacagggtatatcctggaatttctttatggccagctcctacaaagaaaggcccaggggggaaggtagagctatattttaggttttatggctgtttgggggcagaggtatttcactttctgggacctgcctgggggaagaagaattctagtttctatggtgccttaagggagaaaggagagcaggagaaagtagagtgggagaaggtcaaacagatctcgcttctgaggcccttttggtttccttcagttcaaaggactcagcatatcaaggcaccacagtttggaacatcgtattctgggtcccaacaatattcaagcgaacacaggagtggtaaacgtactggggctacgtaatgaaggcggatctattaggattgcatgggaagaggcttcagctgtgtagtgatgcatgggtaggatttgcataggaagagggtctgggtaaaggcattcctggtgaattcctggcaccactacttctaggtgggtagggaatcagaaagaagggtgttggggaataattgaatataagcagggggttccagaagttctgtgtgggctctggagctgtcattatttgggagatgagcctgtgggctcatcttaaggcaaaacaaggctactgttttcacttcgattctttgcttacctggagtggatttgagtggctgaagacattatggaaagacatgaagcctcccttctctctcccaaaataaactactccctctttggtgaaacaactgaaatcaggaggacagaccaggagcactacagagtaccacaggagtgctacaaagcaatgtacccttcttaatgtatcagagagggagcactgcaagttgtagagaacaggagtgctggaacttagaattccattcagtgaccttactcccattccagactctgctccaggttatagcacagcgtgcttcagcacagagctacctctgagagctagcatacagagtgggtgagtgggagaggccccagggtgcctggggaatctcaggcaggcgacagggacatgaacttggaagttattttatgtatgcgggaatgagggccagacccaggcagtgggaattagggcaatgagaatgaggaatagacatgagagatactgccagttggttgatgtttgtcatgcatttagaaaatgcaaagttaggccgggcatagtggctcatgcctgtaatcccagcactttgggaggccgaggtgggtggatcgcctgaggtcaggagtttgagaccatccagggcaacatggtgaaaccccgtctctactaaaaatacaaaaaattaaccaggtgtggtggcacgcacctgtagtcccaaatacttgggaggctgaggcagaagaatcgcttgagccccagaggtgaaggttgcaatgagccgagattatgccactgcactccagcttgggccacagagtgagattccatcaaaacagaaagaaaagaaaaagaaaaagaaagaaagaaaagaaggaaagaaacaaagaaagaaagaaagaaagaaagaaagaaagaaagaaagaaagaaagaaagaaagaaagaaagaaagaaaatgcaaaattaaatagactgcaatgtatacaagccatgaagtgaatagaaggctagaaggagaagcatataaaatgaatgacagtggcacctctgagaagaagctggggtgcaggatgggtgatttttcacactcttcttatattcatatcatttgaacgttttcagtgaaatgatattcaccttatcacttaggtggtacattttgtgaaaggcagaatgaagaatggtgttgaagcacaggcaactcaggtctccagggcagaagggttggcctaagggcaaggcagcaatggtatggttttcctcaccaccacccatggggaagcccagtgctggtgcctgctcatgtctagcagacagccatcctcctgtcttagttcacctttcacagctgggtttaggggcctctagagcacaggagtgccagccagttgtagcccttgtacttagggtagagccagcagacacttaccttgacaggatctgtgaaaacccatctttatgctgtatagttcccttttttttcaacactttcctccatggcagaaaaccacaacaacttgaaatgagacccttcaccacctgtgctttcttcaaagtgtacacgaggacagattgttgagccactggtggggcgatctgatcatattactctgatttttctaaagctcttcttcctttgctgaatgactggaagctcacaactctggctgggcatcttcagttccccatatgcatacacacacacagacacacacacacacacacacacacgcttctctcctctttgaacgtctttggattctgcagagcagatttgtcctatgatgtcataaactgtgaagtcttcaaccctcaggttggttttctaagtaggctttgttatgagcagtaccagactaagtggtatttgcacacacatagtgtctttggttcttatggctctgggtgtgtgtgtgtctgtgtgtgtgagggaggagtaggggaagagatacaacactcctggggaagggagtgcaattgctagtatcacataaaaagtatgaaaacttttccaagaattagggaggaatacgatttggcagaaaagtaaagtcatatccaattcaatcaaccttgaatgaatttaaaggtgctccttgtagttaggacgccagtgctgaggctcagtcattgctagcttttaatattagacatagcatctgggtgcggtggctcacacctgtaattctagcactttgggaagccaaggcaggcagatcactagaggtcaggagttcgagaccagcctggccaacatggtgaaacctcgtctcttctaaaaatacaaaaattagctgggcgtagtggcagtcccctgtaatcccagctacttgggaggctgaggcagaagaattgctttaacctgggaagtgcaatgagctgagattgcaccactgcaccgcagcctaggccacagagcaagactctgtctcaaaaaaaaaaaaaaaaaaaaaaattaggcatagaatctaagaataaatttaacctgaaatttataagtgtatataaaataagatgcaaaaccatgttttacatctctccaagaaatctttgttctattttataggtgagcacaaagattttctttacataattttttatcagaaacaaaaagattgaaaatagtccaaacatctatgtcctgtgtcaaaaaaaaaaaaaggaaaaaagaaagaaaaagaaaaattaggtttgtcctcatgaacatggctctacagactttttaaaaaaataaagtctgaacaaggagcagagtgaataggccgaatttttttttttttttttttttggacagagttttgctcttgttgcccaggctggattgcaatggcgcaatctcagctcactgcaatctccacctcccgggttccagcaattctcctgcctcagcttcccgagcaactaggattacaggcatgcgccactacgcccggctaattttgtatttttagtggagatggggtttctccatgttggtcaggctggtctcgaactcccgacctcaggtgatccacccatctcagcctcccaaagtgctgggattacaggtgtgagccaccgtgcctggccaatttttactggagtaaggatgttgataccatcaagcctcacacttctgctgagattatcaactgtagttttccaatgttggtctacaggtggggaccattctgtaatatagtttccccactctgtgttgatgtgaggaaaataagaataataaagttttattgctggctttgagggagaagggttctatgacccgccttggggaagagaaattctagcttctgtggcctgccttgagagaagaagtggagcaggagaaagacgggcaggagaaagcaagaaagagactttgcttttgcagcctttttaatgtctttcagttcaaagtactcggcatgccaaagagccatatttggggctatctttttctgtgccaaaccaacaacaccaaaccagaaagaagcaagcatagggaatccagggcttcactcaacccatcccttcctatgcttttcctctatctccaccctgggagcaattttcttttacagaactaatgcaactgagcagagaaaggctggcctgtccagagagcagataggacgcccatattttattttcagttgtgccaatgtcctgcatgggactcctggaactcactggatgcccctgtgcatgagcttcttaggcatgtaatagaattaacagcagtctgcttctatgcaggtaggtatcctgcaaagaaactttgtatgaaatgtgtctgcacattgtactcattcttgcattgtttacccatgtagtgaccttcaaaaatggctttgcaaaagtcacaggggaataaccgagttagtaggcacttgtttcccctccttcatcagattctgctctgatttgctacataaagttgtataatcacctggaaatatgcactgtgctgccacgtgattttcaaatgcaratgagcaggttaacaaccccagtgttgcaatgttctagctgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctrctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggtgagtgaattgtgtttaaccttgaagtcacttgggatttgtactatcactaggagtccaggcctcacacacacacacacataccaccaccagcacccaccaccaccacccaccacccaccaccatcacccaccaccaccaccacaaccaccaccaccacccaccaccaccaccaccatccaccaccacccaccacccaccaccacccaccaccatcacccaccacccaccacccaccaccacccaccatcatcacccaccaccacccaccaccatcacccaccacccaccaccactcgccaccatcacccaccaccatcacccaccacccaccacccaccaccaccaaccaccaccatccaccaccaccaaccaccacccaccaccactaccacccctcaccacccaccaccaccgccacccaccacccaccaccatcacccaccaccaccaccatccaccaccaccacccaaccaccaccacccaccacccaccaccatcacccaccacccaccaccacccaccacccaccacccaccaccatcacccaccacctaccacccaccacccaccaccaccaccacccaccaccacccaccacccaccaccaccaccacccaccaccacccaccaccactaccacccctcaccacccaccaccaccgccacccaccacccaccaccatcacgcactaccaaatatgtgatcatcaaaggtagaagcttacaacttgtggaaagacagataccactctctggcctggggtgggaggacagartatgactcgtcctcaggcaggttggcttcctggatgatcagagaagtagaatctagggtgaaatgaaacaaaagtagatggagaaatctcarcaggaccaagtagagagggagaatttaggaatttagttagactgcagcaaaagaattcactgggtctctggccctaggctaaaaactatagaactccaaaccttwaatgggagggggtacttcatggggcatgtctaagaggagtgaggaatgaggttaatgtgattctacggaattagacagaagtctgtatggctgaatgtacygggtttaacagcaacgttttagttagtttttgatattattgcaatgatgcactccagcaggagacaaatcctggcaggatgcatggttcaaagaaataccaatctttcaagagtatgtttaaacaaatttcactataaaagactatatctctgggaatgtcaagcaattggttactttagcagaaaaaaaaaaactagccatgtgacaacatggggataaaggaaaataaacacagtggacatgttattttttctgaaagtaaaatcgagccattttctttcataatctagtacagtcatgtgagaaattctgcttcatggtgatctcaagcaacagtttattggtggtgtggtacccaatagattgtgggtatggttgtaaatatactaaaaaacattaaattgtatgcctttagtgggtaaattttatggcatgtaaattatatctcaataaagctgtttaaaaaagaaaaagtaggaaacaaaataaaccaaataaaagtactaaaatcacccataattaattccaccatacagagataactgttaacatttgtttaaggttttcttgtttgctttttctaatttgtaaaagtcatatacgttcattaggggaaaaagaccacttagaaatgtttgcttgggccgggcgcggtggctcatgcctgtaatcccagcactttgggaggccaaggcggggggatcacgaagtcaggagatcgagaccatggtgaaacccagtctctactaaaaaatacaaaaaagtagccaggcgtggtggagggcgcctgtagtcccagctactctggaggctgaggcaggagaatggcgtgaacccgggaggcagagcttgcagtgagccgagatcacgccactgcactccagcctgggcgacagagcgagactccatctcaaaaaaaaaaaaaagaaatgtttgcttgaagaagaaagtgaaagataattataatctcaccactgacagacaaacattttaacagcttgctgtgtatctttccagacttttaaaagacatagatttatatataaaccagttttsacaaaaatgggctaatactatgcatactgctttgtaacctttaaaagtacattgtgaatatattataaacattctttcacataaatgtttatgatagaaatataaatatattttaagtgaatgctttgctctcaagtcaaagatcaatattcctaactttaccggaacccactagaattatttgctgttgggtcagttggatgaaccctaagtatctttggctgcttttcaggttggctctgacacgttttattccttcaagtacgaaatcaaggagggggattgtcctgttcaaagtggcaaaacctggcaggactgtgagtacaaggatgctgcaaaagcagtaagtgtattggccattcttgggccttctgtyttctccgttgaccctgccagatttttttactgatgcagaaatgatggctactggtgagcctgtttatgagaaatgcaaataaacattccaatgtgtagaaaagtcagatgctttatatctgtgttcttgtatagacagaaaaatcatggagaagccagcagttaaacatggagaaagcctttccatgagaagggggctctagtgtccagccagaacatgtggctcagactccagagagataacaaattgacatttgggccaagccaaagagctggcgaggggagggggtgggtgcttccattgcacaaygttaagtgcaaatcttgactctgccttccattagctgtgtgatagcrggggagctgtgacctctcagaactggcactttctgctgtatatgggagataatattgacctcatcaggttgttggaggatgaaatcagatgaattatgcaaataactttgataacaatggctatcttaaccaaatgcctaacatataggcctggcacaccrtagctggttgttgttttgctttttttttttttttttttttttgagccagagtctcgctctgtcgctcaggctggagtgcagtggcgcgatctcggctcactgcaagctctgccttccaggttcacgccattgtcctgcctcagcctcctgagtagctgggactacaggcacccaccaccacgcctggctaattttttgtgtttttagtagagaccgggtttcaccgtgttagccaggatggtctcaatctcctgacctggtgatctgcccgcctcagcctcccaaagtgctgggattacaggcgtgagccaccgcgcccagccatggttgttttgctttaattaagaaagatttcagacagtatctgcctcagaagcaagmctctcttttcatggattgattcccttcttttatgtcagaacataaaagatgactgccmgtcatctgccattaccaaagagtactgaactccaagtcaggagtctaggattttgcagtgctggttctcccttctcagtcatctcatctgtaaggtggggataagtagctgctgtgctctgtactgcctgcttctaggggctgtgtggacaaagggaggtgtgctttatcctgatggaayagtatctgtcacttagaatccaatggatatgactgaagaatgaaaagacaaaacaaaacaaaaacactgttcaacaataacaattaaacagctgcctattattaagtgcctgctgtgtggcgggcctctagtaggcattttgtgtgtgtttgcacacatactgttcacaacaactctaagagatagatgtatcccatctyctacaagacgggtaaactgagactccaagagtcaaggggacatgacagagttaacagctagcaagtgacaaggctggaactgaataacattttgatgccaaggtccttgccctttctattaagttaaactgaagtttatgtgaacagtattaactyactgaagttgagtggtagataagaggagtgtttagcaggctggttctagacctctgcgtccatcttggttagaaagaaatagctccagrgctcagccaggtgcagtggctcacacctgtaatcgtaacactttgggaggccgaggtgattggatcatttgaggtcaggagtttgagaccagcctgaccaacgtmgtgaaaccctgtctctaccaaaaatacaaaattagctgggtgtggtggcacgtgcatgtaatcccagctacttgggaggctgaggcagcagaatcacttgaatctgggaggcagaggttgcagtgaaccgagagatcgcactgttgcactccagcctgggtaacaaaagcaacactctgtctcaaaaaaaaaaaaaaaaaaataggaaacaaaagaaaaaagaaataccctccagggctcaaaacaaagactcaagctttaaaacctcaycatttacactgtctttcctccagcatctcatgaatatcagtggcttatataaagtaatcattaggctattaaaaaaatttattctcatgtctcaaaactcttttggtaaaatcttcacaagttttgttttgttttgctttttaaggaaagccacatttagcaacagtattaggtagactttcccatctgaaagattaagataaatgatctctttcttttctttttaggccactggagaatgcacrgcaaccgtggggaagaggagcagtacgaaattctccgtggctacccagacctgccagattactccaggtggctggtttatcctctggcactgccctggtgggaaattaaccatttctgtgagccaggaacacaatcttgaccaggctctgcttgctcccagagggtggcagtagtaaagccatttgcagagttaggragcattgggtggagcggcagagcccggaggttgagccaggctygtgaccatcatccccttaggactatcccaactcttcccgtgtgctgcattgtacccagtgtgtgcaagggctcaacagaaggaccagaagacataagacctgccctccattgcaggcagcatcccagattgaggagcgcataggctttgagggcagacctggcctggaatctttcagagctccttgccttcttgcctctccttttccttgtctagaaaagggaggtaagagtacttcccacttcacaggactgttgtgaggctgaaatgagatgatatgcctggaggtacaatcataataacatactaacatattaatcataataacatattagcaacaatcaggataaaagtaatagctaagatatattgagtccttatgtcccagccatgactcaaagcaccttacatgtattatcttctttttctttttttcttttactgatacataatattttacatatttatgaggtacatgtgagtgttttttacatgcattgaacrtgtaatgattaagtcagggtatttggggtatccatcacctgkaatagttatcatttctatgaattggtaatatttcaagtcctctcttytagctactttgaaatatacaatatattgttgctaactatagacactctagtctgctatgtaacattagaacgtatttcttctatctaactataattcagtacctattcaccaacctcttcatttcccccttctacccgcttaccccgctcagcctctggtatctgtcattctcttcycttctctatctccatgtgatggttttagcttccacatgtgagtgagaacaatgtgaagtttgtctttctgtgcttgagttgtttcacttaacgacctctagttctgtccatgtggctttaaatgatatgatttcaattctttgtttacggccaaatactatttcattgtgagtatataccacaatttctttctttttttttttcattttgagacagagtctcgcactgtcgcccaggctggggtgcagtggcacgatctaggctcactgcaacctcccgggttcaagcaattctccagcctcagcctcagcctcctgaatagctggrattatgggcatcgccaccacgcccggataatttttgtgtttttagtagagatggggtttcaccatgttggccaggctggtctcgaactcctgacctcaggtgatccacccgcctcggcctcccaaagtgctgggattacaggtgtgagccactgtgcctggtcccccacattttctttattcattcaccttttgatggacatttaagttgatttcatatctttgctattgtgaatactgctgcracaaacctgggagtggaagtacccctttgataggctgatttactttcctctgggtagatgcccagtagctggactactggatatatggtatttggtgttttcattttttgaggaatctccgcactattttccatagtggttgcactaatttacattcttaccaacagtgcattagagttctcttttctccatwtcctcctggctgtgtttaccgcttacatggcaggcagcgagagctctgtggtgaagaagtccaggctcccagggggtccctccaggtgtgccactcactctgcagctacgttccctttttatggactttgcctctattgaccagtrggttagggctatctgttatgaacattacttgataatttaatacaaaytctttttaataatagccattctaactggggtaagatgatatctcatctcataatggttttgatttgcatttccctaatgcttagtgataytgggcattttttcacatayctgttggccatttgtatgtcgtcttttgagaaatgcctactgagatcatttgcccactttttaatgggattacttggtttttttattggtgagttgattgaattccttgtatatgctggatgttagtcccttgtgggatgcatggtttgcaaatattgtttttctttctttttttttttcttttgagacacagtcttgctctgtcgcccaggctggagtgcagtcscatgatctcggctcactgcaacctccgtctcctgagttcaagtgattctcctgcctcagcctcagccycccgagtagctgggactatcacattcagctaatttttgtattttaaattttgtaattttgtatttttaggagagatggggtttcaccatgttrgycaggctggtctcgaactcctgacctcaggcgatctgcccscctcagcctcccaaagtgctgggtttacaggcatgagccaccacgcccagcctcttctttgtttagggcagtgtatgcgaatgctsattgcgatcattaatgctgtgtttttgtctgctctttgttaagccgagggccctgtggtgacagcccagtacgactgcctcggctgtgtgcatcctatatcaacgcagagcccagacctggagcccattctgagacacggcattcagtactttaacaacaacactcaacattcctccctcttcaygcttaatgaagtaaaacgggcccaaagacaggtttgttctttaattctctaagtagcacagtattactaaaatttgttagatctttacatttaaaatgtatgattgcatggctggtggtgttttcatgtgactagcacaggaagcgaagagctttctccttagtcaaagtgagtcggatagtgcaatatgtaaagtgagaaaagatgtcgaatcagacccccttcctttgaygtttgattttaacaaatgggtaatcgtcattacaggctyttcctagagacagtgaaaaggaaaagtcataccggccttaggattttttttttttttttttttttttttttttttttttgagacagagtctctctctgtcgcccaggctggagtgcagtggcgcgatctcggctcactgcaagctccgcctcctgggttcakgccattctcctgcctcagcctcctgagtagctgggactacaggcgcccgccaccacactggctaattttttttattattattatttttagtagaggcggggtttcaccatgttagccaggatggtctcaatctcctggccttaggattttaaraaaactatattatcacctagccatcatgasttaaacacagctccaaaatattaaattgtgtctaaaatggtcggcatggctttctgggtacccactaattacagttcccatatcatcagaaaaaaaaaagtatatatccgtaattttttttttttgacagtctcgctstgttgcctaggctggagcagtggcgcgatcttggctcactgcaacctctgcctcccaggttcaagcaattctcctgcctcagcctcccaaggaactgggattacaggcgctcatcaccatgtcttgctaatttttgtatttttagtagagacraggtttcaccatggtggccaagcgggtggtctcaaactcccaacctcaagtcatcctcccacctcggcctcgcaaagtgctgggattacaggcctgagccactgcactcagctacaaatcttcttaatgattcagtacacccagacttttcttcttttttttttttttttttttgttttttgaggaagagtcttgttctgttgcccaggctggaggctggagtgcagtggtgccatcttggttcactgcaacttccacctcccaagtttaagagatctcctgcytcagtatcccaagtaactgggattacaggcacccaccaccacgcccggctaatttttgtatttttggtagagacaaggtttccccatgtcggccaggctggtcttaaattcctgacctcaggtgttcctcccgtctcggcctcccaaagtgctgggattacaggcatgagccaccacgcccgcccctcccagacttttctgatagttgactgggtctcttgtatttcagcctcttattatgagtgattccctttggttagtaacattctctgcatttaataaaccttacaacttgctttcatgcgagcatgctttactcaattatgtccgtatagtgctatcagggtgggagaggcccagaataaagtagaagaaatcttactacttggtaacctgggagcctgaggacccaacagtaaagaccactcccctctaaagttttctttatccrtctagaagggcattattattttatgaaattcagtaaacatttctctctgcagcctggcagaggaaatattgttaggattcacttaaggaaatccatgttccaaaactggctgaaaaatagaaaaatatatatattgcttgtcattttcagatggctagcggtgtatgtgtgtgtgtgtgtgtgtgtgtttgtgtgagagatatgagactcttaaggtgctcaatgtttattcagcatttttttgcctagtrataataatawtttatatttcttgggcacttattatattgccacactgttttctaaactcctcataacattcatatcccacagcgaataatgtttaaactgccctttaaatattcaatctgaaattgtttcaggtggtggctggattgaactttygaatkacctactcaattgtgcaaacgaattgttccaaagagaattttctgttcttaactccagactgcaagtccctttggaatggtgtaagtaggcaaaaatttaatgataaagttcttagcattttgtttacattttgtggtaactatcaagctgggtgggaagactgtcacgaaaagtttagatgacattcagcaattcatattcacatttacttgggaagactaaagctcacgtcactggtcaagctgccttacctaactggccaaagaatctgcacagctagcaataagtatttttttataactttattttattttatttattttttgagacaggatctcaatctgttccccaggctggagcacagtggtgtgatctcatctcaytgcagcctccacctcgcatgttcaagctattctcctgcctcagcctcccaagtagctaggactacaggcgccaaccaccacgcatggctaatttttgtatttatagtagagacagggttttaccgtgttagccagagtggtctcgaactcctgacctcaggtgatccgcccaccttggcctcctaaagtgctggtattacaggcatgagccaccgtgcctggccagcaataagtatttacagagcataaccagggactacgaatagataaaatgcttgaacggtcaactgtatctttgttatgtctccacactttcccatttccttttcttccccaggtgctcaatgcccatatggtgttcccttgctctacccagggttattcttcatgtcaaacttttctctgtttgttttctcatcttcccttccctacctttatctttaataaacagaccctgagtctctagcccttagtggtccttcttagcatcgtatcttgttatctgaaccaaaattatattaaaatggtatatctcaaggtagtagtagctagcgaatgttaagatggcgaagacatgatatgtgcccagggatgtttgcatttgagcagaagactgtgctttagccaaggaaatgctgcaagtcctttgatctagtaattctgcttctaattcatttatatgggaaatccagaccataagatgttaatgtcagttgttttttaatagaaaaatattgtaaacaaatagtttatgcaacattacagaatggttaagtaaattacagtatatccatacagtagaatatgatacagctatcaaaaatttttagtttttagtgacatagtaaaacggttacaatgttaagtaaaaaacaaaaaaagtgggatacaaaactatacatacggatttatttaaatatgtaaaataaatgtaaatacaaaaagtgatggaaaacaaattatgacaaaatatagaatgtagttaactttcagttggaattgtgggtgctttttcttttttgagaagaggtcttgctctgtcaccttggctggagtgcagtggtgcgatctcggctcactgcaacctctgcctcccaggtttaagcaattctcatgcctcagcctccctgagtagctgggattacaggcgcccgctgcaacgccaggctaatttttgtattttgggtacagatgggggttttgccacgttggccaggctgttttcgaattcttgatctcaggtgatccacccaccttggccttccaaagtgctggtattacaggtgtaagccactgcatccggccgytttttctgattctttatattttttggaagtttttgatatttcccgagttttctaattgagcatgcatttattttataattggagaaaaaagtaaaaaggacactatcaagagagtaaaaatacaacccacagaatgagagaaaatatttgcaaatcatgtatctgataagagtttaacatgcagaatatataaagaacctctttttgttcataaaataacaagtattagaaagggcatggagaaattagaacttttgtacattgctggtaggactgtaaaatgctgcagccattatagaaaatmatttggcaatttctgaaaaacttaactatagaattactatgtgacccagaagttgcactcttaggtatatgcccaaaagaactggaaatgcatattcaaacacgtgtttatacatgaatttctatagcagcaaaattcataatagccagaaagtcaaaacaacccaagtgtctatcaataggtgaatggataaacaaaatgtgctattatatatacacaatgaaacactgttcaccctttaaaaagaatgaaattctgatacatgctacaatgtggatgaagcttgaaaatattatgttaagtgaaataagccagacacacacaaaaaatattgtatgattccacttatataaaacacctagaataggcaaattcagtcagagactattggagttgctagaaatgtaatgtaggcttttcttttttttttttgagactgagttttgstcttgttgcccaggctggagtgcaatagcgcratcttggctcactgcaacctccgcctcccgggttcaagtgattctcctgcctcagcttcccgagtagctgggattacaggcatgtgccaccacggccggctagttttgtatttttagtagagatgaggtttctccatgttggtcaggctggtctcgaactcccaacctcaggtgatccgcctgcctcagcctcccaaagtgacttatcacacagcacctggctatgtttgtttattattcttttttcccctcacttctggagacctaggcataggtctttctatttgtttgttctatttgtttgttctatttgtttttctccctctgtttttaaattatgaaatcatgtcgagtcaaaaattaacttagaatgctgttctaataacattatatggaattctcatttttgttattttgtttttttttccttatccaagaaagaccctaactttattggcaagcatgtttatatttccaagtatattgtttttgtttgtttaaacatgttatgaatttttagagattattttttctttttggtgctgaggtgaaagaacataccctgtattgtttctgctttgtaaaatgtattggatctttttgtgacctggtgtaaaaacaattaaaaatatttgtatgatactggccgggcacggtagctcatgcctgtaatcccagcattttggtgggtggatcacttgagatcaggagttcgagaycagcctggccaacatggcaaaacctcatctctactaaaaatacaaaaaaattagccgggtgtggtggcagacgcctgtaatcccagacacttgggaggctgaggcaggagaatcacttgaatccaggaggcagaggttgcagtgagctgagattgcgccactgcactccagccttggtgacaaagagagactccatcacaaaaaaaaaaaaaaawatatatatatatatatacacacatatatatatacacatatatatatacacacacacaaatacatacaaattagtatgatacttataaagtatcatttaaaatcatatgtagcatatgaaaataccatttaaataaatctttaatatgttattcaaatcttctatgttcttgtttattttttattcacttgccctgtcttagatttgtaattgcatactaaattttcccaccatattatttctatccatttctattcacgtgtaattttttctactttaggtattttgattccatgccttctggtctatgcttttgaaaaataaaatgatcatttttactacctttaggaatgagtgttttgttctcgtgaattttactttgtccaatattactaatactgtagttcctgctacgtttatatttgtctcacgtagctttgttcatctgttatttttaagctttatacattgtttttatyataagatgattcttgaaactgtaatacattgatttggtgttttaacagtgtgaaagtcttaccttatttttttagaaatttacctttttacttacatggctgttatttctgtactagatcttcctgctttccaygtgctcatgtatatgcatgtatttgttgatgctattgatactattaccttagtatctcttttgcagtaagrctatgttttgcttctttcttttttttctatgcaatgatttggaaagtacacgtcctattcttcaattttactagttgtttacttttaagactctaaaaaatgtttttaactgagcacttatatgctttttaaaaaccaggataccggtgaatgtacagataatgcatacatcgatattcagctacgaattgcttccttctcacagaactgtgacatttatccaggtaaggaataacacatgttggcaccgcaatagaggaatagtggtcccagacaactggctgagtcttttcctataagttgggttttggttcccgtgatatactccaaagtctgtgtaacctgcagacacagatgcaccccttgatgagaacactgtaccccttcsctgcccagttgtgctgcagctcagactgttcttgtcagaatggtttatgaagacagaagggaaatgtatgacccctgggcaaagttggcctttgggtacaatgccatctggtctctcttctctgtaagttgtccttaagtcagatgttgtaagttgaagagacctgtattttatttctaagcactcagaacaaaaccctttcaattaaggtggttttttcctgcatgttataatgggaagaaatggagatagtgtgagtttgtggtcaggtcagtgtttcttataacaagggtgtgcttttytcatasttggaaaacgtttgtatgcgttccaygagtagtctgaagctgcctgttcatcagaaccatagcacttaaacttttctcatgagagtcactcctttaaattaagcattgctttttacagtttccatcaaaaatgcaaaaattcaggaaaagtgtagcgttttgttggagttactcgcacyttcctattgaaaatgtttccctaagtacactgtgctctgaggaggagaaaagaagagaggcaggaagtgaaagtcagacagacaaccttcccccactcactactgggcctgggctcccatgtagccccttatacatgtggatgctggttcttgtgcaggagggatgctaggccaggctgctacttcagtgtacatgttgacttaaaacctgatcctttcagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtgtgtaaactatactacaaaagcagtaacactatagtctatgtgcaaattgctgactaattttgccactgatcttggctctggattgggaaaccatacatttgataatgtgatttggtgcattagatttggtaaattaagtgccaatctccctgtatgcttcatcccggacaagtattttacaacattctctctgttttctatatgtaaaggactgaggtgaggatcaaataagttaatatatgtcaaatcactttttcaaactctaaaatgctatataaatacaatagcagctgggcgcggtggctcacacctgcaataccagcactttgggaggccaaggcgggtggatcacaaggtcaagagatcaagaccatcctggccaacatggtgaaaccctgtctctactaaaaatacaaaaattagccgggygtggtggtgcacacctgtagtcccagctactccagaggctgaggcaggagaatcgcttgaacctgggaggcagaggttgcagtgagcygagattgcgccactgcactccagcctggcaacagagcgagactctgtctaaataaataaataaataaataaataaatacaatagcaaccatgatataattaataaaattcagggctagggccaggaagacttacgctatgtctttctggactcatctctcattataacatcacataatgtcttgggctcagccatatcagtcaatccatcattgccaaggctccacgctttcttgcctccatgtctttcaccyactgttctctctgcctgggatcccgctctcctgcaaatgtaccctctggggattcatctctcctttcatgccctatcaatagaagactgacaggagtgtcttctgggagtcaggagactcagttccaccatagcatctgccgctcacatcccagatcactctgggtggtcattcaaacgttctaagcctttgtggccccgtctgtaaaatgagtgactgtattagaagagcctacattttgccgggcagagtgcctcatgcctataatcccagcactttgggaggctgaggcaggcagatcacctgaggtcaggagttcgagaccagcctgaccaacatagagaaacytcatctctactaaaaatacaaaactagccaggtatggtggtacatgcctgtaatcccagctactcggaaggctgaggcaggagaatcacttgaacccgggaggcggaggttgcaatgagccgagaccgtgtcattgcactccagcctgggcaacaaragcaaaactccttctcaaaaaaagagaagagcctacatgtctagcaactccaatagtctctgactgatgtcatyatggacagacccctattttagagactaaaaattggcttccctaaatacaagctaaataaaaataatcaaaatagagccaaattgttacagcaagccaacataatcctcataatctggtgaaaaaattctcactaaaaagttcatacttttggctcagaattgaatttctaggaatctaaagtaggagtctttatatacaatgatattcactgcagttttaagtataacagcaaaaatagtaaactgtcaaaatgattaatatgagaatgattagatcatgtctggcatatcctcagaatagagtgttaagcagcaacttaaaagcatctttgtgcggagctcttgatatggggaatgtcttgtgttataatattcagtgaaaaaaaggaggcataaaattgaatatacatgatgttatcagttgtgttattttaaagtacagaaaataatgtgggaaaaaaaagtggctcacgcctgtaatcccagcactttgggaggccgaagtgggtggattgcttgaggtcaggagtttgagaccagcctgggcaacatggtgaaaccccatctataatattaggttggtgcaaaagtagttgtgggttttgccaaagtaatggcaaaatcacaattacttttgcagcaacctaataaaattccaaaattagcagggtgtrgtggtgcacacctkcaatcccagctactcaggaggctaaggcacaagaatggcttggacccgggaggcggaggttgcagtgagccgagattgygccactgcacttcagcctgggcgacagagtcagactccacctggaaacaaacaaaaaaacgaatgcctcatagtcatagtggtgatttttaggtgatggaataacactactttaatctttctaattttctgtrttacttttgtaactgaaaaaaagtaaacaaactagattaaagtaaatcaaaactgatactttgatctctctgctacttgagcacttgtttctatcccagacacraccaccctctctctctgatttcattgccatatgaccacgttaggtttacttgaaagggacgccartctatgctattcatgcttttttcagctttaacttctcactttatatttctgctttcttgtgaaattattttattcttttttcgttgttgttttttaagagagacgsgggccagacatggtagctcatgcctgtgatcccagtactttgggaggcagagacaggaggatcacttgagcccmggagcgagaccagctggagcaacatagcaagaccctgtctctacaaaaaaagaattaaaggccaggcgtggtggctcatgcctgtaatcccagcactttgggaggccgaggcaggtggatcacctgaggtcaggagttcgagaccagcctgaccaacatggtgaaaaaccatctctactaaaaatacaaaaatcagctgggtgtggtggtgggtgcctataatcccagctactcgggaggctgaggcaggagaatcacttaaactcgggaggcggaggttgcagtgagcaaagatcatgccattgcactccagcctgggtgacaagagtgaaactccatctcaaaaaataattaaaaaaaaaaagaattaaaaaattagctgggtatggtggtatgtgcttgtagtcccaactactttgggaagctgaagtaggaggattgcttgagactgggaggtcgagactgcagtgagctgtgatcgtgccactgcactctagcctaggtgatagaacaagaccctttgggcaacagagcaaacaaaaagagagagagatgggggtctcactatgatgcccaggctggactcgaactcctgggagcaagcaatgtgcccatctcaacctcccaagtagctgggattacaggcgcayaccaatgcacccagctcccttattctttattctgaatgttgtaggaataggccaccatgtattgtatgtcagaggtttgccatcaaaaacagaaccactcattctcaagcatgaatatctagtcttcttagtagttacagttttctctgtggattaatgaatcaacattctagtatgcatatgtgtctacattaaggatgtcagggggacacaaagaggtaacccatcagatagctgccaagtcaatctgaatattgcaagaatttcaaacttactttagagagataaatctttactaatttttgcatttaaagagagcaatttggttgcttggacatagtcacccaaggcagccttgatggaagcagccaatttactggaaatcaattaaacatatgatgaatttgctaaaagctagtctccaaaatgaccaatttgccaaattgctaaatatttatagttttmatcttgccttgggtttgcacatttagtcctgtttggatgcatgttgattccacgttgggttcatatttcagatatgaaacacttcctgaatcttccattttcacacattagtgattacagtttcatataagttttattttgccctaccaccactgctgctgtccccaaggctgttgatgctcctgtctgcctctgctgagatgaataaacttccaagatctgtgtgtgcacatgcagaaatttttcctttgacaaagtcctaggaatgtcaaataatatgtagatatataagacttgatgcaaattgccagaatcaccaaatatttgcaatgatgccaatttacattcacatcacctgggtataagacaccagttgaggccaggcgtggtagctcatgcctgtaatcccagcactttggggggccgaggcgggcggatcacctgaggtcaggagtttgggaccagcccagccaacatggtgaaacctcatctctacaaaaaacacaaaaattagccaggtgtggtgacacttgcccgtaatctcagctacttgggggcgctgaggcaggagaatcacttgaatttaggaggcggaggttgcagtgtgtgtcactgcactccagcctgggtgacagagtgagactccgtctcaaaaaataaaagaaaaaagacaccagttgaggatcttaatttgaattctcttcctaccagcagtgactgaggctgcttgattcctatgcctggccaatgccacgtatcatcaatttttgttttcatctttgcctgcatggaaggctaacaatgatgtctcattgcttttttaatgtgcatgtttttgtttattaatgaagttaaacttttttttaggcttaatgaccgttttaacttctctgaaatacctgctcatggcttttgtccatttttagtgttgggctttayattcatacagacattgattctatatcatagttttcccagcttgcctttctactttgcttattgtgatttttcagaagcagttttcatttttctctagtcaagttttagtattttccccttccttcagatttctttcctctgcttttcacctaagaaaggccttcctcatcctgggttttggtgaatatttatttatttgtttagttgttttttgtttgtttgtttttgttttgttttgtttcccgaaacagagtctcactctgtcacccaggcttgagtgtagtggcgtgatcttggctcactgtaacctctgccacccaggttcaagcgattctcctgcctcagcctcccaagtagcygggattagagatgcttgcaaccatgtccggctaatttttagtatttttaatagagacagggattcattatatgttagccaggacggtctcgaacccctgacctcaggtgatctgcccgcctcaggcccccaaagtgctggaattacaggcaggagccactattcccggccaacacatttaaatactatgatttaatactaaataatttggttgagaaattgggccacaaaatatttaatggaagatagtgttgagtagtgattaaaactgttgctagagattaaaataatttttttttctttttgagacagagtctcactctgtcacccaggctggagtgcagtggcatgacctcagctcactgcaacctccgcctcctgggttcaggtaactcccctgcctcagcctgtcaaatagctgtcaaattacaggtgtgcatcacaaagcccatctaatttttatatttttagtagaggtggggtttcaccacgttggtcagattggtcttgaacagctggccttaagtgatccacccgcctcagcctcccaaagtgctrgaattgcaggcatgaaccaccacgcccagcctaaaataatttcttaatattaaaaatagtaagagaacaataaaaaccccaaataatttttctaattacaaaatttaatccacataatttctatagtagtactaactcagtatttcaccaattcaagatttggcaggacaataaggcatatttaaaaacattttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggaggccgaggcaggtggatcacctgggtcgggagttcgagaccagcctgaccaacatggagaaaccccatctctactaaaaatataaaattagccaggcgtggaggtgggcaactgtaatcccagctactcaggaggctgaggcaggagaattgcttgaatccaggaggcggaggttgtggtgagccgagatcgtgccactgcactccagcctgggcaacaagagcgaaactccatctcaaaaaaaaaaaataaagaaaattatagcttgcttatttcttcccccacttagaaaaggaaatgggaccaaccgatagccaaatattttaaatatgcatgccaagctttaatgccaaacgtgtacttttttgtatgtaactctctaagttggtcaattaaaatttcaagattctcccttaacatttcttaaagataaatgatttattatgcaaatatttttaagcgtttactttgtactaattaatttttcaggtggtggctggcaagaaatattttattgacttcgtggccagggaaaccacatgttccaaggaaagtaatgaagagttgaccgaaagctgtgagaccaaaaaacttggcgtgagtagtcatgcacctgtctactttttcactggaagcctatttgatgtttttagaatcatttgtttaaatgtctcgtgaataacactgtctctctttcgacttctgttttcatggatagcaaagcctagattgcaacgctgaagtttatgtggtaccctgggagaaaaaaatttaccctactgtcaactgtcaaccactgggaatggtatgattctaattacagtcagcgtggggtcagttctgctcattctgaaaatccatatttgggggctgaaaatgaaccattactgaaatgaattggggagctatcttttttaaatgggaagtaactctcacacttctgtgctgatctctgtttaatggctagaaagaagagtaacaatcctcctgatcacttctcacacattgtcagtgtctcagtgaagcttctatagactctctcctagtgcactgcagtcctgctgtgggggagcaacattggctatgccaggtgtacctgaggccagatacagcactccactgcattctgctgacatgcaaggaccatgtgaaaaatgcatggctgggcgcggtggctcacgcctgttatcccagcactttgggaggctgaagcaggcagatcacctgaggtcaggagtttgagactagcctggccaacatggtgaaaccctgtctctactgaaaatacaacaattagctgggtgtggtggcgcctgtaatcccagctactcagggggctgaggcaggagaatcccttgaacccaggaggtggaggttgcagtgagccgagatcctgccactgcactccagcctgggcaacaaagagcgaaactttgtctcaaaaaaaaaaaaagaaaagaaaaattcagactcgcaaaccccacttcacagctaccgaattttaaccagatccccaggggattcatatgcatgaatcaagtttgaaaagcattcgttgatgtcatctttcttttttaagtcttaaaagaactctgggaggtagtaacactttccctattgtcaaggatgagacactaaaaattagaaagactctgaggtcctgagtgaataatgacattatcaaatgcttcctctgtcccaggcactatactgaaggtttcacccacattttcgagtcctccttataactctgtgaggcaggtgctgttattatttctattttacagaaaggaaaagtgaagctgatggcacttggattcaaatcttggtcaattcagagtctaccctttccatcacgatgctgattaccagtagggtctggccggactccaatgaccatgttctttgcatcaccagacactgyttccaattaacacattctcacaggtagcaaaagtgtaggtagaattaatccacagatcgacatatttgaagcaggttacctcttttccctcttttctgatttggtcttttgtcatgtgtaggtatgtagatggtgtaacacaaacattgtcctcaggttgcatttcaagcttgcgaatatgtcctaatgtgcttcagcacaacaaagtgatcatggatacatgctccctatatattcagttcataaagccacttagggccttttaggataaaagcagtgatggtggtaataacagtagtatcaataattaaatactgtgctcagtaaaaacataggctcagaagctaccctagagattagctagttcaaccatccagatgaagcaaaaacactccagcttattttacagttttttttgttgttgtttggctgggtttttttgtttttttttttgttgttgttgttgtttgttttttgttttttttgacagagtcactgtcgcctaggctggagtgcagtggcgccatctcagctcactgcaacctccacgtcctgggttcaagcaattctcctgcctcagcctcctgagtagctgggattacaggcatgtgccaccatgcccagctartttttgtatttttagtagagatggggtttcagcatgttggccaggctggtctcaaactcctgacctcaagtgatctgctcgccttggtctcccaaagtgctgagattacaggtgtgagccaccatgcctggctattttatggtattattaacaacaataattaatgtccacaaattttaagatcaatcaaaagacaaaaaaaattattcatcctttctggaatgttaatatagcatttaaaatctggcaaacacctcccccattgtaaactaagatarcattgccagatctcagtgtttttttctatcatcaatagcatgatttttgcagtaatacattcatcttaatattttctgtttagatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccayacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagyttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtytactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccraaattttatgaggaaattactctctagtctcactttatagtctttttgctatgactttgaagaccattgatttttgagaagcagaataayaggattgcctttcattgccctatagtgcaaagaargtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgmgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggyaaagaagcaaattgaaaatcaataaagtaaaaagtgacggagattttaaattttctgtaataaaaacacttattgggttgggcatggtggctcacgcctgtaatcccagcactttgggaggccgaggtgggtggatgacctggcgtcaggagttcgagaccagcctggccacatgtcgaaactccatgtctaataaaaatacaaaattagccgggcgtggtggcacgcacctgtaatcccagctactccagaggctgaggcaggagaatcacttgagcctgagaggtggaggttgcagtgagctgagattgcaccactgcattccaggctgggtgacaaaatgaaattcagtctcaaaagaaaaaaaacatttatcgaacacctattacagccatttgctatgctagataatttacttttggcatataacttaatcctcacaaccactctaaggcccccatgaacatcattcttttacaaggaaactgtagttcacagtgccctgcccagggtcatatagttaataagtggcagggctggcattcagacttagaccttttgaactccattacaccatgtcatctgaaggctttattattaatgttgtcattacaaaagacacaccaagtcactgactacagtcacagagacccaataaattaaaaaaaaaaaaggcatgccaagataatgtctgactctgagaggatccttgtctcaatccaaaatatccttattaaatacctaattgtggctggtgctgttctgtgtattggtcaggataaactgagttaagcagcagtcactaactatttaccatatgcttcgcatgaggtcctgagaggaaaagaaagaaattttaaaagacataaatcctttccctcaaagatcttgcaatcccattggcaagtcaagatgaaagcatacggaacaaagatttgatccaggctgcagtcttttgtgcaacagtgagtgaatgcaaccaatgtgactggaagaagttgactaggtagagggatcagctgtgaaaggtagtatgaagcccagctgggagtctaggctgaaatatgcagtagagttccttctacagtctttgccatactcagagggagtttgagatagatgattctgaaggttctgggtagggtggatcagaatgggaagagaatggagtcagggttctgttctgggtatttcctgacaatcatgttttagcagaaaaataacgactcagggctgatatataaagcctatacctctcagcttactcaacaacatgaagtatttccacttcaggcctttgttaggtaacataaacatgagtttcccgtgacccagaaactaactttcttattttttaaatatctataccagccgggcgcagtggcttcacgtctgtaatcccagcactttgggaggccaaggcaggcggatcacttgaggtcaggagtgcgagaccagcctggccaacatggcgaaaccccgtctctactaaaaaataattaaaaaaaaaattagcttggtgtggcggtgggagcctgtaatcccagctactggggaggctgagacacgagaatcgcttgaacccgggaggtggagattgcagggagccgagatcatgccactgcactccagcctgggcaacagagtaagactctgcctcaaataaaaaaaaaaaaaaaaaaaaaaagacctaactaccaagccaaagtcacaccccaagtgtctggccctggctctggggccacacagctacatcgctccgtgcttctcttcagggcaggcatttcctgtcgtcgagtccaacccacattcctcacattgtctacgcctagttcctcaaacaggaggcccctattggctttttactccactctccacttcctgcttctaagcctggttccaaaggagttaactcacagaaagacacatgcttttcggcctcaccccagtctgtccggcgcccatgctccccttctgctcatactctgtacattcacctcgcgggaaagcccagactcccaaggctcctctgagaagatttgagaggatccagcagctatatttaaaactcactcttccagaagcccagtgtctctctctctatattaagatagatgatcaaaagccaaaatgccacttcaacatcttgcaaaaatgctatgttaaattatttaaggttggctgggtgtagtggctcacacctgtaatcccagcactttgggaggctgaggcgggtggatcacctgagcttgggagttcgagaccagcctgactaacatggagaaacctcgtctctgctaaaaatataaaattatccgagtgtggtggcacatgcctgtaatcccagctactcggaggctgaggcaggagaattgcttgaacccgggaggcagagattgcggtgagccaagatcgcaccattgcgctccagcctggacaacaagagtgatactccatctcaaaaaacaacaacaaaaaattatttaagttatactttcatcttttatttcataagaatttccatttgaacaccattctgtcttttgcaaaactttgaggtattgcccagtgtatcacagttgaggcagtatagtgaggtggttaaaaaccagagttctgtagttacagcctgagtctaaaaactgccaatttgcttaacttcccagtttaaattctcaaagtcccagtttccccatgcaaaatattactttaataatgtacttacctcatggggtgttatgagaattaaaagagataaattcttggccaggcacggtggctcacgcctgtaatcccagcattttggcaggccgaggcaggcggatcatctgaggtcaggtgttcgaaaccagcctggccaacatggcaaaatcccgactttaccaaaaaatacaaaaagtagctgggtgtgtggtggcggatgcctgtaatcccagctactcgggaggctgagtcaggagaattgcttcaagctgggaggtggagcaattcatacaaagtacatacaacatacaaagtaagaatagggccgggcatggtggctcatgcctgtaatcccagcactttgggaggctgaggcggctggatcacttgaggtcaggagttcgagaccagcctagccaacatggcaaaaccccgtctctgctaaaaagcacaaaaattagccaggcatggtgacaggcacctgtaatcccagctacttgggaggctgaggcaagagaatcgcttgaacccgggaggcggaggttgcagtgagccaaggtcgtgccagtgcactccagcctggatgacagagcaagactccatctcaaaaaaaaaaaaaaaagaaaaagaaaaagaaaaagaaaagctgcagtgagagatggatgcagggatgccgaagggttccagcctgttctccctcgcccctccttggcactcaacatttcctccactgctggccgtgctaacctatagccatagtacacctaacagggcaagagtcttccaaagatttctccactaactcccctgtgcagtcccttggcagctatatgtacctgtccagttttccctaaaagctctgacttgtccaggagcaccaatgcttttggaaggctaatgaataaccttcttcagatcctccaactccctttccctggaccttattttcctagctcctcccacaatggcattagatttagataaatctcctatgccataggattcacagtggttctgcttccttgatgaaaccttgactgatgcaccagccttttttttcaccctatcaatttgttaccaaaacaccaagggttaggtctaggctctgctgcttgccacacagaaagccaatcactgacacgagtgttgccagttaagaaggctttaattgggtgctgcagccaaggagatgggagatcagtctcaaatccatctccctgactggctaaaattaggggattatatagcagggaagaaatgtaactacatacaggaaaacaggaattagggaggggtaaggaagaggagctgttcaacaggaagcaggtagccacttaggcaaccatggtaggtgaggagtctgatgtcttattgcctagatgcagtgatctggtaagtttcagtttattgacactatctaggaagcctgatggttggatgcctgagaaagaaactgagcaaagacaaatgtaacttcctcaagtttcaagactgggaggatcagtttctatgtttattcaaaagaagccataaatatcagttctatgggacaattggaccagtttcagaggtatattaggagaacacattctattgctttcaaatgcacagccaggcccggcaatgcgactgcatctgagcatcttctaagaaaataaaggctggccaggtgaggtaggtcacgcctgtaatcccagcactttaggaggccaaggtgggtggatcacctgaggtcaggagttcaagaccagcctggccaacatggtgaaaccccgtctgtactaaaaatacaaaaattagctgggcatgatggcgggtgcctgtaatcctagctactcaggaggctgaggcgggagaatcgcttgaacccgggaggcccaggaggcagaggttgcagtgagctgagattgcgccattgcactccggcctgggcaactgagcaaaactccatctcaaaaaaaaaaagaaagaaaatgattaaaggctgttcctgtcctcaatatcacactttagagagaagcacagacacattaaaaaatatataaatcagcataaaaattccaatagtagaggtgtgtttaagctgcaatgaaagcatagagaaggaagaatcaagtctgaaaagctggaagaagctaagagggcaaagacctatctcacacagcatcatattcctagggcccaggcacaaggcctaacaaaaaattagtgctcaataaatatttcttgagttgaattgagttaaactgaatttgttcacaacacagcgtttagccctaggaatgcagcattaacaacacaagccgggtgcagtgactcgcagctgtaatcccagcactttgggatgccaaggcaggaggatcacttgaggccaggagttcaagaccagcctgcgcaacatagcaagatcccatctctacaaaaaataacaacaacaacaacaacaaacccagatgtggtggcatgtgcctatactcctagctactcagcaggctgagaagagaagactgcttgagctctggagtacaaggctgcaatgagccatgattatgccactgcactccagcctgggtgacagagcaagaccctgtctctgaaaagaaacaaaaatgaaaaggaaaaaccagacagttcacgcctttgctcagcttacaatctagtgcagctcttcacaaattttagcaccagaatcttctagaaaacttacgaaaaccggccgggttcggtggctcacgcctgtaatctcagcactttgggaggctgaggcaggtggattacctgaggtcaggagttcaagaccagcctgaccaacatggtgaaaccccatctctactaaaaatacaaaaattagctgggcgtggtggtgcatgcctgtaattccagctactagggaggctgaggtaggagaattgcttgaacctgggagccggaggttgcagtaagcggagattgctaactgcactccagcctggacaacaagagcaaaactctgtctcaaaaaaaaaaaaagaaaaaaagaaaacttattaaaaccccaatagctggagcccattttcagagtttctcattcagcaggtctgtggtggggccctagaattggtatttctgacagcttcccaggagatgttggtgctattggtctgggttgcatactttcagagctactggtcaagcgcagtagttctcaaccctggctactcattggaatcacttgcctaactttaaaaaataccttgctagaagcatcagcccagacctattaaaggtaattttaatgtgcaggtcagcattgaaaccactgatatgacaaataggagtagttaatattatttgcttgc

SEQ ID NO: 17654 - DNA, 231914 bp, Homo sapiens
  misc_feature (1)...(231914): n = A,T,C or G, or insertion/deletion polymorphism (see Tables 1-2)
caggtgatgcaagtgcactaaattcattgaggtgatcactgcacaactctttggctatacttaaaaagcattgatttgaagactttaaattgtatggtatatgaattatatctcaatagagcatatatatataaaatatgtattatataattatatattatatgtaatatatataatatataattatatataatatgtatatataatatatacaacttcatcttttatgttcaaaggctacattgataaaactctggttagaatcaggaaggagcaagacatcttactgatggtgctgaagggtgtatagaacaaaaataattctgaaggaaatgttacaggctgggcacagtggctcatacctgtaatcccagcactttgggaggccaagggggtggatcacctgaggtcaggagtttgagaccagcctgaccaacatggtaaaaccctgtgtctactaaaagtacaaaattagccaggcatggtggtgcatgcctgtaacccagctactcaggaggctgaggcaggagaattgcttgaacccaggaggtggaggttgcagtgagctgcaccattgcactccagcctgggcaacaagagcgaaactccgtctcaaaaaaataaaaagaaatgttactataactgaagctggtggaaggataggaattattattttgtcccgtgttacatacttgattctaagtgttggaaaatgactctattaagtaggaagtgttcttaattagtccatgtctttatgtttccatgtgttttgtaatttatagttattagtcttataaattttaaaagttccaagtcatcctgatgctttgagttctacstagtggtcaaactcctctctactatgtgtccttggacgcctgacccaccaggtactagtgttatctggtagtgatactgttgaattttaatgacctggctgagagtttccatattacctccttctgttataaaacaaaatacaagtaggcctgtggagagttctccaaactgagaattttagtacagctttcctacaggaggttcactaagaaatccacaaacatcatgtggtagcctaccaggtgctccttagctgcaggaaagatacccatgccctggagtgttgtatgtttccagacactcagaacacttctaagtgtttcttgatgtttctggtatggcataacccccaaaatatattaagcaaaataaagcaaggtgtagaagagtgtgtataatatgttattatttgtatttaagaaaaagtgggtataaaaatatacatgtattttcaaaacatatctctagaagatgtgattacatggctgattctggaagagaagttggtgctggatacctaggagctgggtacctagaagcaggtgtgggtgaaagacatttcactatatacttttgtatcttttcagttgaaggggcaagggaaaacttctcctttgccctctgaaggttcactaaacatcaaatgacaaaaggtggattaatagtagaagaggcacataaatttatttgatcatagttttccatgacatgggagccttcgaatgaagacccaaagatacaaaggaaacgttcatttttatgcttaggttcaataaactgtggacaactgtgtaaaaatatgattggacaaaaagggtataatctaatgctaatagactgagtagggaaactcagcaaggcctttctgtttgtattcctcctctctgtgcagcatttcttccttctgatggggcaagactctctctggaatggggctcttatgacctacagtcaaacaaggtaggtcagataatttctttatggccagtttttacacagaaaggccagggggagaagttagaataatatttttaggtttcctggctggctttaaggaaaagggattctggtttctataacctgccttggggaagagggattctggtgtccttggaggagaatgagtggccagagacaggagggaagaagaaggtcagagagaaacttttgcttctgaggctgcttctgaagtcttcattttggggtattgttttctgagcccccaaacaatttcaaaccatataactgtatttgctattcaaacaggaatacaagttaaattaaaacaaaatcttcctaggatggttaattaaacttgaggctcagattggcccttgataatttactctttgtccttatttctcatccctggggtcttctgtcttcaggtcttccacccctgatcagttgcctgccacagacatattcaaatattcccctccgtctctgagcctaatagaaactctacacagggatgaagcaggatttctaaaatctctcttgtgactgattgccatattgaacctcaggctttctagaccagtggttctcaaccttgagcctgcatcagagtcacctggaggacttgtcaatacgcaggtttctcagccccacacccagagtttctgattcagcaggtctggggtaggacccaataatctgcatttctaacaagttcccaggtgatgctaattagggaccacactttgagaaacactgctctatcctaaaatagtttctcctatgatggattgatgtgtagtttttgtgttccagttgtgtcttcatttagacatataaagaaataaaaggagagctatgttcctttccatgggcatgcttatagtgcaccattgcccagctctctgtccagccaacaatacccttcaggctcgttatgcctcataagacaatatgcattttaccaccagcagagctgacacatcagaaacctggcatcctccttcatctctacttcccggagcagacattcttgtggtcactgccatcaactccctgtaaagacttaattggtattttagagsaggcactagaagagtcatgctaattactcatttcccttccagtgtttctctccagtggtgctattagcattttaggcaagacaaaatgctttataatgctctttataatgagcattctatttaatgtaggacattcagctcctttcccttgttctcaagtcgttgtgacagtcaataatcccactgcgcatcccaatgctccctcaatccccctaacccttaaccccgtgcaacctgcctgcaccacctttacccacctgcacccccacctccaggatgggtgatgagggcaactcaactttccactgagaaccaccaagacctttattaaattacctgtccagacctttgctttagatccctgcaaaaatcccaagacatattttattattttcctttttatcaaatgttgatattaaaaagttaccaaactctgaggctgggcgcagtagctcacgcctgtaatcccagcactttgggaggccgaagcatgtggattgcttgaggtcaggagttcaagaccagcctagccaacatggtgaaaccccatctccactaaaaatacaaaaattagcaggacatggtggcgtgcacctgtagtcccaactacttgggagactgaggcacaagaatcacttgaacatgggaggcagaggttgcagtgatctgagattgcaccactgcacaccccagcctgggcgacagagcaagatctgtctccaagaaacaaaaaacaaacaaacaaacaaacaaaaaacagtaatgaaatgccaaatgtttccttttgaaaaccctattggtagaattgtccattgttcagtggacaattgtccagtgttgttcagtcctctctctggagagagaccttttggagattagcactggagggccctgttacctgatgaagtggcttcgtgtcctcatttgacaaggagaattgtgtgacctctcctgtttccttttttgccatgagtgtcagggaactcggggatagatgtaatgcctgatagggttgaaaaattagcttagaaaatcatttcacccatattatcagcttttatatagttttaatttttacataattaacagctttattttttgttttcttgtgagtggcttctaattatttgagaagcaggagagtattaaatgtctgtggtgcatgtgagttgtgaaataatagccagatgtggcctaatcagctgggcaaaagaatggaaatgacagagcacccaggggcctcccgtgtgcatgggcagggtagggaactgaggatagggagagcagcaggtttggaggctcctctggctggtagaaagcagaagggggctgctgagaatgaagggccaggtgtgctcactggaggtggggtcaaggttaaggaactaagaagcaataggtatccctaaaccttcaccagagatggatatacattgaggggggtggcagcagatgtcctgagcttgacctttctcttcaaggtcaagagaagtcctgctgggattgcctggattagcttatgagacatgtggaaaccattccttatagaaacacctgttctgcttgagctctcatttggtcctgtggccaaacagattacagggagcaactgggtgcagacaaggctggcattcctgaaatgaactttctgctgacacttcctgtccaggtggaaaagagcacctggctgtgggactgtaatggggtgggaattccacctcatcctgccccttctttgagagccccgtctctcccgtttccttttcaaagtgtccctcaaagtgtcaggggaagccacaaccctaaactcagggtttccaccctctctctctcctttgtgatttattaagggattgtgtaaggacgttttcagtgtggaagtcccctgctgaaatgctgtcttagtctatctgtgctgctatgacaaaatacctgaggctgggtgatttacaaatagtagaattttttttcctcacagttctggaaaatggaagtccaagatcaagacaccagcagatttggtgtcttgtgagagctgttttctgcttccaagatggtgccaagttgctttgtcctcacttggcagaagacagaagagcaaaaaagggcctcaccagttcgctccagcccctttataaggttgctgatcctattctccagggctctgccctcttgacttaatcacctcctaaaggtcctacctcttaacactgttgcatcagggattaagattcaacataaattttgggagggaacagaaaacattcaaaaacagcaaatgccattgtgagggcttgatttcctttggattttcaaactatccttttcaaattaacacaccatctggatgggtagcttatggagggctctgaaataagttatttgtccctctgaggaaatggaattgctacttactgtaggtatttatttccctcttaagaagtgagattttccctcagaggaaaacaaaagtgtctgaagggaggagaagggggaacttcaggagcctgggccaggctgagtcgggggtcccgtgttccaccttggtgtggtgctgggggaacagagcatatcagcccagccctgggacagtgaaggtaggagagacactcctctagaagcacagtgctttcccagtgtgttggtgtttcttttcctgccctgtcagccctttattcccctggccatgtcaccgaagccagatccctgatagccaggagccagctccctccagaatgccccaacagccacctacctgcactgcctttcacctgcaggaaggcagctcccatggccttcctccctcacccctgccagggcctctccctagaccctgcaatctaccctgagtaccaccgtcatggttctgcgtctgtcctctgtgggggaagaaagtacctcgttctggttctccttgtaactattgttcctgaactctaaacgtataacccccccacacggtaataaaagccacccatcgtcactgttgggatgcttccctatttctacatagcctgtcccagagtgatgtactcctcccagccgctcccacatcccttttgcgtgtctgtctctgatttggctttcctttcctccttcccacccacccaggtggctcccggctgcctctgctgcagttcagagcaacttcaggagcttcccagcygagagcttcaggacgcctttcctgtcccactggcccagttgccacaacaaacaacagagaagacggtggtgagtgaacagagtttacattatgctgttgaccattcctcctcagtccaccctggggaggctgcagagaggggagctgtgtgtctttctaggtgcccagaagagactgctgcccccaaggtgagatggcacctggccagctgcccaagcaggtaagagtgaaggcagtatgctgtagcattgtctgttgatyttggcttagctggtcagaattcttgaactggygaaggtggtggaaatcatcattggaactagccaggaaacaagattaagggcctgcgggktgccctggctgctgctagaaactgttcacactgcacgctgtggtactccatccttccaagctggctgaaaactttctcctcctgctgctccaggatgctgctctgactaactctggttttgatttctcctttgactccatggttccttggcaagcaggcattgttggggatggaacacaggtggaactttgtgttacctggacccataaccatagctagttctgtgggactgagcagctgccagaacactatccataacctggtcacctgcactctgtttggtgagaaatcctgtgtgataataggtgtagagtgagcctgtttaacaaagacagtgccttctttgggcagctgtacaatagtaaatattctaaataatattccaaaatgtgggtgatcgtttgggatttcatatgtgtaatttggggcttagggtgtttccattgctttctgcagctttagcagtgaggaaggtggtttcccgctgctacccttgaccccctccttagggtctaactactacagtacttcaggggtcctcagctaacatcagcctggggtgagggtgtcagttaactctcagtgcagaggaggctggcagggccaaaaccaataccagtgaaacaaagaaagtgagaaggttggtgggtggtggacctggggaggcatgaattaataacaggaagtgtggtctgtgatttcaaaaaaataatacygataatttcccccatggtgctaaacctgctttgaactatgaccccatcattgacttgagggaatagcttcttagattactttgaaagacatatcgaagtatgtagggcctgctgttttgttaaggaaataaatcccataacattaaaggaattttttwaaaartkactataaggttggactctaatatggctgataaagggaaaagcagtgtcctgctactgcctgaaagaaaacacagcatatgtggctcagatgggggctttattttaggatttgtgggaggctggaccaaagcgaacactgaacatatgagcaaggcgttctttaaaggaaagccttaaggcttttcacactgtgaagcaccrtaggtagaagatcaaaggatgcacaaaataatgcaagtcccttctattttaaagacacatctgcctggccaaaagtcaggatgaaagtagtgcctctggtactggtgagtgggctatgccagaagccctctttgtttagtcacctactttatgctgtgacgggaacatttgcagtgaggaaaagaagtaaataaaaatgagataaaacttcagttttaaagcctaggggcacatgacaccataggactcacccagtattcctttctttgcatcattggggccatgtgagcaaagctcttgagatacatctggtcagtgcaaaggcagtctagaactcatgcccttctttgtgagtcccttaaagtctgagccaatgggacactcataggtaatacaggactccttagcaagttgtaaacattttttaaatttaatttaattttaaaaaatttacaaataatagttgtgcatattcatggagtacatggtgatgttttgatataattaatatatggtgatcagatctgggcaattagcatatccatcattgcaaacatttatcatttctttatgtttgaaacattcaatatcctcttctacctatttgaaactatataatatattattgttaactatagtcatcctaccatggtatagaacagtagaacttcttcttcttatctagctgtaattttgtatcctttagaaatctgtccctatcccacccttcttcctacccttcccagcctctagtatgctctgttctacttttttacttctttgagatcaatattttttagctttcacatatgaatgagaacacaccatgtctaactttctgttcctggcttatctcacttaatataatgtcctccagttctatccgtgttgccgcaaatggcaggattcattcttttttatggctgaatagtattccattgtgtatctatacaacattttatttatccattcatcttctgttggatacctacattgatcccatttcttggctattgtaaatagtgctgcagtagacatggggatacagacgtctcttcgatgatttccttttttcctttggataaatttccagtagtagaattgctggatcatatggctgttttatttttagttttggaagaacctctatattggttttcatagttgctatactagtttatattcccaccaagagtatatgagtttccttttctcctcatccttgccagcatttgttgtttgtctttttgaaaatagccattctaactgggataagatgatacctcattgtggttttgatttgtatttccctgatgattagtgatgttgggcagttttccatatatttgttggcaatttatatttcttcttttgagaaatgtctgttcatatcatttgcccattttctaatcagattgtttttctgctgttgaattgagttccttgtatattctggatattaatcccctgtcaggtgaatagtttgcaaatattttctcccatcctgtaggttttttcactatttgttttatttgcttcccttgctatgcagaaacattttcatttgatataatactatttgtttatttttgcttctgttccctgtgcttttgaggtcttattcataaaatattttcccagaccaatgttctgaggcattttccttatgttttcttctagtaattttatcatttcaggtcttacatttaggtctttgatccattttgagttgatttttgtataggatgagcggtggggggtctagtcttattcttctgcatttggatatccagttttcccagcaccatctattcaagagagtatccttttcccaaagatgttcttggtacctttgctgaaaatcaattggctgtacctatgtggattaatttctgggttctctatttgttccgttggtctatgtgtctgtttttatgctaataccatgctgtttgggttactacagctttgtagtatattttgaggtctagtagtgtgatacccccagctttgtcatttttggtcgggactgctttggctatttagggcctttcattgttccatacaaagtttaggattttttttctatttatgtgaagaatttcattggtattctttggataatattgtcattttaacaatattaattcttctgatccatgggcataggatgcgtttccacttgtttgtatcctcttcaatctctttcatcagtgttttgtagtttttcttgtagaggtctttcacctccttggttaaatttattcctatttttttttagtagctattgtaaatcggatttgctttcttgatttcttttcagctagtttgttgcttgtgtgtagaaatgctactcatttttgtatattaattttgtatcctgtaactttactaaatttgtttatcagttctaagttttttggtagagtctttatatatatatatatatatatatatatatatatatatatatatatatatatatggtgtttttcatcttttcatttccagatgtaagaatcccttgagcatttcttgtaaggccagtttagtggtgatgaattcctttactttttgcttgtctgtgaaatattttatttcttcttcatttctgaaggttagctttgctgggtatagtattcttggctgacagagtttttcccttctttctttcaatagtttaaattctattctttcctggcctgtaagattccttttgagaaatctcctgttagtctaatagagattcccttatatgtaacttggtgcttttctcttgatgctttcaaaattctttctttgtctttgacttttgacaatttgattataatgtgccttagtgaggacctgtttgggtttaatctatttggggttctttgagctttctagacctgaatgtccatctctcccctaagacttaggaagttttctgctaatttttattgcattaattgatttccttttagttctttttaaatgatatccatctctttgttgaatttctcattcaaatcttcaattattttcctgatttcatcagattatctcactgattttccttaagattattatttcgaattgtttttctggcatttcatatatttccttatgattggattctgttactggataattactatctttcttgggaggtaacatattttctgatttttttatggttgtgtttctacattgatttctatgcatctggtggaaaagttgcctcttccaattttatgaagtaggctttgtagagaaagacttatatgaatgtgtcttgtgatgtcggttcagtggggtgcatttgcctgggttctaggtggatgcattagtgtagtctctgtgtagtttcttcacctgtaatccacactagtggcatttgtgatttctcagtgacctaggctgaaagagtttgtggtgacagtggtgcagctttgctaggctgggcttgctgggctctttctaaggttggaggatataaatgtaaatgatggattgaccaaatttgggtctagcttgctgggtttgggagcccagggctgttattttggccaggagcatgagcatgcagatgtttggccaacctagtgtgcctgtcaggagtggtctgtggggctgcttttcagactcaggacaggatgcggacagaagtccacttggctggactcaggttgtgtttgctggggactacctacaggtctgtttcttatgcttgtgacacagctgcatggttgcctgcttggctggggggcatgtctgctggggatggcccatggggctctttcttcatctcaggacatgggcttatagctgctcagccagcctggtgatgtgtctgccaggggcagcccatgcagctgcttattaggcccaggatgcaggtgcaagactgctcaactggtgtggtggcatgcctgccagaggtggcccacagggctatatctcaggctgggacgtggacagacagctgctcagccagcctgggagaatatctgctgagggtggtccacagcgttgtttcttaggtttgggacccaggtgcaaagctgctcagctggcataagggcatacctgccaggaatgtcctgtgggtttctcaggcccttttttgggggtgggggtggtacagggccactaggcaggccagggacatgcctgcaaaggggggatgctattatggagctgtttctcaggtcctgagtgtggatgcatagccactttgctggtgcaggggcatatcaactgcttgaaggctcaggggcctctcctatttagaggagggcatgcaaccatttggctggctcaagggtgggttttccccaggcagaactggcagattgttcctctggctggaagtgcaatggcaggggttggtttccctgctgtacaggaccagagtcacagctgatcttgggcccatgcaactggggttgtggctacagccacccacrtaagcttggtgtaaggaaaatggagctccagtgctggaaggtgcagtacttactggcccccagagcaggatgcaatccagaggtggctgaggtctcaagattgtgccttgctgcagcagcttggctcacaagggatgggagagatgggaagtgcatactttgtgctccgaattcagggcaatgtggctgtgtgaattccagtggctctccaaactgggcccaggacttgtaaggactgtgggattctcctgttgtaaggactgtaggtgtttgcaatgccagtggggaccggtggggatcttctgcttatcttttccttgcaacaagaagtctytcctgactccagacaatcttggcaggggagatagatctgcagaggttgggtggctccatgctgccctcctggacaccacaggtgtatctccatgccctgctactttctaacactctccctaccaacatttcttaatagatgtttcaaaagggcaagtaacctgtagtttcctccataggtattttcagagatgtcagtggaaagtctcttatctgaattctatgactttttttttcttttttttttttttgagacagggtgttgctctgttgcccaggttggagtgcaacagcacaattatagctcactgcagcctcgacctctcaggtttaaacaatcctcctgcctcagcctcctaagtagctgggactataggcacacaccaccatatccagcttttgaattctttgtagagatgggatcttgctgtgttgtcagggctggcctcaaactcctggrctcaagcaatcctcccacctcagcctcttgaagtgctgggattccaggcttgagccaacgaacccagccttatgaattccgtgtttttaatgaagatgatcattctgcttttgatataataactttgaacaatgaattatgatatatatatcaaattatatttacatatgcttcattattatttttctttttttaatgaaagtacatgtattttagagagctctatattgcttgatatataacttgtagttaaatatggggtttgatcatgtttctttaaaaggtgggcattaggaccttgatcaatagtgtaaccatctcttacgttattgtttctatgaaaaattcagtccccttccccagaaaagaatgtaactcccatcaatgtggctaacatgacatgacattctaccaggcatgactttcattcatttaacaagtgctctttgaatgaggagtgaggcaaagtccctgctctcacgtaattttcattctagtggaacaggaagacagtaacatccagcagtgattttaaagtacagtaagagccagatgctgtggctcacacctgtaatcccagcactttgggagaccaaggcggatggatcacctgaggtcaggagttcgagaccagcctggccaacatagtgaaaccctgtctctactcaaaatacaaaaattagctggacatgatggtgtaggcctgtaatcccagctactcaggaggctgaggcaggagaatcacttggacccaggaggcagaggttgcggcgagctgagatcgcgccattgcactccagcctgggggacaagagtgaaactccgtctcaaaaaaaaaaaaaagaaacaataaagtacaataaggagcataaggggatgaagagattgggtagaggggtattttatataggatggtcaagtggtcaagaaaggcccccctgtggaggtgatatgtaagcagaaaacaataaaataaaggagggggtcttgagaagatctggaggaagaaaactattcagggtaggaaaactgtccattgcaaaggccctgagtcaggagtgaacttggtgtggttggaggaacagcaaagcaggccagtgagtgtaagagtgggagggcagagcttaataggagatgagtttggggcagtgagccagagctgggtgatgcagggccgtgtaggccatggtaaggggtttgggttttattctgtgtgtagtgggcagccattggagggtgttaagtggggagcaccgcaatctgactgtgtgagggagctaactgtagggaagtgagagtggaattagggaggcacataggagactgctacagtggtctaaaagcatgacaatggtgccttggatggctggtggcagtggaggtggaggggagtgataagattaaagttagaaccagtcagagctgcttatggattggaagtggagggagaggagtgagggatgaattctgggcctgagcacttgggtggacagtggagccttttgcctggatgggaaatgctgtgagaagagcacatttagctggaggaaatggagaggtcctgtatgtcttgttagataagccagtcgagatctggagtagacagtgagatgtcaaattctggaggtcagtggagagggtgggataagaaatgtgtgtggagatcaccagcttctggatggtgtataaaaccacaggactggatttgatcacctcaggagtgagcatgccagtcatttagagacggggaaaaggaagtaggaagaaaaacaggagagcatggcattccagaaaccaagggaagaaagtctgtcaagaagcaggggtggtgattaactatgttaatgtgttagtgcagccacgaggtgtttaaacccattatcacacaaggaatgatgctctcttggtgatttcctgctttcatatgtgttcrtggacctcatcttcccccattaaactggaacctcattgaagccagggatgatttctttcttctgtttgcacttagagccacttaaagctgtcccttaactgcctcactccaaaagctctgcagtgtgaggttgaggcctgaagtgacgtttcctgaggagctacttttggagttgtgtattgggtgggtgtggggacagtgatgacaaggaagtccaggactagtcccttcctaggcagaagaggctactgatatcccaactctgagtagaagggttgggtggcagaggagaagacagatggaagaagtaggacagatgcacaaatgtgtcagattcttaacttcagaaactgtcagccccacaaacgtggtcatagaacttcaacctgaggaagcagggacactgatgggtcatgatgggctctttgcccactgattgatgcagsagtgggattctttaccatactctgtaaagtacacatgaccccctgctgcagatgaagaaggatggaggagtccctcatggcttcccttgaaggtttcttacacagaactaccagttcaggttcttacaaagactggataatccagatggtacctgtgtctggggagtaattctatgggctgcgctttgggacagcagtggcctcttctcttgaccaggtttcatttctctgtattgatgaggagtacccaggcctgagggtctggccatttttgactagaggcagtatctgtgttggaatagcctgaagaccctgtcttagcctattttawgctgctrtaaaagaatatcacaaaccaggtaatttataaagaatagagacttatttcttacagttctggaggctgggaagtccaagttcaagggctggcttcttgccagggccttcttgctgtgtcatcccacggtggaaggtagaaggacaagagagaataagagagcaagaggagggttggacttttttttaaataagaaacccactcctacaataatgaacccattcctgaaataacatgaatctattaatgagaacaaagccttcattacttaatcacctcttaaaggtcccacctctcaaaaccgttgcagtgggagtcaagtttccaaaacatgaattctgggggacacattcaaaccacagcaaccccctacagggttggacaaactggaagttaatctatataggtaaagggttgggttttctggcaattgggagattgcgatgaggtttggatcttgtcctgtctcttacataaacataatgaaagcagacgacccatagtatcataggaaagcataagagtaatttctggttggggcacttgtgaacactttgacaaaatggaaagccatcttgggggaggcaggaccagcagttgagcccctacaacacaaaggagaccctgggtgcgggatgaaggtggacccctagccctgtaaagtttaagctggtaggaggcctgcagatcaagggttcatcccctggagtttttcttggaacttattactaaatgtttccagataatccctgatcatggggcctgataaaattcattcttactgctaaaactatgttaagataaaagttgtttttattcatttgctatccattaaagccatcacagactaattatttttcaaaagaaagaaaactatgctacagctctgcaagtaacttatgaccagatgttgagatcttgggataccctgccctgcttaaaatatattataagagatctttagacagtaaaatctaaaaataaaacccaaaatataaaaaaagatgaataatagcaaagcatgatagttcaagagttttgttggctttttaattttttatttatttttaaaagaatcattagttataatttcataccagttgctgagacttagatataccaattttgtagtggggagggagggtaattatagaaagcaagagagaaaactttgaaaatcactgttagctcagccgggcgtggtggctcacgcctgtaatcccagcactttgggagaccgaggtgggtggatcacttgaggtcgggagttcgacaccagcctggttaacatggtgaaatcctgtccctactaaatatacaaaaaaaagaatagccaggtgtggtggtgcacactcgtaatcccagctacttggggaactgagacaggagaattgcctgaacctgggaggcagaggttgcagtgagccgagattgcactactgcattccagcctgggcaacagagtcagacttcgtcagaaagaaaagaataaaagagagagagaggaaagaaggaaggaaggaaggaaggagggaaggaaggaaggaaggaaggagggaaggaaggaaggaaggagggaaggaaggaaggaaggaaggaaggaaggaaggaaggaaatcaatcactggtagcttagctgaatagtccatgggtatctgcaagctagactttatcatgcacacaaatcctcgatctaaaaatgagtggcagtggaagtagtggtaggaggcaggagtgaagatcatgtcccattaatttagggtatctgaaaaagacgtggagccatgactgcttctgtatctaccagctttccacttagctgcctgaggtgagtagaaattatattaggcatttccataaccttatccttaactgtgttccctccttttcttagtgcctgaggtgagtctggcagtatctgtacttccctgctcccattcatacaaccatgttcttagatcctggcttgatgtgggttagtcagctgttctaggccagatttctcagatttctgttcttacctgttctgcccaactacaacagctggtgtcctgctggcctttgcctgagtcacaccctcaggtcatgcatccccaccttttacaggcagggttgttagcatgagagccctgctctgtgctctcagtgaaggatgaagggagaggagaagagcaccctaggatgctggtagaactttcagttctcttgccaacaaattgaatgaagttagangctctccgtaagttttattcagtacagacctggtgtctgatgctacagttaagagactagatttagaaggagggtggtgcacctgttttggtgggaggaatgaatgggatgtaaggagagatgatggtctgtgcatctcagacaaaggaacttaaaaagaggagtcttcaaaagaatgccccctgcaaaaaaaaaaaaaaaaaaaaaaggaggcttagaaatatctcaaatgaacagaaatttgaattacaatccagaagatgaaaatcaacaggaataataagaaaataaggaaacattctttacttaaaaattttaaaaagtcagctaaacgttgctaggatgtgaaggggtagatgacattttaagataaagactatgggaaaggagtttattttgccactatcttttctataggcttttgctaatagctgtgaagggtcttagatttcatatactttcaagttaaggagttaacctgccacagtttcatacctgctggcagaagatgagactcatggggtagagataagggactttatgattcacaacagtaacagtaatcagaacatcatcattttcctgtactggttctttgagctccaacccccacaggttgacaccaagagagccaggtgatacctgcacacacagtggagagaattcctgagcctagggaacttgagagctctgtaatgaacagtaagtgtgcctgcactttgctccatcctgagggaaactctctctttgaaggctgtttgctatgcaaatcttcttgaaaagatagtcgggaacaaaggcagtcagtgcctctgcttgcaagatgtgcaaaactgtgagagacatgaagaatggtctcccaactgttgcatcaataaaaaggaaaggaagctaatgtttatttcatccttgtcatgcaccaagcactgaccaggagacttctcatttcttgcctcatcaaagtttcaaagcagccttgcccagggtggtactgttgttgttttatcggtaaggaagctggtgagtcagggaactggaatatctaggtggaggacttgtgtatgtattatgtacttcttataatgtaagcattgtgctaagaagtagctaaaacttaattagatgcttatcaggtgccaagcacagttctaagagctctccatgaattgttgatttaattcaccacaactaagattatcaggtgctgctgaggaaactaaggcacagtgggtgacagaactgagattcaaatctgcacatttaaccactgtgtggttgcgagttgtgggtttttgtttttgtttttgagagagggtctggctctgtcgctcaggctggagtgcagaggtgccatctctgctcactacaacctctgccttctggactcaagcaatcctcctgcctcagccccttgagtggctgagaccacaggcatgcaccaccattcccagttaatttttgtgtttttttgtagagttgtggtttgccgtgttgtccaggcttgtctcgacctcctgggctcaagtggtcgacttgccttggcctcccaaagtgctgggattacaggttccctgtggttgtgttctttcttcattcctcagagtcatagcaagagggtcatagtcaaactaatgtgtgcccagaggaagtggatgtatttgaaaactgccaagtagaaatagttgaagtgggactgattgtgtttaatctgcagaatgataaaggataagtgatgcctgtcttcaaacatttgtaggcatgtcttatagaagaggagagttcactctgtgtgactgcaggaggcagaattgggtccatttacggggaggcatatcatggctcagcaaaaatcatttcttgaataatacagtgccccctgacatcataagggaatggactacctgtgagagtggtaactcagtggttacctttcaaagatgtgctgtctgggctctgtcaaggtccccacaataaacccctctgctataggagctgggcaatggaagaggatggccctaatgaggttctctagacctttcctaagagagctgaccctgctaacagtgacctgaactccttcccctgccatgccccctgtcccttcttggagcctcaggcctcaggtctgttggacatgcacagagatggtttctgcatgtgtgaggagggtgccttacctcttgagaatccaggaccaccctaaggatctggaggagttagttctgcagctcctcgcactctcaggcctgccctatttttggttccttacccgctatcagcctgtaatcaccagcctcatggctcagctataccctggcaaatctcgttgcacacatgaggcccactgttgcccagtttgggacagaataagattctgtggttctgtgattcactctttccttgtcaagtagcccaagctttaaaaagcaagtgggaacaggtggttgggccagtgctgctctgtgatgaccttgctacggccccctgacaactcccctggtgtagctgtaggcctgggctgagcagatctgatccagatgcaggcccagaggggaaccctgggcaggtagggaaaggaatttggggagatggtaagaaacaggagtggtggcaactggcttcacagtatatgttccactctgctagaaatggcctctgctaggggctaaagactccccagaagtagtcttgtcttaattactctgtggacatctttaaaagaatctcattttcatcaaagggttttaaagagtgatgcttagcccagtgtaaagggcatagtcaagatctgatcctgaaataatatctctgctatcctagatgtcaggagaaactaaaaatatcctcataaccctgaggaattcttggtttattgcacccatctcttttccctctgaacatccttccagaaagtgagagagtgaggaagtgagccaagaagctttaattacccaatctgctgacattattttatctgcgccactgatattaaatctgcacagcattccacttaaatctcagtgctaacagcagcctctacaaacttgggcctttgtccttctgctggctgtggcccatgctctgtttcccaccctactgcaccctccttcagacttcttaaattccgaagctttctgtggcaccggaaatgatctgtctgtggaatgtccatacttcaggaaagtccccgatctgtgtgtgtttattcccaaattctgctccccccaactcagcctggctgtttgtggttgagttctggcacgtgcccatcattacagaaacctggatttggcaggggcattgtgccatatttctattattggcatatttggagaaggaggagaaagtctgtctagttttttttccctctcttttatgtacaaatgaaaatttctgtcttatgttattaacttttctggccaaccagtgaaatacatcttcaatttcaggttggttccctggagtgtggaagttttctcttggtttaatgttgactctgtcgcctaatagctggttcatttagcacccrattggtgctatggttatagytgcaacaggccacatttaaggagggcttccagggaaccagcactgtgttgaggacttcagtcctcatgacctctgagacaagtgttgttaccatcttccccccattatagggaggacatgagctgaaagaggtccaagaactttgctgaaggtcttgcagcagagctggggctggaagccaggcagtgtggtgccagagctggctgacttcagcgcctacttcatgcttccatgcatgcatacatatgccatacatacatatgggagacccataggatgtatgccatcaatgcatactgatgtgcacaccagtgctcccaccatcctcccaggaagtgttgatatcattataaaactctgtcctcagcaagtgtgtattaagaacttactgtgtgcagatccaaagatgtacaaacccaggtcytgctcataggcattgcagctggggagacaaggccttgatctgcagaatctgagctgggctgagcaggggaagcttcatctgttttgttcactgctatgtctccagggactattatagcacctggcaggtagtaagctctcaaaaacgtgwtgaatgaacaaacttctaattaaacaaagccatttacatttttacaaataaatgaaagaacacatgaatttctaaaaagtttgaaggacataaactgagattagaggacagccttttaaattatttacgttaagcggtataaaaagctccccatgttgtcctcatttttcttacttttcataggttggtgggcacgatgtgatggatggggtgcttgtggacccatgtcatagatagggctttagaggctcttagatcctgctgggtggggagggcttagagaagagatggaccttgaggttggagtaggactcagctgggtggaaaagaccatgggaggcattccagagctgcccccactggcaggattatactggagagggcagaagcctcatgttttgcttgatagcaatcgttttgaacttcacgacttctcgaagcttggatccttttctgtcttactcaatrcttgcctcacttcccaaggcttgcctaacttggttgggtatctaagtgtacatcccttcaaaccatgtaggaatccctggacctgatacttgcctgaattctggcaccagatcaagaagaacaagcttaaacggaggctgaggcaggagagtaaaatactggggagccacaagtcagcaccaggcaagttgacaggaatcaagaggacctggatgcaagagccataaaatcccatgcactctgactcagtaattgaagttcttgaaatgtatcttggggaaataatctaaaggattattatggaaataaaggggccaggtgtggtggctcatgcctgtaatcccagtgctttgggaggccaaggtgggtgaatcacctgaggtcaggagttcaagaccagcctgaccaacaaggtgaaaccctgtctctactaaaaatacaaaaattagccaggcatggtgtcaggtgcctgtagtcctagctactcgggaggctgagacaggagacttgcttgaacctgggaggtggaggttgcagtgagccragatcrtgccgctgtactccagcctgggtaacagaatgagactccatctaaaraaagaaagaaagaaagaaagaaaggatcagtttatgtccatgaaactgtttgttttaatgaaattggaagcaacctaaatagtaaataacaggggcatcattaagttttggcttgtctacttgctagaatatgatacagtcactgaaaataagatttatgaagagtgttccatatctgaggaaaagcatgaaaaatgaaggcaatgataatttgtatatataattttatttttaaaagtacatacatagaaacagattggaaaaatattacagaaaattatagtatttatattgggggaaaagtcatttgtaatcgtactcacgaccaaacttttagccaatattgtttatttgtttatgaatgacaaaagatgatgagacaagggaactcgggtgagttcarcattcctgtaaagagtcagaaaccaagacactgtctgtctagsaaaggagtaaggacagctatgagaacatgtccaaaataacccggagtgtgaaataacaggttcctggacagaggggacatgaagcctgagcttggccggaatagggtgaatgtggccggggaagatacctttgtcttttgtttttctagaggcttggtatctgtaaccaaatttatccctgagcccgagacacaggaacagggcccatgagtcagtgtttctgtggcagccttctgggtcagtgcctacacaggcagggcaggcaccaaatttgacacagctgcatggggaagatatctttgaagtcatgtcttgtgtctagacttagggagacatgggagtgattagggtagaggtggccttatgtatagcccggctcccctgaatagtcccagcatgagtattcaaagagccctttccattctcaagagctctcatttggataatatgttatgtggtcaccctaattattgaaaaggaggttggaggacattctgggttgatgacagttgctctgctggttgcctctagtgcttaagaggccgtgaattgtccgggcatggtggctcatgcctgtaatcccagcactttgggaggctaaggcaggcagattgcttgaggttgggagttcgagcccagcctggccaacatggtgaaaccccgtctctactaaaaatacaaaaattagycaggcgtggtcgcacatgtctgtaatcccagcaactcgggaggctgaggcaggagaatcgcttgaacccgggaggcagaggttgcagtgagctgagatcacgtcactgcattccagcctgggcaacagagcgagactccatctcaaaaaaaaaaaagagagagagagrcagtgaattaagattccctgacgcagaggtgggcccagcctgatggagaagtggcccaggtgttgtagatgaatacagttctgctgtctatcctgattaagataaccaaggtaattattcccaagctgccccagcatgtggctagaattcatatttaactttgacccaagagctccttttccccttgcagtcttcctcccccatcccacaaacctggtacatgaccattaaaatctcaataagcagaagcttaagtaagggtaaataatttgccagctgaaccttcccctatttgcaaccttttagcattagcaagttcttgacttttcatgaaaaagccctggtatggctagtgcaaaaatcagttcaaatggtagaggatgataactttaagcagatagggacttggcctgagtgggctctgtttacttcctgctgtctgccctttcttctatcggctctgtcaaggcacgttttttgggaaccccattactgagcagactgccaagttgaccatcagtgatctagcctgggagccaagcctaggttcatcttgcaagaaaagtggggtgggattgtggagaaggcccccttccctgtgcccacaggagaattggtgtgaccctgagtgccccaatatgcctggctggacatcttgggagcactgcgaaacaggaggtaaagaccttcacaaagtatctcctcacagacagcctcagctcagtggggcccccagtcaacggagaagccgtgacaggcacagctgactggatgtgtgaacaaacagattaacagttggccctgcatcagggatttccaaagtaaagagacatctaggtctttcatagatgttttgttcagttggttggttgagggacacaggtgacaagtgttggggcaaactctggcttttcctggacttaagcaagaaattaccttttggcacctggacactgttttaagtctctagttaagagataaggggaaaccactgtctcactcaagagagaacgctctgctttagaggccaggctagatatggaattggccgggatctgtggagaggacacctgagcaagcatgggctaatgtcaaaccatagcttcctagagaggttgggtggggaaacctgactttcagtgggggagaaagtaccactgcaaagtcttaaactgaaacaggtgtaagcaagttggttctgaccgcccctcatttggtttaagcttacatcacaaggaacaggtgctgtcaataatgaattcagtttttctcttgagcccagaagcagagcgggatgaagccattaaggtgatagaacccagccctgactaataggtatgagggggaacagaactggggggcaagagttcttcagtgtaggcgtcctgaatctctatcgctgactctgagaagtcccaggggtctgctttctctaagaacagttccatattgggtaatgacaaaaaaccagagtgagattaaaaatggattctttatattgagcgttaatgataaaagctccaggtgatagcattctgttcaatgttatataactgttagaaatgggggttagtagttagaagtgaattgttaatttaatagatatgtttttatagaaaaatgatacaaataagtatgtgaagtactgctttctggcctaatcaatcacacctggaggggcctagctggctggctgctgtgtccaccaggtagaagcttacctaaattgcttgaaagaaaatgttctggcactagaattgccgtttcaaagctttacagggatgataaacaacatactgctcttcagagcactataccaatcttgttactgttggcgagagagagcatctaacactcaataaatgctaggcactccaggctgaatgctaaaaaaaatgaactgctgcctttgtttagcacagtgtccccggtagggtgtggaatttcaagttcaggwgtagacaagcatgaagggttttagggcctttgaacaggtcaatgccccattagctttttarttttccatcccactttcctggctcctggggctctatttttctctttgataatctgttttctccaataggattccaaattccctattggaagttgagcctcatatcctcaaggcccatgatccctgagccaggtatgagtgcagctaatagctgatggtggtccattgatctccctgttggccctgcatytgcctgtacttcccccttgcagctgatggaggatcctgtgtggaagrgctccctcaccccgagtgcaaatggctccctgtttcagaaagggttgagaggggacacgcactttctcctctccactggaaaccagctgagctgacacctccgagcagaagttcctctttgtgttcctgctgatgggctgtgctctcagttgatcattggttttttccataccttctccaggttctcagaggtcaccatttctttccagttagccccattctagaagagatttagggctgggagaaaaggagaaacatgtgttagcctcattagtatctttggtgaagtgtgaggagaaaaaggtagccatgattgctagaaaaatgagactgttaagggagaaaagtgtgtcgatctctgttatcacccatcattgcagatggcaaaaatcagttgttctcagcaacatcactgactgccctgcagacaacctggaactggagggtgtcctttgggagacaggcagggcatggtgtggaagggcctgtgtgagtcacatgaggacagccaagggtctgactggactcccggccagtcctgccacaggcattgcatgcagctggtgcttgagtgggttcacctgcctacctgaggagcacgacagggaaggtgagaactgtcctgagcctgttggggggattgttcatctagaagagacatgactggcatccccattggcagagccagggccaggcttagagctggcttacatttcctcattttgtattctattgagcgccagaaatgaagcagagagggctgaaccctgacacagtgggccggcccaagcctgagattgaggcccagaaaggcctaggctcaacagacgccagctccagacccagggccaccctgctcacccatggctcacagggagatgcagattgaactcttcgttccagagagtggccaccttgattgggaagggaagcaggggcaggggaggagagggaagtcacagggagactatgggaaccacgggaaacacrgccattctgtcctgaggtctgggggaggggcctatgtccgcgtttcacctacagcacttatgtcattgtattgggaggaggtagttgaacctctcaccttatttatagtcctagcgggtattgtgggcactcagtaaatacacagtgatgggtgtgcggacaggtaatgagttctgagccttaggccctagttcttcctgctctgctgagagcacaaacctgataaagcttgagaaccatgatcaggtaaactgttcgaaatagtcaggagagtcccatcttctcaatccttttgtccagctgtggagtaggccttttagacaaacaacagtggcctaagaagttggaatatagaagaggattcctatgtataagaaccgcaggaaattatgaacttctggaatttccttgctgagagggctgtgtgttgtggctgtggcatttggctactgcgtgtacgtcctatttcctgtaatacaaggcttagctcatcactagcagactgacaagctagtctcagaagcagggcaactgggattgtcaaataggtttccttagtatgctccatcctgcttactggtgagaggtttaggatagtgtgtctgagctgctgtctgcagagcagagtgtgcgagtggctctgcaggtgctggagctcacagagagactgccaggatgtgcacctaagattatatgtttagaggtcttctttttgtttgtttgtttttgttttttagacgaagtttcactcttgttgcccaggctggagtgcagtggtgcaatcttggctcaccacaacttccgcctcctgggttcaagcgattctcctgcctcagcctcccaagtagctgggattacaggtgcctgccaccacacctggctacctttttgtatttttagtagagatgctgtttcaccatgttggccaggcttgtctcgaactcctgacctcaagtgatctgcccaccttggcctcccaaagtgctgggattacaggcgtgagccaccacgcctggcctgcttagaggtcttctaaccccagagaggtcaggacactccctcagggcctcactgttagcagaccctgtccctgaaatgttgtggccttaagtcagtttcttctctgtaggccttggttttcttatctatagactgagaaggtgagccaggggctctctgagttctgtgattatgtgcaatctagcagcagagccaggacaggacaccaggacctttgaactccagtccactcccagctcttccgtgtggcatctctaacaatgtgaccttgtcaccaagggtctgaagcctggaatcagagacctcagttcaaatccagttgataataagtagccgttacttattagctttgagaackttggctactattactcaacttctgagtgcttcctttatctttaaaatgaaagtaatacagtatgtatcttatagaattactttgaaaattacagtaaacttatataaagccctcagtacagtacctagtcctcaataagcattcaataaatgggttgtttgtattagtgacaatcgatatgtggttcagtcactgcacttgtctggaccttaggtttcctttctgtaattggaccagtgcttctctgacttagccatccctgaggacagtagagaaagagcatgtattctagggttaggggcttggggtgtagcctgtagcagcttgcagaaagcctggcatttctttgaactcctatttatttgtaaaatctacttacagttggtatcctatacaatgatctgaattttttggttgtaatataaaaatgcttcacccaaatctttgagtaaagttgatgttctagggtgaggtagcctcaaatatcccaaagggcatacagccacacccctctgggctggaggtgggattgaaagtagtttcaaaggtcccttccagctgtgaaattccaggcacctagagtaagtgagtctcatcctcaaaggacctaaggttggtaccaaagaattctaaaggaacctgagaagcgggatccctgtgccctgcccctggtgagaatggacagggctgtgtggaagtggaactagcagaaacagggagagagacagccctctgcagtgaagggtgaaggaggctggaggaagagccgggctgtgtctgggcctgactgtcggccttgagctgatgaccctggcaggkttggcttggcagctctccatctccccaggtaatttccaggaagcactaagccattgtttctcatccacagctggaggctgtctggggaggagccctcatatctcaggagggcagtgagggcagggggtgaactgcatgtggaaacatagagcttgtcacactgccaaggcctcctggccattctgatgcagcacctaaggctggggtctgggcttgtgcccagccagtgggaggagagttgagggagtctggagaagggcagcaaggttttggagagaacacagagatttctggcctttgaatgggaacaatctctaactacattctgggaacctctctgtgcatggggaaagactatctgctgatggtggtgtcagccttgcacaaatttgccagtatgcatggtctcttcctcaggcatgagggattcaaatgaagtcaccccgtttgtttagggcaaatgtaagggttttccctgggcaagggattgatgacttagtcaaattcatactcagcagatgtcatgacaataaaaatctaaggggatatcaatacattcgttacactggaaatttcctgttgtgtaaggtatttgttataataagatttaacatagcttttttttttttggtggggggatggagtttcactccattgcccaggctggagtgcagtggcactgtctcagcccactgcaacctctgcctcccgggttcaagagattctcctgcctcagcctccagagtagctgggattacaggcgcctgccaccacacccagctgacttttgtatttttgatagagaggaggtttcaccatgttggccagggtggtcttgaactcctgacctcaggtcatgcccccgccttggcttctcaaagtgctgggattacaggtgtgagccaccatgcccagccataagatttaacatatcttgataaaccctttctaagcatgttgccaagttggatttgaagttcagaaggactggattccagtactgctttatgaactatatgaccttaggcaagactcacctggtctttgagcttcgggtgttccatccataaagtggtgctataaaatatctcagtatgttggccaggcacggtggttcacgcctgtaatcccagcactttgggaggccgaggtgggtggatcacctgaggtcaggagttcgagaccagcctggccaacatgctgaaaccccatctctactaaaaatacaaaaaaattagccaggtgtagtgatgcgcacctgtatcccagctactcaggaggctaaagcaggagaatcacttgaacccaggatgcggaggttgcattgagccgagatcacgccattgtacttcagcctgggtgacaagagcaagactccatctcaaaaaataaataaataaataaataatatcttagtatgttgtgaagttgaaatgggatattgattaggaaagtatttcatcagttgttaaataagtagctaaatgttcattttaagtaaaaacccttttggtaacattagctaagtatcaccatcctctaggccctccacaagctagtctcaatcaatgtaatgactatttttcaacatttctcttgacccatctctttaccagatgagtttccttgctcttatatacaggcaccaccatctccctagatcagctctatacagacggctcacctgcttagattaccatggcctgttctctgtgctttgccagcttcagagatctcaactcagtctttgaagatacagtggtccactctggaccctagtttcctcatccataaaataagggagcggactacatgatttaggttctctttcatcgctgacattctgcaatccagccatttttcagtgtgcaaacagtaacctagaatctgagaagatgagagcaatgcatattgtccaacaattataagtaattgatttaaaaaagcactttaaaagcatgaattaaaaaataaaaataaaagcatgaattaataatctattccttgtgatatatagggcaatgtttgtagcaatatttaaatgaactaaaacatttaagtgaaatgtgaaacctgagtcttcatcataactgactattatcaaattgttaccattttttgagtgcttgctacatgccagacatggttagaaattacttattacagttacaatgtattgagtattttgagtatctactttctgatagctgcttaaagctgctgctaatcatactaccctgcagatgtacagatggggaaattgaggtttagagaagttaagtaaatcacccacggtcatccagccactgtgtggcagtagcagggttcaagtctaggtgtgtgtaacaacaaagcctgtgacgtgatggctccacccaagtcctctgtcttgcagtcaccactgtgcttcctcttaggttgtaaatctgttgttactactctcctaggactggtggttaccccagctgtgtttatgatacagctctggacttgaccctgaattaggaattggccctctctctctttagttgaggcagccagcctgagaattgtatgggaaaaaaaccctagatttttatgggaaaaacctccacctagatttagcaccttccctcctctggcgtgttggagaaacccagtctcggctccctcctcacttccctccgtgtgcacctgccttctcctgtcagtgctaaccaaggatggaagtaaaactagaaatccttaataccgtttgccaggctttgggcttcagccacgggaggcagattgtgttgatggatgtaattagaaaactgcaaacctgcttctcamatcccaggtcctaaaggagttgataaaccaggttggctcatgtctcattctcctctgctgtgtcacacggggaaggatttggaatagaagtatccccaggcctttcagtaatggaagctcgagtcaaccatggatgcaccagagccaaacgagtgatggcaactgcctttggccccaggggtccagcaggagctgtggacagctggggctggtgacagtcttcacttgataagagtctgggatcctactggcaaccatgtcaccgcagcccctcctgtcagcagtgcttcctgctccctcttccaagcggaagacctgttccagctgaatggcttaggctcacatggaaaggaggacacacacagaagcgccttccttcttccctctcctccaatcagtcaggtgttagttgagtcacagagctaatgttttctcaggggaaacaggccatgggacctggtgcctcccctaaactgcatagagaggaccaggggccacatttagaagccaggcctgggcagcttctctcacagttcacttgtgcccatgccctcagaattgaggggtcttcctagcaaagtatcctctgggcttgtcccttaagatcatccccacagaaccagctccctgcagaaagcagagaggcagtgtgtatttcaggccattttagacagaaggcatgggatctacagtctgcaggtagagaacctgctcacagcctgctccaggggagtgtgtgatctgcagaatcatgaggtgcatttccttcctgcaccttcttttctcaagtgggctttcctaggcttctcacagaccactgttggagaggaggggagggcaggacagactcctgccacagagaggtgaccctttttactccctctcctttctgggtctcctctcagtcctgtgaccctacagcaccaatagcacaccctactgccatgggctgcccaaacccacttgctagccctctccctggcttccctccctgccccctgcaagatttctgtttcaaaataactcaaattaccaaatgctggcagaattgagggagtgggagggagaggaagaatgaagtgattgaaagacagggagtatattccatttaccttatgagcaaatgatactccccaacatcctgccccattaattttgctgttaatatctgccattctgctaagggattaaatgagttctaagtcaccttaagtacttagtctaatgcctgacagtaagtgctaaatacatggcaactattattagttctctctttttctcctttttcccctgggattttcccttagctcttccagccccagctcttctctggacagacctcatccaatcagagggctccacctgggagctggccagaagcagaggagctagaatcactgcacaggtgtgggtcgggactgacccagccctcagagtcttcctagcctgtgccgctgtctcacaggtgtgtctcgaggaccaggtgtgcctgcctgatttgcctgcttggcgggcagccctgggcagggagccccaacagaagtctttttggttggatataagctttgcctcctctcctggggtcctgcagcagctcatccctgcctgggctyggatccccctgctggaacctttcctacttgcscacatgtcttgtggagagctggtggcagtcttagagaaaggtgcactaggacaggaaatgcccagagagacccttcaggccgtgtagagaggaccagagaaggaaggtggctttcctgagatcacacagctggtttgggtggcagcaccacaataagcatgagagtcactgactcttctgtgctatctcaccctccagtgccatccggatttctcctgtgcacctactttgagcaaggttgcttttattctctgagcctctgacagaaactttaaaatcataaaagcagtaacaccattaacgatagcagtcatcatagattcagctcctattctgtgtgagagactaggctgaggtcgctttttatgcacgttgctgaccctcgtaacaatcttgcagctacgaggctattagcagtagccgcattgtacagctgaatcaactaagattttgagagattgtcaattgcctcaagccaccctcctagggattggaagccatgagctcggttcttgttccctgagtcgatttcctgggcttcagtgggctaagggttgtgaggctgcccctacctgagtactcacacctcatctcatagggtttaaaacacaaggcacagttctgcttggcagaatggagtggggggcatggtatttgagaaggagacagtggtggtaggagttcaataagtatacttgataccccaaacttaatcctgagggggtgaaacctaagaatgaagtgagtgaactttaggattatagctggagtgtgcattccgctaatttagttataagcagggctctggttctggctttaattacttttgcatatgacttgtatcgcagaaaacttctctcagcctgttcccatcaaatcccaaataaagcaagaattccagcaggaagaaaacaactccaggagaccaggccttgctccttcacactgtgcgtgaggttaggtgtgtggatttgattagatctgtgtgcctgtgtctgtgtgtgtgttgttgttgtcgttgtccccttttaagaaaatttaaaaataactttctgccaaagatgtgggcaccagggttgtgttgctgagcagaaatgctcctcccacccgtggtctgctgctctgctgatgtggcccagctgatgtgggcagcttgtctgcctgcagaagctcagcccctcctttaatgtgtcttccaagaggaaaggcccaggaagccatggggagggagaggctgcctggtggctcagggaagaactcagctgttgggacaagagtgggctggctttgcctgctttcatgtgggaacccagggacctggatccaagtcactcaaggatgccagcaggaaaccctgagattgtaccccgggcaggctgtgattgtgcccatttcacagctgggaagactgagaaacaaagagtagaaaggatgcaaatcagaactatcatgaggtaccatctgacatcagtcagaatggcttttgtttaaaagtccaaaataacaaatgttggcaaggctgtggagaaaaaaagaaagacacttatacattattacatggtgagagtgtaaattagtccagccactggggcagtttggagattcctcaaagaactaggagttgaactaccgttagacccagcaatctcattactgggtatatagtcaaagaaagataaatcattctatcataaggacacatacatctgtatgttcttcacagtgctattcccaatagcaaagacatggaatcaaactaggtgcctatcaatggtggagcagataaagaaaatgtggcacatatacaccatagactattatgcagccataaaaaagaatgaaatcatgtcctttgcagcaacatgggtatagctggaggccattatcctaagcaaactaacacagaaacagaaaaacaaataccacatgttctcacttgtaagtggaagctaaacatgaggtatacatgaacataaaaacagaacaatagacactctagggattgctagaggagggaaaagggaggggagcaagggctgaaaaactatctgttgggtactatgctccctacctgggtgatgggtttaatcataccccaagcctcagtatcatgtaatctacctttgtaataaacctgcacatgtactcccttactctagaataaaagttttttttaaagggaaaataaagtaaaagttaaaaaataaagaagaccacttttccctttctccttgtgtattttaagaaggacagaaatgagagtagatggtaacagagagagtagggagataggctaatgtggtggttctcaaaatgtgccctggatgtccctgagactcttccagggtcccttgaggtccaagttatttttgtaagaaaacatcatttactttatttcactctcattctctttcaagcgtacagtggagttttctagtagctgtgatgtcacaatagattggatgcaaaagcagatatgaaaatttagctgttttctactagccagacattaatttgcaaaaaggagcaactcttctcattaaattcttttttgtcttagaaaatatatttttctcttaaaatgttatttatgttagcctataatgggcttattgatgttttaaaatgaattaatatttcccagttttaatttccaatactgtaaatattgacagcagtaactcacaaacaaaagctctctgggggccctcaataatttttagaagcataatggggcccaccctgagacaaaaatgtttgagaactactgggaaagcaggtagggggtctcctaggtgttaaaagaataccagctcttcaagaatcagatatgaatcaagggaaaacttaaattcatgtcattgccrattcggatgtccacagtctgccccaaggtgtgagttgcataggatgttcctttggaactatgaaaataccttctcttgctggaggaaaaggtctggacagggcatcaccttgctgcctcattttagaggagtgctccaaggatcattcctgaagctctccagggctctggaccaacgaggcaaagtcgtgctcaacatgaacacagtctgtggagtctgggcctcatcagtgcagttccttatgagaaacacagcacaggagttctccatccatctgcttgctgggcttgcatcctgctctagggatcataaacagggcttcttcagcttagggaagaaagagctgggtctcaggaggaaatatcttatgatccctgggtggtaatcccaggccagatgtgccaaggggttggagtggtgttccaggccagatgtggaattgggagagtgcccagcccctccgaggactcagctctctgcttgacagggtcctccctttgctccacactcagattagaatctgcagctctgaacaagtaaaaataaaaacctgtgagcttccacccctggctcccccaggactccattgagagcctctgcagtggcagccagaggtttcaaaggtcaccccagctgggcggattagaacaacagatctcccggaccgggtgaagttggctgctcagcggaaggcaaattgcaccatctgcgagcagagtcagaacaaaagccccttaactttttcggtctggccctgggctctgtggcgcccggcactccttcggtctccattcttggctggaccttggacaggaacctctgcagtacggtggtggtgaagtgtggctgcctcgcatcctgactcatgtgagagctgccgaggaagaagctgcggtaaggtgtgtcccgttcactggtgtgtggtcctgcccagctttgctccggtaggtcatagcaagtcagcctggcacagccgaggagcagcgcactccggaattaggagtgattagagaacttgtcaggatttgagtgcattgcagagaggattaaggtgggagagggagctgtcagtgcctggggcatttgcacgtgggtggttttgctgcctctgatgtgtgctgttgttggaggtagggttcacggtagactgcggagcctgcttgggagcccctccctctagggaaggtatgatatttccaagatgcccggcaaactgaccaggtgcttcaagacaatgatcatttaaaatgtatacactttgggtagggaaggggataactggtttctctaaacttgttctgtggtattacttgagccctgattttttaaactttttttctgagtcatttgccttatagttacaatctcttttcgctgtagttgaaagtgttcctttctgggttcaagagacaatttaaagtgcttttgatcaaattaaagtccagttaactcaatgctgcttcaaatagttaataaattatgttacttgtgaaagcctcatttagaggtgggcgttggcccaagcatcagggggtgaggggtgaggggtaaggggggtaagggggagtttccagctcttgaaccactgctctttttgaccctctcccctgttttttcttcttacttctctgtgtttcccctttgatctgtgtttagcttgtattgaataagaccccctagctgggtgtgtttgattctagccactgagcattgctctgcattagagaaattattgtagaaatcacccaacctctctggttttcttgattggaatatagtccacaggcttgacaagggattagagaggaacgaggtttggtctaatttactttattattaattttttttctgatagagcattccacatatgtcagtaaccattaattgtgtggcagagatctgtttatgctgatgatggcagtgggtggggcgatgggctgagggtgagcagagctgtttggtgtggctgggctctggtcctgtccgcatggtagttgagtaactctcccccacaaaagcactttgcaagggactagatgttcccttgctgtattgatttgcgtgttccttttctaacctgaagccagacctctcctagggatggatgactcctgtctaatgtgctgttgagatcaagcaggtgccttttgatgagaacatctggggccttcaggagatttccatgggcctctgattttagatcaagaggacttgcacagagggtcctgagccactcctaccttccaggaggatctcaccactcctagcttccagctcccctgaaagcaaaggtagagaagagtcttgtgtcttcaaagccaggcctgacagcagaagggggaggcacatgctctgcccctcttcctctgtacaactcccaaccctctgcctattgcatctctcattactggggatggcaagaaatacctcatttgagatgtgggggcctccgagaagccagcagattttgactttgtaatcagaccttgatttggttttcactttttagctgtgtgaccttagacaagagtagttggctttctaagcctctatgtcttcatttgtgaaggggtgatcattagaactgctctttctgattgagatgggtgcccagcatgatgtcagcacgtacaccttgcttattaaatggtgctgctagtacagacacaaaggtgctgcgggaagctgcccatgggcctcaggccctcctccccaccttcccagggaattctgccatctgcttcctgctactgttttccagtcatctcactcatagacccttgcctgaagatatctggggcttcttgctgtctttggtgaaagggtctatatctatattcagggtggagagacgggcatccctttgggaactggatgataatgatgttgacagccactgctattgaatgccttttatgctatattatgggtgttacatacactctcgttcaaaccttcccttcaactttatgaggctgatatgatcattccatttgacagagaaagagactgaagccaagagggttggagcaccttgcccagctcacagctggaaagtggccgtgtccccgggtttgtggcagggtcacaaaagtctgatcctcatgatacctgtccccaccttcatcccaagtctctacccggtcctggctgcacagtgtatcatcacttcacctctgtggcagaggaggagggcacagggagcagtgttcttactggggtgtggtcctgggtagctatgtgggatatcagatgatgcccattccttccgcagccctgtgtttctacggtcgccacacaaacaacaacacacatgccccactcatgtaactgctgctrtataccaagtctctagcttggcccatggtagatatttagtaaatatattttaattgagtgaatgaatatatcttgatgctcgccattaaaattgtagtatgactgcttttaaatggttctacaaacatatactatatgctataaatgctatagatgctataaatatggcaaaatgttaattgttaaatctaggtgataggtatttggggtgctcattttatcattcaattctactgttctgtatgtttgaaatttcccataataattttttaaatttaaaatttctatatcatcaaattcttatcattattttccctgtaaatatgtacccataaaaccacctggtattccactgtatttgaccagttctcactgttggattttttaaaatatagtctatcttctgtcctaaataatgcaaatagtgttcttataaataaattttgggctgtatctctgattctttcccaataatatatttctaaatgtaggattattgggaaaagacatggaagtattttttagaatctttttaccaaattgctttccagaaagactacaccagtttttattccccacagagggtatgagcatgcccatctcatcatggtctcaccagcagtatatgttatgtttctttttaaatgtcatttaaatgaaatgttttggttcatttttaaaaagtaacagcttattcttaatttgcactcttggattattgtcggagccaagagtgttcagtggtacatcctctgtgcattgttcaggtcatatcatccgtccattgatctgttgggctgctttcttctgatatgtaaagacctttgtttggtgcaaacattttattccaggttatcacccatcttctaatgttgttgatagtattacagaatattttaattttatacatatgtggtagcggctctcaacttttccccttgttatcccaacttttacttttcctttcccatcagccaatttgactgcttacaggaggcaagagggcctagtggttaagaatagcagctctggcgccaggtgcttgggttcaaatgcctgttctgccccctactaaatgcatgaacttggacaaatttctcaatctcactgtgcctcaggtgtctaatccacaaaatggggataccaagattatctgtctcatagtgttgttgtaaggagcaaatgagctatttattatttatatttattatttataaagggcttggaagagttccccacatctagtaagtgctacasaagtgtttgcttttattgctacctactgcagggaacctgtgagtcttaccattcarcaaggaattttgtttgcaaagctaatatcttatcagtgaaagagaaagctgggtttatcaagcaggggatgtgccctattacaaatgagcctagtccctttgctgctttcacttgaacttcaaaagagatatccccattttatttttgttagagattattaaatttaaacaaactaattacatgtcccagagagcattgttcatttgtgtcagtttacctgactcacagcataggacttaagtatgtgaccagacagccaaagaaaatgaacagaaaagcaaatctaggaatatggcttctcttcagttcagcagatgtgtgccccacgtctgggccagtcatcagggattttgtggtaagaamtgatcgtcagcctggatctgtccccacctgcacttggaacctgggacagggacactttgggtgtattccaggtggtggcagttgttgtccaatggycttgactggagtccgaccacctagctcttctcaactgcaacgttttcccagcctggttcttcagatttttctatggattttggaaactccccctgaaactccaccatctttccaacaaatcctttctctgtttacaagagccagatttagcttctcttgctttcaatcaagaactcagatatgtacttataataattccacttttggagtcatttgtaaggaaatctttaggaattcrggcatagatttcagtacacatagactcatcaccgggcatcataaaagatttagaaactatccaaatggccagcagtagggagatagttatgtaagtcatacatcaatatgatggatatttgaaaatcaaatttcttaaaagcaacttttcccccttattttaagaaaagttgtagggaaaaaatagaaaacattgtttacatagtatgctttcaaccatgtaagatatgtgtttttctatattgataaaaacaaaattggagggaaatgtaccaccattctgtataatagaattatggatattttcacttaaaaaacttttatttcaggttcacattttcacattttaaaagagctctggagcctgcctgggtttaacttccacttctgccactcaatagctgtgtaatgggcaagttattccacctgtctgacctcagcttctttatttgcgaaatgatgactatacatacttcatggggttgttctgaggattaaaacaaatgagataatataaaaagtgcttgatacagtgcctggaacagaatgtattctcaataaatgataacttattatttttacatattggtaattttcaagttttatgatgaaatgtatttaaaattaagaataataaaatatcacaaaagagttgacgatcgctctaatgagtagtcgtctgttacttctcatgtcagccccttgttctgctacccttgccagccccagtcacatcttatctagtccccagcaggccctggaccaggagtcagggcttaaggtgttcttgtcagtgataccatcattttgctctgtctcctggggcaagtgacttaccctctctgggcttcagttataagcagaggcattagcctgggtaatctgaaaacaccccccttctctgatgatctgtgatcttggagccttgttcacaatctggtcctcagaggtgggatgtccccccatgcctacctccttcccttcattcagccaagactctccctttacctcacccagggtccttgccatattaaccccaaactaccttcctctcttggagtatggatcccatttttctatagcctgtgagctcttgcagttcaggctaaagcagtttctactttctgccagaagtgcttaatgtagatgttggtcctgaagagttagtgactattaaatacagattatagatatctattataagaactatttctccattcttgtccccagcttcccctttcctagaagaaggggtcagtgaaaagatggaaagttccccacagggttttgaggaggcagggcatcgccctgggaaccggagtgtttgtctgggatgggctctgccttgtcctggcactttgtgtataaaagacagagcctctcatcttcacagaggagctgtgggtggacactgacctaactggggatctgctccacgtaaaagccacacctccagactggacacacctgatgcctgaagggaagacagggctgtgctttgtctgatctgaccttgtcctcttccttcctttttgcagaccatgggggatgtgaagctggttgcctcgtcacacatttccaaaacctccctcagtgtggatcmctcaagagttgactccatgcccctgacagaggcccctgctttcattttgccccctcggaacctctgcatcaaagaaggagccaccgccaagttcgaagggcgggtaagaagtgtggctggatggggaggctgtggggaaggatgggcaggggccgctgctccttgtcaagccttttcctgggccggctggatctaatagaaggctcaattttcttttggaccttcatgtaaaacgaacctgtgccacttttctctttcttttgtttgtgatgggctttggtctgtgctggagaacttgggggtggggaggacgctgcaagttgaccatcctgtgatgttttgctgttaatgtaggttgtgttctgggtacatgctatataattacagaaaaagaagacgcggtccggtggcaggaagaatacagcttgggtttatatatgtcctcaaatctggacagttgagaattgactgtaatttttctcttgctttttccgtggaaggagagtttagttagccgaccttcttgtacatccatttggtatacccggagcagtgataggacctctcatttcacttctgtcacctgtcataaatgaatactggtcacttgccgttactgggactccacttcttcttctacaaayaggcatgatcattccttgtctaccttgtactcaaaggagaagagaacactgaagaatagttgtactatgactcagcagtctaagagggagctcctgaaagcttgtaggagggggtcaggtggatgattctttttgcatgatgccggaccttacctttgtgtaagtggcaggtctggctacgtggttgtctggagagtttgcaggggttgctgccttgaaaatggcctggggctgtactgaattgcatgctgtgcatggacctgtgtagtcaagactgtttgctaatgattctgacctactagtcctttcatatctcttaccagaagattgttggggatgttagtgatgttcctgaggagtctgtttctctctgggcactaccaggatgagggctgtcttctgttgccctgactctggttccctctgtcctcttatcctcatagctaacaggagagaagcaacaggaagaatcgctgggggctcataaatgacttagatgactataaaaaggaatgaagtactgactcatgctataacacggatgaaccttgacacattatgctaagcgaaagaagccagacacaaaaagccactgattataggattctatttatatgaaatgtccagaataggaatatctatagagacagaaagtagaaaggtggtcaccaggggctggggggaagagagatggggagtggctgctgataggcacaggatttatttggggctgatgaaaatgttctgaaattagtactggtggttgtacaacttttcaatatacagtaattataaaatactgaattatacacttagaaaactaaaaagtaaaaacatttgagaaacggatcagacagcaaaatggatcttaactgcacacacagtctcctaccatactgcttctgagacataaactccttcctcaagtcaaacaaatatggagaggaagagatggcggcctctatgtcatgtgatgatgcttttgcttcctttgctgaccttggtgtcatgaaagaaccatgccttgagtgactcgatttggaacttgcatctgctgagcactggccaggagccaacacactggagttctttgttgctcagtgtcctctggttggcaagccatgccttctatgtggctaaggtttccttctctgagaaaagacaactggctgtttctgtatttctggcccacaggggtggaagaagaaaagttgatagatagtaaaagtacttcatgaagttagaaagtatactttggtaagacagtatttttcttaaggagttgaaatttacataacataaatttaaccattttaatgtgaacaatttagtcatttaattcagtgttgactgcagtattcttaaaatgtagctttttctatgtgaaaattttatttttcttatatggatgaaatagttgaccttgtatattacatgtggactatatgtcaaaatgcatgtgttccttatgagtcagactgcagcgctacttgaccacttaccacctgacttgaattaacccagaacaatgccttggcagcacactggtgtatacagaagaaagactattccagagagacgtcgaaagcatccagctgtcttgcagagacaaatgcagagggagagactgtagaagaaaatgccctggaagctagcatgctgcaagtgtgtattgttagtgtaggaaacaacacagagacttttgcatcagggaagggccacatcacatgatcccagaagaagagagctggttgttctgataccaaagacgaagttaaacagggggtgtttctgacctggtgacctcaaagaagtgaaaagttaggtggtgttagcctgaggtggcatgggttttgagcaggagttgctggttataataagctccaaacactcaaaacttgcagttccctattgggcatagtcagtggtgatctgccttccaatgcatgtcagccttcactgttggggccacttgaccttgcctgcagctgacccctccctccaggtcctgggacacacccctccctccaggtcctgttctaggtgctcaatcrtcacggaaccagtcctggtatcactctcaggatggcctcaggagcacatttctctggtaactgagctcttgcagaacctcttatgagtgactaacttaaaaagtatgccttcaagcaacttcttggacccaggctggtccctgtcacagctgacaggaatcttcttcctggcctctgcccacagcacctctgcctgctttcctccgtgaagttgcgcccacggtggaggcagtggagggacctaggacttcccagcttcttctgaaagaggttcagggaccgtcccatcactgagaagcaaagtggacaccacagatgtgagaaagttctaaagatttatttcctactgcctttggagctgccaatcagaagttcttcaaatgtgtgcttttggtttttattctcgtaagacgttaagaactgttgcctactctgccccatttcctttttatgcctgtttttagacaaaggacttaatgaaccacttccttcaataaagctcctctttctatctagtgacttgggtgacattaagatgggataacaggcaccccctgggggttcaagcctctttccaaggagctccaaacracgagatgctcatctctgtgggctcagtccctcacagcctttagggcttttccaccttgtgggagatacattgggtagccaacacataacccatgaccaggcccctttgcctttgccctgttccatgatggggtccactgtagaggcttccgtygcagctaagggtagcccagtgacacatttgggctgaagtcagatagggagcttctggaaaagcccttgcttttctgattaaaggaagataaaaagacatcactggtgctctcatatttcacccttccgttgcttcctgccttgaatacaggtgtaatgcctggtgcttgggcagccagattaaaaccatgaggcaacaagcctgcacgctaaggattgtttgggggcagggggacagcagtggagagagtgaaaagaaccagcagctaagagacacaaatcctaaagctcaaagcctgtcccagatacaatctttgcagtgattcacmcaggaaatgttaccgaaagtattcctaactgataaatagctcgcgagatgcatgtggagatagtgtctccttaaatgaagggaatgaataggagagaagacattgcacagggatgggggttccttattctgagttgattgtggtcctgcagtgaaatcattctcgaagaattcattcactccctggctgtggccattaggcttgaaccagcagggcctagggtttatgagaggaagtcaacaactactatttgattagcatctactgatttgacctaagccccttccctcctctcccctctccttcccatctcttcccttccgttccttcttyttttttttttttttttgctttgccagcccaaagcttgaggagactatattttcaggaattaatacaactttatctcatttccacctttagacccaggcaaccagatccctcttcccgtgcccacaacctagaagcccctgttcctttatccagctgttctctctccatagagcagcagagcaggagacctgtctgcccaagggatacgcccaccggagccaaacctcccccatgtgctgggcacccaggacccaggaattttttaccaaatggccctgagcacacttctaacacctgtgtaggcctcctcccatgaaaagatgttgctaggcctgggggggcggggtcaaagggcagctgtttgcttgggaggacagtgaggtagatgaaaattcagacgcgcgctctgtgttctgctcacgtgcctagtagaacaggatgtaagtagggtggggcgagaagtgcacaggactgcgccactgtctggtgttcactgctgggcctcaggggtggctgggggcttccatgtacagacagccagggctccacgaatgccaggggctggtggaaacacccctagctgctctgttgcccatgctggtagctgaagtgttgatgggctgttttccccagcagagtcaagtatgaaaagagcaatggtgggaaaaatgctgaaattactggagatttcttcccttctaccctggaatttattcttatcagaaaaaaaaagcaaacatggtgacaagccctggctgtgctgtgactcagatgagctaatactttagtgtctcttgagaagtacagcccaaatgaggtttcggctcacactgctggccttagcgtttgctgaggtgggctttgtgataaagagccagccctggccctgtcaaggcatgtttctgtctaagctgtggaaggtggaggaagggaacatgagaatactgaaccatggaagcatgaataattcctcagtttccactttatacaatagtgtatctgtctcccaataactttcaactcagttcacttccagctcagaagcagtcagccaccatgtttagcactttaacaatgagaacacatggacacaggaaggggaacatcacactctggggactgttgtggggtggggggaggggagagggatagcattaggagatatacctaatgctaaatgaattaaatgggtgcagcacaccagcatggcacatgtatacatatgtaactaacctgcacattgtgcacatgtaccctagaacttaaagtataattaaaaaaaaaaagaaataacaaatcaaaaaaaaaaagagaaatttgaaagaaatgtctggtttgctttctgtcctcaggagtcttaatgatgtggttctggagaagaatgtgcatatagaagagcaagatatgacagtgtataattaggtgcttgaatttcttcaagaaatagtttctactataggaattgagagattaagatgaggctgggagtggcttgaagactggtttcctgctctgatttctgcccttccagttcatccttccttctgctacttaagtgatcttcctaccacgtggatctgacggtgccacctcctgctttatacgctggaaccttggatggttccccttgcatgaaattctgcagcactgcttaaaaggccgttgatgaccagctcctcaccctccagccttgtctcctttccctcccttcttccatctgctgtattttggtgatggtcctgctcccttggcccacacaggcacagtgcaaatcctttgctctagccccaactttgtggagaaagggtaaacaagaagcatattttatctccctattggtttggggttaggaatggggtagatatgatagaaaggggactaacatatttgttaatggcttattggtgctaggcttacaatcttaatcattttatcctcctggcaaggcagcttttatcctgattttttgtagggtaagaacctgggggctccaagggattataacatttacaccagtaagtgatggagccagttttaatagacctaagtctcatgttcttcctgccgcatgacactgccccttcacatgtctcatctggttccttgaacgcgatgaccgtttcttgtccatctttgaataagatgaatgcctgccatatgatgaatgctcaagcagtgtttggtgcccctgaggagaaccacggtggtgaagtgtctaagactcccggtgtcttgccattcaagcccataaggatttggccgtgtacttcttctagggtcctgtgtctctgttaccccatcagcactccctgcctggcttcagagccctcattccgcaccagccacacccctgtgcacctgcttcctgctcctccacagcctgtgcctatatcaagaatgcccttccttctttccattctacgcagcctcaggatctgatttaaattctacctccttcaggctactttcctaatgcttccttttaaagcatttcattagagtacagaagagccatggttataggatgtggaaaattcacaataatcatataagatcattcttgactaatagccacaggaaagagttgactactttggccttttaaaaaggtattattcactaataatctctgtgcctataactatgttacaaagaaaagcatgatttaaatgctaaactatttttaaaacaaaaattcagacaaagttaaaagttatttgccttagccctcacttctactctatataggtggccaccattaataatgttgagtatcctttcagaaatgatttatacaaatattagcatatatctgaatatccttgtatatacacaaatgggccatgtatacatagtaacctacaatttgctctttctatttttttgtgagttcatagtaggaaatatatatttatggggtacatgagatattttgataaggcacgcaatgtgaaataaacacattgtagagaatggggtatccatcccctcaagcatttatcctttgagttacaaacaagtcaattacactctttattttgaaaaatacaattattattgactataggtaccctgttgtgctatcgaatagtaggtcttattttttcttttttttttgtacccattagccatccccccctcctcccccacccccaccctcccactacccttcccagcctctggtaaccatctgcaacttgctctttttactgaatgtctttcggtgtttttgttttcacactagcacacagatccacttcacagctctaattctgaactttctaaccctcaattgttcccttctctgaacgcctataatacttttatatatatatgagactcatttttactctttatcaattttttttttttgagatggagtcttactctgttgccccaagctggagtgcagtgacacaatcgcggttcactgcaacctccgcctcccaggttcgagcgacactcctgcctcagcctcctgagtagctgggactacaggcgcgtgccaccacacccggctaatttttgtatttttagtagagacagggtttcaccatgttggctaggctggtctcgaactcctgacctcaggtgatccgcccacctcggcctcccaaagtgctgggattacaggcgtgagccaccgtgcccggcctactctttatcagttttttaatcaatttataatttgatccattattgtttatcttttgcttcttcaatgagagtgagctgttcaagatacagaattgcattgtccaataggatacctacccactagtcacatgtggctacttaaacttaaattaacatgaatttaaattaaataaaattgaaaattcagttcctcagccgcatcagccgcatcagcactatttaagtgctgaatagtcacatggggctaatggctaccatattggacagcacagattcttgaacatttccattatcatagaatgtcctttcggacagggctgattgagagccttctcacacataattcaacttcccatactgtatatcactaacccacagctagaagatagactggaaatagttgtcccattcacaataaaatgaaggcattacattcttgagaattaagtgaattctcaagattcattcaaagaaaaatgtgatctgttgatgagagaatctttgtccttcatcttcattgtagaatgctaaccttgatatcccagcaagcttgaatgtgctcccaaattttccacaggtgtctattccacgtggctggtagcccaggtgtcacagagtttccaaagtactcaaagggaaagcagcagtatgagaagtggcagggcaagtattactgaaaatttaccatagtcaacagctggtggtcactttgggttcaaaatggtggactgaacagatgtcttaacttcccttcctgacaaatatgacatcgaaataaacatgaagcagtccaaagagaatgcattcatagctgcgctaaaaacgtgagagggacattagtggatgagagattttcttggcattgcattgaaggacatattagctctgcctgcagaacagttaaggggtgaggcttcagccatatatttgagattaaaggatttggagattaggagtggatgtagggcagaagtcggggtgattaaaggaaagcctatttactaaacatgtatatggagagaattgaagctcctgctgtagatgttagtttataagaaacaggatggaagtgtgttggatgtgccatcatctgcccacttgctccatgaccaagcctgtgactatgaccaagtcctctatgtgaagcctgctaatagacattccccatgtggggcttgcagtccgccccctcattcagggagataggactactcccaagaggtagaaaatccacagaagccacctgcatttggaaactagttcttcagccactgatggttaacagttaattcatggacaccagatgtctgaaaacaacatttatacaatataatattgctataagaaaattgttgtttttaaaaatcaatccatagacaaaagtcaaaagtgttcattatagttacagtacagaaagtaaatcctgtaagttttggcaagcygaaagtagagggatggtgaatggtaaggtagagacagaaaaacagaggaagagaaaaatatagtgacactaatgtccccatcttacacagtgggaagtaaagagattccacctaaaatggatggatcaaataacaggtttaagtatgtgacttaaaaccataatgacagaggtaaaaaaaaaaaaaaaaaaaaaaaaaaagaaagtcaacccatgagccgtatttggcacacagaccttttgtgtttggccagtggtgttctcaaaaagtttgagcaaagatttgcaaatggaaaatgtacatatatgattcgtgtataagtggcttttctttacaaatgagagctggcaatgtttccacatggccacactggcccagagggtgccgtcactgtgtctgacattagtttccaggtcgttatagtccccaccattccaaggcatctcccaacactaaggacaagtgcctgttgccagtgaggaccttgcttttctcctagccaagtctatattcataatgggaaagcaggaaatggacaggaagggcctcgtgacatttcttgtcccagcccacattccctacatgtgtttcctgcccagcctctgtaggcattggagttagtgattatgctataaatgtccaataaaagatctaaaaatcaagtcaaggccaggaagagggaggcaccgtaagccagagaaatttctcatcactcctgtgggactccactaagtgctgtctaaattcttaaatcaagaaatagacacagagcaaaataaaaataattaaaagaaaaaaagattatgtcaagggttatagctgagaagtaatactgttgcacggaggggaaagataaagaaggaaagaaacctttagccattttataccctcaactttcaccttttactttgtacacattcttattgcttgaattttttgtaaacagtagacaggaattacttctgtatattttttaaaagcacaataaaaatgcctgcaagaagactcagtacagctgtctgagttcaatgtccagattctatttgacagatggtcaaagatgaatacacagtttacagtgaaagaagtgtagacaaagtccgggcatggaaaatatataacactgcatttaaaaaattacacaactctgctggcatttaaacaaatggaaatcaaaataccttaaaagtatttatgcacctaaaaaactagcaaaataagataccaagagcccactgctggggctgtgaggaaacaggtgaggttttcctttgttggaagtactgattattggttcagcctccttggggcttagattggcagaatgttacaagggcaataaaactgttgatgtgccttgccaagaattctgcttttgacactataacttaactcttaaaggagaagaaaaaatgtagttgctacaaagatgtccaaagcactatttttaataacaaaaaaggaactagtttgtactcaaaaggagatagattattatacaaacacatcaatgtggcaaatattacataatcacctatttgtcattgtggtagctatatccataaatgaaaatgcgtgtgaataacaaagtaggaagaaaagtagaacaaacactgtgcacactctgatcacaaccatagaaaatccatcaatgtgttcactacctaaaattagaagaggatttggaactgtatgaatagaattattttttgttgtaagttctttaagtgtctgtgtttttaaaatttctcagtgatggtttacttactagatggctggccctgtctagatatgtctgtctctctactaataaggccttaggctcctattgttttaacgtgtttccaattatctcgactgtctgccttgaaatggaaacaaagctgagtggcaaaatgaccgatgagagataaagagaccagattggggttttcttcctcttaactgtatactcaaagtggtgtaggggatctacacaggcatgagcgatagcactgaggtctggttcatttgttcacatagatacaatttctggagagcccaggatgttcagattccttctaatatctatcttccttccaactctaagtaaagttaataagtaagacactactttcataaataatgaccaatgtgagttgagcctcctctgtgctccagactctggagatacaaagaaaaataaaacatgattgctgtcttcagtgatcttgcaactaatgaattctcaatatcaaaacagaaaattaaactttccttcctctatgaagccttttctagctcttctacctcattgcatttctttccatttccatattccaagagggttgtattctgcactctacaatttagattttaattagataattaacgtagtgtgttgtggaaagagccctggactggggttctagttcccacatagttgccttaaactttctacaaaccactaaaccttcccgagtctcacattccttcttataaaatcacgattcagatgatccctaagacgcttcaacatctgaaattctgtgatgtgtctgttgtagtgtgtgttctctgttttacatgcctagtttttataaaacacacctcggtgccagctcctggtagatgcccagtaaaaagagattatttattcagtctgtaagttttctaaatattaatctcttgtctccttaatgttctgtttttatttaagaaagattttgagtgtttagatttgattcattcaagtaatgtttatgaagcactttaccatgagctggctactgtgtaggctgtttgtggtttgaggaggtgcttggggagggctggccatcatttgtgaggactgtggtgttgagatctacacacatcaggctgagagttggaccaaatcatcttgaccgttgctcccatcttcaacattttattattttattcagtgcctatttgtattggagttggtgttggagttttctttgtggtttgttctgatcacatctgatttttaatagtatgccataggtttgtgtggcattttacagaaccccttctagttttgttagagggtagagagtgctagttaccccctctcccatttgtcagcacttggggaaagatatgcagaatgaaatggagggaagtatgtgcatggagggccagtgcctctaagagcacagcaccctccaggagagctcgactgaaggatgaggccaggcctctagtgaccccctcaggattccatttgtccagccactggagggcagagttactggagacttggtggcccagtgctcccagagctcctccctcagtcccttccaggcttcatctactgtgagggtcttcccaacaattggcttggagcacttcctctctggccagaagcctccagttgttctgactgcagactcctggcctggcatttgcctttctccacgatgtggggctagttccccagaccagcactcttcccagttgccaggccctacattccctgagcaggtcccgggatttgcctcttggacttccatcatcctttctaactggagcccggacccctaatctgtcatagtgctaccctgcttcttccaaatgtcacctcttccagggagcccatcccacttttccttgccagttgtggtctctttcctgctgaatcaccctggggctttcctgtactgtgtatctttggctttatgttctggttatttaagtacttgtctctagaatgtgagcctctagacaatctcttattcatctttgtgttctctatagcacctaggacagtgcccggcccgtggtagatattcagtcagacttggttaggtgatggctgagcagggatggatttaaatactctagggcactgcagtcagcccgtgatgccaaagtgctgtcatttgcaaacgtgtttactgggcagcttgtcggctatcttaaggagctgcctctcttaagaccaacagtgtgatctggaaggagggcagttctggtatcatgtgcttgggtctttgtctttaattcagtctgccctctgggctgtagtttcctcatcctataaaatgagagagttgaaccagatgactgtgatgccccttcctgttccaacataacatggtttcataaaaatacatttatttctattttattttattttttgagacagaatctcgctctgttgcccaggctggaggacagtggcgcaatctcggctcactgcaacctctgccccctgggttcaagcaattctcctgtctcaccctcccaagtagctgggattacaggcacgtgccaccatgccgggctaatttttgtatttttagtagagatggggtttcaccacattggtcaggctggtctcaaactcctgacgtcaggtgatccacccacctaggccgcccgaagtgctgggattacaggcatgagccaccgcgcccaaccataaaaataaattttaaacaagattttggagtagggacctggtggttttatgagcatgcttaccagttgaccccactgctacgtgacaggctgacttaagtgactagtttgcaggttcgttcagtaaacactaatggtatgcaggatgtttgtactcatgcaataaacagatgacagagaaaaccaagacactgtccctgtattcaaaggtttgacatcctcaacttgctgaggctctaaatctgcacttcccacaccctctacatgcacatcaaccttgagtgctggcatgtcgtgtgggaatgaggaagtgtgttctgatgtcacacattggacctgatgtctccttcaaattaatccctgtcccctgcctctgctgaagaactctgaaataaaggcgggtgggagatggtgatggtgagaagagacttatgtcctgatagtgatggtgaggatgagcaatagactcacttgttcttctctcatgtggtggcacgctgagtccctgagcaactcctctaagaattgcaggtccctctcagccactcagaaaactccagcagggattacggcaggacgaggtgggggcaggcagagcctgttgagagctggagtttagatggtgagcacagagtcccaagcctgggagggaggttgtctgtggagtgtgaagaacttggctcaacccggccaccaaatgctgggaagcctgacaggggagtgaaaaatgagcctggaagagttggagccaggaaggcaaggaaaatcaaatcaaatctggatcctgacttaaaaggcattaggctgaggggagccaggcacctgaacatactttccacagcctgtcatgctgggcctgcctcatccgtgtgcaaggggacgttgggcccagggagactggttcccaggccaccatcccccagccagtctgctcaggcgcaggcacaaccccatcaaatgccatactctgttgagctagaggacaggagagctgctgtggctcagtcccgaaaggagtggggaaagactgtttctggagcagactggcgccagtcagtcccccacatgcacagtgaacactggtactgaattaatgaattatctgagacaaagctcttttgtcataaactcaagtcatacccaaccccacccccactcttcatttttagctgccaggacatagctatttggggtttgaagtgaaattctggacaccttagtgctggaatcattcgtggaggcactttgtcgagagtggtttctcaaggtgggatcctgcagaagccactgggtgcctgcagggtcctacccagacccactgaggtgagaccaaggaatctgcmcttgaacacactgtccctaaacaggttcttctatgagccactcaaggggcagctgttagtctccagagatggaaacaaaggtcacacctgcaggtttcagccgcccctgggcgagcacatgggaagtggctgggcagtggaggaaggggtgactgggcttctgcgtcttgcctgattttacttctgagggtggcgggtctgacaatctcaggccctgggaaggggctgtctgttgatgggctgctcgagcatattgctgacttatagattggtgattttttttttttttttttttgaggcagagtctcactctgttgcccaggctggggtacagtggcgcaatcttggctcactgcaagctccacctcccgggttcacgccattctcctgcctcagcctcctgagtagctgggactacaggcgcctgccaccacgctcggctaattttttgtattttgtttagtagagatggggattgatgattcttattatcaccattatctccccattatcaccctcccgaggaatcccctagtgcaaatttaataccacagttatactctataccatatatgtgtactggagtatatctgtgtgtatatgtaaaaagagtaagactttttgccccttactcctgagaaccaattatcgcccccccttagggatgatattacccccttgagaatgcatcatcatatagattaaattttataatgcttagaatcttcttctggagtagaggtgtggagtcagaatagagaagggaaaatatgggtaggaaataataaacctggggtaagaatagcatacagaaataagcactgtacagtcttgtattatagttgttagagatgggctgcaaatatgactattagctttctggaaatcattttgtctgtaaaaaataagcccatttgctcaggagatgcagtcaaaggcctaactagtgggaactctggagatcacgtgtgggtatatacacatgtccctgtgcataaacaaggagctgtctggatgctagaggtggcaggagatgctttttgggcagtagactggagacccctggctctgtcattgttctgtgttctatctcccctcctaccctgaactcagatcaccactatcgtctgctccacaccctcagcccagttcccaagctggctcaggccccttctcactgctcttcgcctcatctgccttgtggccctcaggtctctgttctacacttggtcatgcttcctgaacctccccaaagtttcacaggggaagagagggtgagcgcaagactcgagctgtggcagagtgtgggtatatacctcagggtggaccagttcaccttgacctcttcttcagggagcagtggccagccccgtgcttataaacatgggcttgccagagctcaaatgatcaaaaaacatcaggacaggaaatcaagaaactctgtgttgtggggccatggaaagaatagaaagcacagatttcgtagccaggatatctgagtttgaatttgttctgcttacattctctaggccccatagctgagatgggaataataattcctacttcccagcatagttggagggttgatgcaatggcagatgtgcgcaagcacatagcagttgcctaataaaacaatgggcatcatagtactatagtaatacagtcaggatcactgatctgtccacagcaccactctaaatggcttactttgagaatgttttaaagtaaaaatgcaatattctacttaagaaagcagataagcaaaggtagaaagaaggctaaaattacctatggttctgctttgctctcggtctttattattgttttgtttaatcgttctgtcctatagttattttctaagctgggggtttcttttgttttcagcatagggataactacaggatctacaggggcatagtggcttgtggaagcatcacaggccatgggtcagacttgatttttaattcaatcccatcctttaccaactgtgatcatgagtaatttgccaactctccaggtcatgctcctatctataaaatggggataatactacctataatatggcattacttaagtgaaatatctttgctgcatatgtaatataagtgctcagtaacttttagtcataactaaaattattcatagtgttttgtatcctgcttttttcagccaacatagcatttttcaaatcactctgtcaccataattttaatggtgaatattccattaaatctgatatgctaccatttactgaatcattcctctgttggcagttatcttgatggtttccaacgtttccttttataaattaaattttcatcaacatctttatacatgaagtttttaattccatatttaatattatttccttgggattgattagttggcagaagagaggtgaatgggacaaggattcgggcatctttaagcacaagtactttccaagaggcttgtcttcttcagcttgcactgttatcagtaaggaagaagacatagcaccagttttcatggcccacctgctccctgatctgtgagattcaaacttgccttgtcacatctggggcacctccctccaccaactccttcytgccccagctcgtagcttggttccctccaaaccaagaatccttcagtagacctcagtctgtatctgccctgcagcttggcctcttgtcctgctgccacacggggaccagcagggcctgcaggtaccaagcggtcaggagggtgggaggcaggaagccagagagtccagtgagagctgagaccggtaatggcgtctgctggggtggcagagggagcgagaacagcaagcagactcagagatcaggcctgttcatcctagtcgtcagaaagatcaagacagcctagggctcaggagacctcagtgcctaccatgatgcctgacacacagtaggtgattaagaagtgaaaaccaaaggctgggcagtgagagagccgtgagtttaaggagaaccatcttcttcccagaggttcactgactttcactgatagaggacctcattaaatttcaagctaagagactcttccagccacacagggtcgaatgttgaactacttggtacttgtcattcccctttttctcttttcttctctgcatatcatggtcctggcccacatagtcattaattttaatcattccattgaactcatattcttatttagagtatatttgtcaatttgtcttcactgggctccagactaggagcctttgggttggatactgtctcccctaatagagagtgagcatcctaaggcaggtgccacatctactgtactgactctaaaataggtgcacaacaaatacagagctgggttctaagaggcatgaaatgctaagactcagttcttgctcactaagcattaatgcagcctgattgaagtactaaaatgtatgtgcatgcacacactttcctgaacttacatttgttttgtgagatctgccgatgctgagagccaggtgaggtaccccatgcctataatcccagcacttcaggaggctgttgggggaggattgcttgaagccagcagttcgagaccaccagcctgggcagcaaagcaagacccagtctctacaaaaaatagaaataaaaaaaattagctgggcatggtggtatgcaactgtagtcccagctactgagaggctaaggtgggaggatcacttgagcccgggagttcaaggctgcagtgagctatgattacactccaacctgggtgacagagcaaaaccccatctctaaaattaaaaaaaaaaaaatttaccatgttgaatctgtcttttccatcttccctattagagtaggcactcattgtgggaggagactagatccttaaccttctttgcatccccagtgtctagcacagtaacggtgaagggtgctcaacgagcctttatccagcgcataaacaaacactagtagtgaacaagaccctatgctctatggtcggtatattaatacaataaaatgtgcaacaaaaaatataggaaagaagcattcagaagacctcatgaagaaggccggtttcattctaggcctttctaggagtcattaatttattcaattacaaaataagggtgtggtgtttaacagtgctcttgaagaatactcctaaggggacactggtgaaatatcttgccaaaagactaggaagccttgccataactttttgatacttggaactttcttgcccgtgattctgtttgactcccctgaaaagtagtgagctatggaggaacaagcctgaatctggggaccttgtgtaaattacttatcttctttgagatttttttttcttacctataaaattagtatggtaacactgaccttacagcggtattgggaggattaactgaaatgatttgcataatgtagcctgtacttcccgagaatgaacgcccaaccccgtccatgcttgtacagcagggggaggagtaactgcctccggaggactgtgatgcagtctccactgaccctgcaaaagtattgtaacctctgcctgacctgcttgtaggttgcttaggaggagagctgagaagtgacaggaaaaaggttttgtatgcagtttatgagttaagagaatattacttaattgtgggtttgatggaaaacattatgtgaggttggttcagatctttccagaggtctgccagcaacctcagaagtggagccttattgaaaacagctggggagaaggttggcgcccagcctctccttgcttttccatgccccagagctgtctcactcagtggactgagctcagccccaggaccctgccaagggctctggcagcctcagctggagacaggcagtggctctgcccagcttggggctccatctcaaagatcaaaaccagttaagccaggagtttgccaggccaccagtcagtatttcttccaggtcttgaaattagccactgacttgagttcttgcaggatgagttaaccagtgcaacgttttcgtggcaggggtgtgggctgcctactggatgtgtgatggatgggctgtgttgtcctttgaagtcctcccagctgtcctgctgggcaccagctagagaatgaggatactgttcaaagcacagccctcccatatgtccattcagaagcctcaccctcctctgctacagaggcttttctatcggaaggctgctagctttgctacagctgaagcccatttggttttatcccaactactcaccaaccatgtcgatttcagctgaattttcttgaagacaaatatggcatgccactcccttattctttcatttcaaagggacatttagtcactgccagtctcttgttttatttactttctaaaaatgtgctcctactaaatttgcataatttgaatttcagtaagtaaaatttttaaatttttttactgttcatgaaagtaaaacgtgttccttactttaaaagttttgacatacagaaagtatagaaaacaatcccaccatccagtgatgacagctatttacacattagtagatttcctttttatttcttttttttctattgtaacaaggagaaagtaaatcgttaaaagttacattatggatattaagtaactggttttatatgctgcctttttagttaatgctttctcatattctttaaaattcttcaagataaatcttaatagttgtatagtattttggtcttattatttcaaatagactatgtttttgatatgttgatttctaatatttaatcttttaaataaacataaacatcttcatggacatctttgataattcctaagagatattagaaatagaattattgaatctttttaagtctttggatagctatttccaaattgttaaaaatagccttataaggtcaacattactatgccaattttataggaaagaaaaatgaagtttaaattactacccttccttcagcaatgtttaagaatttaattttctcacactcataagcactagttatcactttacctattaacacgttttttaaatgaaacatatcacattttattttacgtttgtttgattaattttaaacatttttatatgtttggctacttcagaaacttcttgttcatgtcctttacttttttccttctgtgttctttttatttagtcatgcaaactttttatatcttaaaaagttcaccttttttacacatatatttgaaatatttttaatttgtttaccttttaatttttatcctaagtttacttttgtacagaaattttaaattttagtgttcacatatctttatgctttccactattagtgtcatgcctggaatctctaagattatatccacatttcttctacctttttttacttttaacattttaatcaaaatggatgtttctgtgtgtaatgtgaggaagggatcttgaataggatttttttcaagttatccacacttactgaataatctattcttttcccattagtttgaggccacctttactgtatactaaagtcttatgtatagagtttgttttagcatttttctggactatttcattagtcaatatgtgaaccaaaatggttttaataattgttgctttttaacattccatatctaatcatataatcctactggttacttttaatacaaggacaaagtatttctctttatatatccaagacttctcgtatgttgtttagaaagttttgaaactttaattatataggatcttcacatttcttaaatttgttcctaggtgaagtgcatgtgcatacctttcctaatcgtaatagctactagatatggaaacagttttaacttttgagtaggttataactggctaaagccaatatcagaggtgtagacggttcccaaattatgatagttcagctttacattttcaactttatgcaaaaatgatacccactcattagaaaccacacttcaagtacccccacaactattgtttttcactttcagtgctcaataaattacatgagatattcaatgttgtattatataataggccttgtgttagatgaatttgccaactgtaagctaatgtaagtgttctgagcatgtttaagggaggctaggctaagctatgatgtttgatggagtcactatgttaaatgcattttcaatttagaaaattttcaacttaggatgagcttattgggatgtaacccatcataaattaaggagcatctgtatatgcatagcctttaatgcttttatcattgaacaaaaattactaaaaattagtgagccaatcattcaactcgcaaaatcaaagactagaacaagccgaaggaaagcagaagcaaaacatttatataaaaggagaaatgattgtattacaaagagaaaaacaatatttaggaataaacttaaggactggtcttagaaataagacataggcaaaccctactaggccattcaaagaaggacagaaaatatacctaacatttggaaatgggactctaaccactgatctgtagttgataaaaatgagattttcagggtaaactccgatttgaagatcttgaaagaagtagatgcttttctaagaaaattaacttaaaaaaagttgaaaacctgaaaagttcagtggaagaaactgaaacagttgaagaaatatatcctgagaaagttctggatccacatagttttatagatgagttcattaaaaccttcaaggagtagatcattccaagctctgtatttgtagcacaaaggttatttacagtatgaaatggaatatttctttcatagtctctctcacctttatacattcagttctgtgaaattcttggaaaactaggattggggttgtaaggcatcttagagggtaggaaggcttcttttgacaacatcccagccagatggttctccagtcttcttatgaacattctggggacggggatctaccgtgtcacagttggtccatttggttgttgaggcattgctggtcttacttatatgaacctaaatctgcctctggagaattatggaccgatttatccttggtctgtcctctggcactacatagcatgtagacttttatacaagagctcatcatacatttgaagacagatatgccctccttttggtgtgttttactccaggctaaatagaccaacttccatcaactatactttatgttccttcaataaacatctgttgagcacctaccaggtgccagccgggcactgggcatcaccccctcacacaccttgagccgcttcctcaatatcctattaacacgtggcacttgtacctggacgcagtctgtcagtgatgcccatgtggaatgggactgcccactccctgtgtggacaccatgctctgttaatatggcttaaggttaaataatgtttaaaagactcatgctcggctcctttcaatgttagctgcccttccacactaattttgtctagttgatgatttagaaccttcacaagacttattctctcctaatatatcttgattcggacctttgttttattttattttgagaaagcattttgctcttattgcccaggctggaatataatggcatgatctcagctcactgcaacctctgcctctgaggttcaagtgattctcctgcatcagcctcccaagtatctgggattacaggtgcccgccaccacgcccagctaattttttttttttttttttgtatttttagtagagacagggtttcaccatgttggtcagcctcgtctcgaactcctgacctcaggtgatccacctgcttcggcctccaaaagtgctgggattacaggcatgagccactgcacccggcctgactttgttcttttagaacattgattctatcagccaatatgtatactcccaggattaatgccagctttagtactcgtgagcagccttgcagtccattcaagtaataaattcataataaataataataaattcaacggaataaaaatgttcaacaaaaacaaaagaggaagtcctgggacctaccagagagaccatgacattaatttaaaaatacttattgatcacctactatgtgccagtcattgtgctgggaattggtaattcaccagtgagccaaagctttgtagctctttccacagacagttacagtctagtgcgattagacaggcaggagtgactgtgcacacagatgaattataagccgtgatgaggcccactgaaggaaaacccagggtgcagtgagagcataacagcatgacttagtttgggaaatcaacaaaggtgtctctgaagtgacacccaggctgggatataaagattggagaggagagacatcagtcagctagctactcagtgctgccaaaaggaagtggccatgctgagtgtggagacaagttcagaataggtgtaatgcctgtttccctctcatgagtaagtcacagtcttgcagtaagttgtgccaaatatacctggaatgaatagaaacataacccgtgttactggcataagggctgtcacctcagattgtcatgagccattctggtttaaaatattctcatttttccagtaaagttatccaaatatgcttggagttccagtattttgatgttgaaacttttatagcaccaactccttcttgcacctggaggctgctcgtaaatctctcatcagataatgtatcctgatttttttaatggaaaatatggtcctgtgcttcgtgtagggcagagagaaatgtggaaggtgatgtcatggtgattagttgtctcagattgtctgggacaggcctgattttaagtagtctgaactgtgatcagatcaacatgcactcgtttttaaaatgtgaccactgtagataatagtgtagatgctgcaaggaggaagcagggcaagatcagaggcagccagagtaacgggaggctctctagaggcagagcaagtggtcctggagaagcaggcagagagggggagagtgcacttgcgtggccttttggaattgctcctcgcttggctctgccagcagtgcatatttctaaggcccctatcctgttcaccagacagtgtatggtgaagatgtttcgaaaggacacaattaggaggaaaaatctgatgtgtgacacatcccatagacaaatagaaatagaactatgattatccccttttgcgacaaggaggtaagtgaaaattgattgtatcagcatttagccctggctttagaatattatttttcagccttacaaacaaatactacctacttagaggtggatctgggtccccagtacctaatctctaggtgtatttagagaactaggcccactgtggccaagggccaggagcagcagtggcctgagccctgcatggtgttaggggtctttgccttagagaggggctgggtgggtcattcaggtcagggctgtccttactgaatgggtcttcccttcaggtgacatagctgagcagtcagtgctgagaattctgactctgtcctcacctgcatttggtggcagtccttcccaggggcagaagaaacagctgagggccagggaaacattgcttttttcatttccccctgaccagcaaaaggaagggaaaaacaccaagcttggaaaggggaccctgaccctggacccagttgtaaagctcttaagacagaaaacggctttggaataagcactgctctcatgcttgcgtcctgcagctgggggcaaagggctctccaggcatgcctgcttcttttgggctgcaggttgtcctggttcccctcagcttctagggcaacagccctcctggacagcagtgtcagccgagtggtcactgtgagaagctgctgctgagaggccaggagttcggtcagcattcccagagcctaggggctccttcagaagccaagtggtgatggtaggagtccaggctcccttaggctgaagaggactctctagagtgtaacaagtttacagacccttccaattcctaacccgaagctggcccttttaacaacacaaaataaagtcatcttctcaagggccaccaggcctctctcagcagcccactcccctgaagacacccacaggcatcattcatccttagcaagtacttcctgtcacttcctgacacccccatgggactgacacccacccatccttacttcttccccactcctcagacctggaggtcactatggctaacgtgcttagtgcagcaaaggccttagggcagctctggcaccagccatgcatttgtttttgtttttgtttttgttttgagacagagtctcaccctgtcacccaggctggagtgcagtggcgcaatcttggctcactgcaacctccacctcccaggttcaagtgattctcgtgcctcagccacctgagtatctgggattacaggtgcaagccaccatgcttggctaatttttgaatttttagtacaggcggggtttcttcattttggacaggctggtctcgaactcctgatctcaggtgatctgccaacctcggcctcccaaagtgctggaattacaggcatgagccaccacacccagcctcatgcatttgtttttaacagacgaagaatgagttgcgctgcgcctgaaattctctgagctgggtggtctgagcagttgtctgtactgagaccaagccctacctgcaggcttctcaacccactgcttttgtctaacagtggctcagctgggccccagcccccgccaattcttcctccccgaggatcacagacttgaaagggacactggcgggaggaggaaaggaaagtttgagttttgttttttactacgtaactgggcagcttttccctccatttttccagatgcttctttagaaaagagatttcagtggcatggactgggaagtctaattctgctttaaatgtgtgttttgaaccaggactctgacccctttggtgctccccagcccccaaacaggccaccaacaaatacccagagaacaaccgcaggcaaggtttgctcacaatgggtcctgattggagggttgttggtatgtgtttcttttcttttctgcaacccctgggccattgccctaaaattcctgagcaatagcttgtgagagggctgtgccctgtggaactaagttggcaagagccaatagatcaggcggaagtggctgaggagagctactctggttcagcaagagctgtttatgtgctggcacgacctggaatctgcctcggctcacaacctggggtctccgaggacccctcctaaggcgggcagggctgttgggagctatctcgcttctagtgcaaactgggttcaccctttccctacaaacccttgggcgccagccccagccctgtaagtcacccctactgctgctcccctggggcagatgctatattaagaggtggtcctcccttcttgctcaactcacagcaacacctctgtggagccctcaccctcctccgtgctcccatggtcctcagcacacacctcttacacagccctgactgcatgtgctgtgggcctcgaggctgcgagccacttctgggcggcctggagcctgtgtggtcacgaggcagagaagggggaatgagggtggagagaaataggcaggccaggtcttattcatagcacaatgagaactcattggaaattttcaaaacagagagtggctttggtctgatttatttattataaggcagtgtaacatttggcaaagggataaacatatagctaattgaaacagaacagagagttctgaaatagatttttatatattggctcattgacttttttattgtggtaaatacacatgaaatgaaatttaccactttaaccatttttaagtggacagttcagcggcactaagtacattcacattgttgcacaaccatcaccaccatttatctctggaaccttttcaccttgtaaaactgaaagttcccacccattaaacaataacttcttacttcctttccctctagcccctggcaaccaccattctactttctgtctctatgaattttactactctaggtacctcacataagtggaattataatgtatttgtgaccgtcttactttacttagcataatgtcttcaaggttcaccagtgtagcatatgtcagcatttccttcctttttaaatttttccctatgtaatgccaaaccacagaaccttcctttttaaggctgaataatatcccattgtacacatatatcatattttgcttgtccatttatctgttgatgcacatttgggttgcttccactatctggatgttgtgaataatgctgtcatgaatgtgggtgtacaaattccttttttcttttgttttttttcctttctttttttttttttgaggtggaatctcactctgttacccaggctagagtgcaatggcgcaatctcggctcattgcaatctctgtctcctggattcaaacaattctcctgcctctgcctcccaagtagctgggattacaggcatgcgccaccacccccggctaatttttgaatttttagtagagacggggtttcaccatgttggccaggctggtctcgaacccctgacctcaggtgatccacctgcctcagcctcccaaagtgctggattacaggtgtgagccacgacacccaacctgggtgtacaaatttcttttcaagtccctgctttcaattattttaagtatatgctcagaagtggaattgctggatcatatgataatggaactttaattttttgaagaactctgccattttacatttccaccagcagtgtgcgacggttccaatttctccacgtctttgcccatacttgttattttctattgctttttttaaaaataatggtgtccttaaaatgagtttttaaagaaagaaaatgaaaacttataaacctatgaggacagaaagaatgaggagagacaacagcaaatgagagatgtcaacaaactcgtggatgatggcatgtgaatagatggttggctgagttgggtttcagtcttctgacgygctatgcctgtggttaggagagtaggcaatgatgaagcaattggaagatgacatacttccagagcctgggttgcgaagtgaagctgaaaactggaagatgaaagatctgataaggagcagtgaggccccggttccccgctgtagtccatgccccagacccctctcctcctgtacacccaaggagactgaaagctcctccgtggagaggccaaagctgaccagctgtcacgtcctagacatgaggtacagctgcaggcagggcaaagcgttgtactcaaaagggagaggggccgagtgaaagtcagcatgtggaaaataaccaacttaccttcccaccctgcgatggtcttccctcactcagtgtactaaatgctggtagacagacttcgttgctgtacccaccctccaccccacaccaccaaagcagcaactaggaagatgcctttttatggaaactgattatctcaagggagaagatctgcagatattgatgttgatgttttaatttcaatccctctaccatgaggtctgacacattgacaggtcccatctgtgcacctggaactttgtatttcctcacttacatacaggaaaaatcagtaaaggatcatcagatgtccaagggaatcctctgttatggaacagacataaagaaccgaacaaggaaccaagtagaaacagaagactgcaggaaacagaacttcaaagaagtttctctcacctcagagataagatgttatgtctattaagcaagaagagaagacaattcaaaacaattttgagaaactgaaaaagggttttttgaagttaatgatagccaaaataataaattcaatatactagttggaaaataaagtcaaagaaatctcccagagagaataaaaagactgaggtagaaaaagtgtgaaaagaaatgtaggtcagtctaatagggctcatgtccagttcatgggagttccatgaagagaacattgaggaaaacagtagagagagaattctcaaaacacaaacattcctcaaaactgaaagacatgcattgccagtaatgaaaatatctaccaacggtctgacggacagtgaacaaagacccacaccaagtcaggtcatcatgaaattctagaatatcagaatgaaaagaagattctaaaagtttgaaaggaaaacacacacacaaccccacacacataatagttcacagatgatggatcagggagtccgtgtggcattatgcctctcaaacagcaacactggatgccagaattgccttcaaatgccacgaagcagtatcttcagagttctgaagaaaaaaaaaggtttccacttaaaattccatctccagacaaaatgtcaattgagtataaaggtagaatgtggatacttttggaaatgccagatctaaaaattttaactttccatgcattcattcttagaaaactattggaatggtattctatcaaaacggtggcatagaatgagaaatttccaagaggatggtgagggaatgtcccaggaccactatgcatcaagcccagaaaacatccagtttagattagaggaggatgacaaaatgttccgggagggttatctctaaaggagaaaaaaataacagcaactgatgagttatctgatgcatttgaccattactgagaagaatgtatggttctcttaagaagttggagtccttaaaaaactaaggatatcaaagtaaagcagttattaactccaggaaaaataaaaagttcaagatatttattgtaatatactatgtggcatggcagtgagcaaagttagaatgtagtgaagaccacaatttttgtcatgtcgatgtgtaatgtcattttgtgggggtaagggatggatttatgtgggggcagatttgagagcttaaagtttacattccatacagagaacttaagagattgtcttagtccatttaaagtttgtgctgctataacaaaataccacagaccgagtaatttataaacaataggaattcatttcttacagccctagaagctgagaagtctaagatcaatgcaccacttggtgagggccagtctttctgtttccaagagagcaccttgttgctgcatcctccaaaggggatgaatgctatgtcatctcatggtggaaggccgaagggcaaaaaggggcaaactacctccgtcaagcccttttctaagggcacttaaccccttcatgaaggctctgccctcgtgagccacacctgagccacaccttctaatgctgtagcattgatgattaagtttcaacatgaactttagaggggacaaaaacactcaaaccatagcagagataatgcataaaattaaaaagaataaagtaggccaggtgcagtggctcacacctgtaatcccagcaactttgggaggtcaaggtgggtggattgcttgagcccaggaaattgagaccagcctgggcaacatggtgaaaccccatctttaccaaaaatatgaaaaattagccaggcatggtggcatgtgcctgtggtcccagctacttgggaggctctgggtgggaggatcgcttgagcatgggaggtagaggttgcagtgagccaagatctgccactgcacttcagcctaggtaacaaagtgagaccccatctcaaaaaaagaaaaaaaaaagaatattagttgtgtaagactattgtttaggaataatggaagaaatatcagaagaaatgactaaaagcattgaaggtgattgccctcaaggaagtggaaatgggagtgggagggcggcctgctttcttatgacttatagtaccaattcacattttaaccaggtacgggtgttttggtgaggataaaaatatatatattttttgaggcggagtttcgctcttgttgcccacgctggtgtgcaatggcatgatctcggctcactgcaacctccatctcctggattcaagtgattctcctgcctcaggctcccgagtagctgggattacaggtgcccgccaccatgcccagctgattttttgtatttttagtagagacgaggtttcaccatgttggccaggctagtctcaaattcctgacctcaggcgatccacctgcctcggcctcccaaaatgctgggattacaggcgtgagctactgcgtctggccgagaataaaaatattttaataaagatctgggtttttttagcctaatggccagtcagacactgacattgcwtgagaaacaacytttgattccttctctgacatgattctctatgcaaatcatgatgcctttgggcagcttgggacatggggcagacattcaagcataaagggacattttcatgaggctgctgtctgccacttgtgccaggtattttccagcagagtcaaagagatgctctcctggccacatggatacaggtggcataaaagatcctgctttcatagccccacctgctccactccgtccctcagagccgccacctgggagagtgagcagaatgcatgctttgtgtggtggattctgacccaacgtggagcaggtgttgggtcacagagacaggctgcagagatcagaaattctgaaacaaagccaaggaagccaagtcatgatgttctcagggtgttgagaccctcaggtcacttttgcccacccttgcttttaaacagaaattgtcagagaataagacagaacaatctgtggccagtgtctgagtcttgggcagcaggctctgctgatggaggggttatagtctctgtgttgtttggggagcagccctccactccattcctactgccagtgaagtatgtctctccctctctccaggtccaatcatgactggctaaaaactccagatttattatccagatttatttcctgacactcacccatccttcttgaaattccagggctgcattagtcagtgaggcagaaatccaggggatggtctctgtctccaaggctcaartggtattttgggagtggaataatggcacagtaaaactgcagactggatatttgttttaaaatgtgttttttaataatacataaaaacaaggatcacttttcaaattgggtttcggtctttaaataaaaataataagccaattcaaccagagcagaatgttctcagttaaagggttagatttttacctagttaagagtgtgatgccttgaagttgtctataagaatgaaagttgtgtaagatgaggcataccaagcccataagtttatatgttctgatatttcttagggcagaagtagtttcatgccattaacagagctgggagtgaaatggagtttcgggtacctcattataaaaaaaaaattgttgactttgaagaaaagaagagaggaaaagtctaacctttagaatctattaatgtggtattgtacatgtgctatctcatttaattataaacttctcagccaggcgtggtggctcatgcctgtaatcccagcactttgggaggccgaggcagatggatcaccttaggtcgggagttcaagaccagcctgaccaacatggagaaatcctggcttaactaaaaatacaaaattagctgggcgtggtggtgcatgcctgtaatcccagctactcgggaggctgaggcaggagagtcacttgaacccgggaggcggaggttgcggtgagccaagatcacaccattgcactccagcctgggcaacaagagcaagactctgtctcataaatacatacatacatacatacatacatacttctccatggaagtagattctgatatcatctgcactttgcagttacgtaaactcagagccaaataagtaacttgctcaatgtcaggcagctgatgattgatgcagcccacatccacacatagatctgtctgactccaaaggccatataccttcctgaagtaagtaggtgggacttttttttgcaggtgacagaaactccagctaggttaagcaaaagatatgtattgtctcatatacctgagcgggtccagagtctaccacagctctgtcaactctgtctccatttcttctcttcactgtatatatcagctcttattctccagatggcttcttccttctgggaggaggcaagaaaatagataatggggcttgggagagaacggctgcagataggctaagtcttacatcttctcagttttgggtctctgtgaaaagagacagctttggtctctcaatattcaaagataaagttgcagggaagatctctcattggctggcttggaacatatgcctattgtttgagaccaagtgctttggccaggaggcattttaccaattggcatccccaccgggtctaacacatartgggtggaaagggaggaggcacttcctccaaaggagaggaatgctgcttacactggcaggcaggagagcctagcaaatcaaaaccacgtcaaaccacagcattaatttgttaaacctctgcaatgccacatgcctctcattaatacttaatatgtctgagagtgcatctctatttggtagcagaaactggagagctgccacagaagagtgatctcctgggcttgctcctccagctgaagacacagtatccgtggagacccatggtgagagtacagccagaaccccaaagttttgtgtagaggttctggaaagcctggagccccacaactatcccagaagggctgggagttaaaccagaaggacatctgttttgctatgaaaacaatgcatttgggggaacaaggaaggtatcaacgtgagaagttgcccatcacacttaaaattctatgtctttggccaggcacagtgtctcatgcttatgatcctagcactttgggaagccaaggcaggcagatcttttgagaccagaagttcaagaccagcctgggcaacatggaaagaccccatttctacaaaagtacaaaaaattagctgggcatagtggcatatgcctatagtcccagctacttgggaggttaaagtaggagaatcacctgagcccaggagttcgaggctgcaaaatgagctgattgtgccactgcactctagcctgggcaacagagtgagaacgtgtctcagaaaaaaaagaaagaaagaaagaaagaaaaatctgtatctttgtttggctgctccaaagggttttagatgcttatatcattaaaagggaatcaaaaagttgcatgtgttgataaggttggtctagataaaaggaaatagatctttttgattaagcggtccagaagggcttgaattgtaacccccagctacggagctataacttgccttgtgttttcagtgacagaaacaagtcctcagccttgcagatgtcgaggtgcagkgattcctatgtctcgggtcataggaaaagaaagcatgccataggaagtgagagtggctgatcacagagaaagagactttgagcatctgtccctggagacccacatggcatttgctgagccattgagaggaacaattctctgcattctggttttatttacacggaagcacttttgtcctcattggtttacaagttggacatgggggtggggagcatccagcagtttaagcctctcactaattgctgtttttagttggtatgrtctcttcctgatgggttctgtgggttcagttaaggcttttgactgttggcaatgggattattcaaagccttaattaagtgcctgcctgcttatggggctgagtgccagttgctgacacagatgcaggctctgaagcttggtcatgccatgcccctggctcacccttcactcttcaccctcataacatacccatgaggtaagttttatagacattttctgtggtctgatttgtttggggtgttaatgttttccttcttttttttttttgtgcaaccacgtccatttattatctgagtgagcttatacttggagatggggcagaagaagattgattcttcttcagctaatccctcagcaccattggttttatttcctactatttttcagtttttaatcaccagtcctcttctagtcttttatcataggagaaacaacacttgtaacagggtaagaagttcacagtaatgtgttacaggcaggcaggcaacaatcatgaatacatagacagtgttgcagaatgaggctttgtcagcttaggggagatgtccatctagaagaattccttaatgtcccctcctccaggcccagcctttcccagcatcccttcagttacttaacaatcaagtaaatactcagtggcaacccctcgggtctgttgttcccagccctaaagattcttcagctcactgctcatatcttcttggtgcatcttcccaatccccagtgtcctgctgggcagtctgttttctccctggcctcagctcagtcctgctttctctccttcctggtcttcctccgtccctgatgtgggcagagcctcagttccttcttcctgctcatgtgacctatctgcggttgggccaccgcagctgtgccctgcagctgtgtgggtttgtagtgtgtgcattgcgccaggccctgccagacaaaaaagacatgcggcagatctgcagaatcagcacaatcaccccctttctgctactcaccaagcttggagaagatggatatgttgctttgagtcttggaggacctatagggacaaagaatttgcccctgctctgagcacaggctatggtagcccgtcctaagcaactgaggataagttgaaagcccttgatatatgttagagaaaaaccaaaatgcttagtgctctaacagatgttttgcttttagtcattaagtaaatctcaaggcagcaccaggttctggaaactgcctctcaagtgagacaggcaggtagaatgcagtggccaagcgactgcctgcctgcagctcagctttctcctcaaccttcagcaagcacagaatgagccctcattccttttaaaggccttttgaggccataaaggtttttgaggacattttatgaagctggagcacagttttactatttaaaattattataggggttatggtgactatatctttatttttatgacaagttgttggttatacccttgatttatttgataccgggcttttgttcgagaatacaacctccaattaaatgtggttactgtgtcaagaatgcgattctctccttagagtgaccctctttggtgccatttccaaaactcattgtggtgaaaactcagggctgtctattcatgtttgtgagcatttcttctgtggttacttggttttctcatatggaggattagagggtactaaggctgtgggttggacccagaggagaatgcaggggaaaggaaagaatcttccctaagaagctaagtgggtcaccatttaaaaccataatacttcagagatgggaggaaccttagataccaaaagcaatttcctccttaatacaaggaaggaattacaacccaagaaagctaggacaccaagccaggcccagagtgtgcaggccttggcttgcatactagcctctctgtaccacactgactctcctaggggtgtcttaggtacacacctggcaggcaccaatcctgtcctattacgaaaacaagggaatagcccaagacttgcttatggtgtgattataaccttggtgaaccatttgacactttccaaaagtggggagcagatattgctttaacctataagggatttagggtctcttggagatagacgcttatgaatacttttggttctacagaacttacctcaccaaaaacatgaatttacgatgaggcatggagacaaccactcaacctggaaaccaaaattatggtctccaatctgccatttaagctgccatgtgagatcatggcaaaccatctacttctccaggcctcttttctaggctacatgggcccagtaaaacgactggctttgtgagctgttgtggacattgttggtgccctacccgtataccttcattaggcccattcccagctgctgtgagtgttggtgaggacttgcaggmaggggtctctgaagccctatctgaggttctgcttctgggtatccaaaccaaagacatctccgtcatagctgcaagagtcaagtaagagtctatacatggcagccctctgaaaactacaggaccaaagagtttttactggctcttgatgaagatcctgactgtaaaaatcccagctatgacttcttggtggaaggccagtgatgacagcagataaggcaacctggsagggcagggctgttgtcatgcatcccaaggatgtgaacccaggcttattccttcaccacccagaggtccagggtagtggcagacagtaaaaacggattgattttccatattgggagggcaagtattaaagtttcaaatcattcagaccttggaactgaacaaggtcacaaaaattcctgcctttgcttcaggtccaatgtgctataaaagtatcatagtgaactgcaactttcttaagtgatgccagtttcagcatattttcaaatccctaaatatttattttaagagggcatttcagaggtaagcttggggtatgtgtagaaagtgagaggaaaagagaaagagacagaaggatcgtgtccctgaggtctggaacgtttgcaatgtccccagttaatcattgatgccccagagcccagtgagccaccagagctggccctgctgcagggggcctgtatgcttgctaatggaatgccaggacgcctctggcgcagttaatgatttacctcctcctagttgcagtgcttggcactcccattctctgaagctgatagaagcctgggtagaccagccctgcctaatggagtgcaggagaagacaatgatggtttgcagattcactgtatgagcagagtcctgaggggccaccttctgtaggaaagggtttcacacgagaagaatactttaacagtgtaattgttgtctgatgttcccatgcatgaacgtttctgcctttagggccacaagatgacatgattttatatgggcgcatgacmtctgtcacctttaaacatgcataacatttatttgcatggctcttttatttccgctactagatttaaattccttgaggccctcaacaaattaatgaatgtgctatatacattcattatacagcacactaatataaaagaaatgcattttttaagtaaaattcttttttctgttttgcaaaggccaggtgtactattgcagaactctcagaaactaatagttaactaaaaagaaaggaggagactcacaatcctaaccacccagagacaacagctgttaacacaccattttatattacagtggctgtgagaccctgtgcatcccaatggatgcggtctccttcaacactgtcagcctaagttctggaacacttgttttggtgaggctacaatggcttcaggcattgttcmcatggcttttggggaatccactccagagtctcagcatttcctccaaagtactcaatctctgtcatgagtatagtttagattttgataggaaagggatatatttttgtttccagacattgtaaataagatggaccatattgatttggagttttattgttgtttctttttcactgaagcttgaccacaaattagtggggacagaaaggcagtcttgtgagattcacaaactggcactgaggggtgactatatggaataatcaaagagggattgttcactttgggagttttccctgttattcaaggcttccttccttaggaagaaatctgcatcctggttacagagactctggtctaagggtgggctaggggctgagcacctgggaagaawactgagcacagtccaaagacaacgaccggcgctttttagcatagctctttcctcgcttagtatgcttagggaagagactgtatttggatgcccaggcctgtgtgcacatgcgccaatatagcatcactctgtgaccttgcagggggtgtgagtaggattattgctacagatcagtgaagcctttctttgtaaatgcaatttgggggtcattcagtgaattttgattttgcttcatccgtatccattctctctttycttgaagtgaatacatggataaaactattgctaccactgttttgtaatgcaaacaactttgttctcaggaagctcctatgatgccttctactttccagtgctaaaatccccaattctgggtccttggctgtgcattagtgagccattctgaaccctaatcctccaaagatgagttaattctgaagagcctactgagtttcaagtgtttgaaggccctwgggggacttcctttctttaaaactcaaagtgaattcttttctttgaatttatctctgcattttcccctcttttgagagatgtyttctctctgactgggttgctatgaaactcagatgattgcaccactgtactccagcctgggcaacagagcaagactccatctcaaaaaaaaaaaaaaaaggaaactcagatgagccaagtacttagagaagtgctgaacccttagcactcagcaaatgtcagctgctaactacagttagagaaaggcaagtggtctagagcagcactaccccataggactgtcacaaggcctggatgtaattgtaacttttctagtagccacattaaaaagtagaaacaactgaaattaatctgaatacatttaattcaacatatcaaaaatactacttttcaacatctaatccatatttttaattattgagatattttgcccttttytgtattgtcttcgaaacccagtgtgtaatgcacacttacagtgcaactcagtctcactggccacattttgagtgctccatcgctacctgtggccagtggctaccgtgctgggcagtgyaggtcctgaaccttgctactcaaggtgagttccagggaccagcagcatcagtagcatctgtgagcttgtcccaactgcagaatctcaggccccagcccggacctgtagaagcaggatatgcattttaacaggatcaccaagtgatttattagcatgttggagtgagaagcactggtctagaatccccgtactcagtcctggccccctgggattctaatctaattggtctaaggtgggacctgggcactagtgtttttttaaagctcccctggatgattctaaaatgcagccgggcttgagagtcatttgcatagtggattctggacccaggatgcctgactttgccaccttctacctttgagaccttgggaaattgccaaaactctctgtaccttgatttccttatctgtaaaatgaggatgaaatgggggcgttatgaggattaaatgagttaacacatgtaaagcactccaaacaatacctgacacagagagagtactcatgaaatacaggctcttaccctttcttctttttcttgaaggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggtgagtcccaggaggcccgagtccaggagggagctgagctctcagttaccccaaggcctgcagctcctgccttagccctctcttgaaggatggaggaactgacaagagaaaacacaccccatccttgaaccccggaccttccaatctaatgggagagatgtggtccctgcgaacaagggaggcatcmaggagatgatgtttgtcaaactaggtatcacctgtctcctgcttgagccctcccatggcttcccctcacactgcagctgaaatcagactccttaggatggtcttacagagccccacccaatctggcccctccctagctctcagacccatcttctgccactctgcacctgttcagcccaccgtggtcacacccacctctggcccttctttgagcaaggctacagggccttcacccttgctgttccttctgtaaaagaagagcccttccctcagcctctcacctgacgctcctttcacatccttcaagtctgttctcagatgtctgctccttagaggccctttcccaaccatcccagccctatgactctccatcttctcaccccactcgaggtttttcttttaggacgtattaccatctcacattgcagtgtcttctccatcccccaccactaaatggaagatttaggaggagatggactttctctgctcattgccttatctccaacatctagaaagcttcctggcacatggtagatactgaaatatttgaggaatgaatgaacaatgtttttatcctcattaacatcatctttagcgtcattatgaaataatacatgctcattattaaaaattaygtaactcagaaaaatatgtaggaagtaaacacatcaatgtgttaacatattagttaaaagtaattgcaaaaaccacatgacttttgcaccaacctaatatttttgtctttttccccactctgtactttaaaaaattctgttaactttaaaacttctaggagaaacattggaccataagtaaaatattttttgctactagtgtgtccttctgccatgctgaagccactccactggaaagagtatctctagttcaggtccctggctgacacttaaagccttgatatcaggaaggacatggggtctgtcagcccctcagaagtaacacaaggttcccttgacccttcccggtctttctaagactggaagtttataaaccaaggctcagactcacttctcctctttcagaagactgtcctcccaatctggttttcaggggacactagatggagaattaaggtagtcagggaaggttccagaagggggcgaggtgcacctgggccaatggccgccctttgccctgttttccctgtctccccacaccacagaagggccaacaggctgtttcacagagtggagcatgcatagtttggatgctttccttaaattctttaacygagtgactcacttactctaatgacctttgagtgcttktggctggggcattccagatggaaagtggcccctgctcagaacctcrggatggacctcagctctgccatcctggtgctgtgctttcccctacatgaaccccctttcaatgcctgaactttgtgttgatgcctacaaataaaaattaccctgttccctcttctgagttctgtttagagctggggaaattgagaaagcactgagttatgagtttgtgccaatgagatgtgtgactctaaacctctgcacctgtctttctgcaggataaagggtttgactttggtggtctctacaacctggactagcccttgttttctatgatccacattaagggaagactggagtctgttaggaatacaggggaggcatataaaacctagataatatgaaaacgttttcttcaatccctactgttcaggaagtgagatctgatgtcatgaccaagcaggaaaatttttagtagctcatggtactcagggcaggggaaaggaaatcaggctgagggctgtagaggaaggagagcaggctaaggctctcaaccccacccctcccctttggttttcatttggggagactcaggccctcaaattaaaattaaaatacagttaattaaaataaaattaagacataaaatgtaagatactttctgtcttctaactctaggagatagagaacagcctaaaggatgcagctctttaaatgtgtgtgagtcctatgcacattctgcttctgcagcaagaccgattttaagctaatgtgtggtttggggccaccccacagacctaggcctgaaagagtccactctgggcccttctgccatggatgagttgctggctgtgccaggctagcccaaccctttacaaaggaaacctagcagcccaactgccttccctccagctctctgtgctatgcttcttacttggagtgagcagaggtccaggaattcagagtgtaattcatatgtggagttttgtaatcctttagtggtcaagtttaggaggcagtgttgtgcaatggaaagaaagtcaaatggtcttggattgaattttagctctactaatttctaactatggagaaattaaccttcctaagccttacttccttttctgtgacttggagttcatggctgccccacagtgtggtacaaggataagcacagctagtaggaagtagcacccagaaagtggtagcttcatcattgtttgaactggcattagcatccttagagctacttaaaaagggaaatctgcaagagagaaagattcctcatctgacgtttaatgtagtgatcaggcccaagaaacattcagaatcccccaagagaaccagtgccttaatgagggccatgcagttattcagggccttacatgatggaaatcagccttggtctgagcccctggaaggctatctgaagacagctctgacacttgcccacctccagaggtcaggtcatgaggcttggtgcagagcaaggaagagacgtggtacctgccctctgagaacttcctctcccgtggaggaccacagacctgtcctgtagagatttaatgtgagccacatatataatctttttttttttttttgaggctaggtcttgctctgttgctcagacgagagtgcagtggtgtaatcacagctcactgcagcctcgacctcctgggctcaagcgatcctcctacctcagcctcccaagtagctgggactataggcctgcaccactacactgagctaatttatgtatttgtatgtatgtatgtatgtatgtatgtatgtatgtadgttgtatgtatttttctgagacagggtcttgccgtgtcacccaggctggagtgctgtgacatgatcttggctcactgcaacctctgcctcctgggttcaaacaattcttctgcctcagcctcccaagtagctgggattacaggcgtgtgccatcacgcccggctaatttttgtacttttagtagagatggggcctcaccatgttggccaagctggtcttgaactcctgaccttgtgatccgcctacctcagcctcccagaatgctggggttacaggtgtgagccaccgtgcccggccttatgtatttatttttttaaagatggggtttcaccgtattgcccaggcttgtgtaatcttaagtttaccagtagccacattttaagatatcaggtaaaattcattttaataaaatacttatttaacctattatatccaaaatattaccatttcaatgtataagcgatataaaaattattaatgagatattttacattcttcaacatctgggatgtattttacacttacagcacacctcacttcagaccagctataatgctgagtgctcaatagccacaagtggctaacagctactcttttgaacagtgcagttctagaagctgccacctgaataggaataaacaaggtttacacagaacaaaaagagaaagccacatggatgaacaggtgttgatatggtttggatgtttgttccttccaagtctcatgttgaaacgtgatttccaaggttggaggtagggcctggtgggaggtgattagatcatggggatggatccctcatgaatggcttaataccatccccttggtgatgtgtgaattcttgctcagttagttcacatgagatctggttgtttaaaagagtctgggacctctcccttctctctctttctccctctcgtcatctgacatttctgctcctgcttcaccttcctccatgattgtaagcttcccgaggccctcaccargagcagatactggtgccatgcttcttgtacagcctgcagaaccacaagccaaataaacctcttttcyatgtaaattaccaagcctcaggtatttataacaatgcgagaacagactaacaggtggtgagtagtcctgggtcatcacacatccacacagtgagcatcggacatgaggtggagtgagtgcccaaacggtgggtgtgccccagccccagtggtctcagtctgagaaggcctttgacttttcaaggaccagagagtcacttcaggtaataaagggttaactttaaggacataagctcaggagcccagggaaagccaaactggcagcccccagaggagatccagacctcagatggatcacccaccttacaggattggttagtgcaaatgcatgtgcacagaaatcacctggcgaatctggttgaaatgcagatgctgattccataggtctggagcagagcctgggagtctgcatttccagccgccagttgatgccatgctgctggtccacagaccactcttggagtagcaaggagggatttaattacatgtgtgatatattccacctagtacagtgattctcaaacttgagcatgcatcagaatcacccggagggctgctgaaaacactgactgggctggagccgtctgcctggctctcccctcccagatggtccaagcacacctcctccctacccccagccacccctcagtgccgcagctcctgctatccacacccgcatgaaactactgcagtgcagaccgaggctctgactatgtgagagagagagggccagccagcaggtcacctagactgtgacagcagaagggagaatgaccccctgtcacaagatttaagggagaagagtagccctggtgaccactaaggcagctctggtggtgccactgacaccaggattctcgggccaccttgaattcgtaggaaatgctcctgtgccatcttttgttgccactgccgtttktcaggggcagatctcttagactccttttatcttcatgttgggttggattgatgacattatacatttttaggccgtgtctatttatactggctgagttttaaattactgtgttcctcctggatgtttgtcatggttcttcttttggttctttttgctcttatttctttyggactgtcttcctttatctaacttttctacccatctgaaggacctataattatatttcccatttatgttctttataaatgcttttcaacctctaaaactccccaatgacttcattttctaggggtatataccctatttttttaaaatctaggcagaatcttaaaatgctctgagtttttgtccttttctgtctcattaargttaacaatacaaatgtgatagaaagggaaattattctttttgccccaccagactctttgctgtaaaatagttgtgtgttcaagactgcctttgcagaagcagccttactcatttagtatacaaaagagttagctggaaagttacttggtcccattctgttcttgaaggatgacttccaaatttcctttagctggaatctcttccctcctttatcttcaccatccactttgcctttgcctctttttccctccaaaatacacacaggttgcccttgctggcctaacttagatttttgctactgatgctccctcctttttccatctcgtattcctccacctccttctcccatctccacccctggcctttggtagatttaggcttttcccagttgctgttagttctagcctcttcttcattcctcagattttagtaactttgtgctaggatataaagaacaataaagctcaaactcctagcctcaagcaatcctcctgcctcagcctcctgagaagctgtggctacaggcatgtaccaccatgcctggcttcacaattctttatacttgaacttatttgtctttaaattgtaaataaagccgggcatggtggctcacacctgtaatcccagcactttgggaggccaaagtgggcagatcacttgaggttaggacttcaagaccagcctgacaacatggtgaaacccgtctctactaaaaacataaaaattagccatatgtggtggtgggtgcctataatcccagctactcaggaggctgaggcaggagaatcacttgagtctgacatgaggaggttgcagtgagccaagattgcaccactgcactccaccctgggcgacagagtgagactccatctcaaaaatacgtaaaaaataaaaataaataaataaattataaataagtattttaaatgtttttcttctccactagaactgtaagctccatgaaggcaagacatgtctctttttatcagttactgaatccccagtgtaaggaacctagcacagggcctgagccatgataggtctggcctgtagaaagagctcagtaaatatttgttgactgcctctgtagctgcctttggtacttcatcccctgtactaagaaagggattccgttcctagtatatataagcactggtcagagcttcaacaagtagactaacatgtacaacaaaatctagaataatatctgagccttaaaagaaagagtgcttcaaagaggagaattttggcaaaaatgttattcacattgagcaatttcagtgacctttagttttgacttttttcattccttttttcttcaataccaagtttaatattcaaccagaaattctggttctaggcacttctccagaggttttcttaagccactggccctaaacagagacagtaccaccctctagggggcacttaggagattcatgggggcccttttggtttcccagtgattgggagtgttgctggatttagggggcaagcactaggggtacaggatgggcttcacagcaagaatcttttcccagttcctcacagtcctaccagaacagacaccacaaatatataaatcggtggttccttagtcttcaataatacaaaaaaaaagagcccagtaattgaagaaatggtcatcatttagagggaagattaaaaggaatgaagctatcctccaaaatttttgaaaaatttactctgcacaaattttctactaaatgaaatataacatttctatctatatataattacctcatataattgtatatatagatagtgctgttactacactattgctctgaaaatgtggatcagaggagacttaaaactcttaatattagaagcaaatagtattaagttaatggagatgcataaaatrtaggcatcttattgagttttattgccatctcacattttttaaaactttggggaacagtaataaatctatattgtaaaaaaattatgtatttccattattttttggagatgactgctgttttcatcctagcacatgtcttctctatagtctcttgttattatcactgttcctttgtcaaaaccattcactgaatgtgtatttcaaggtaaggtgagattttaccttgaagtcctgtgataaattttactgtgataattttcttactactcaaccccgtatcataaaacggagaattgttttaacaccacattaatacattaatcatctttctaaaaatgttctctacttcagtggtctgtaacttgtcttgctatgttatcttcttttaaagttattttcttctttcttttttatataatacatctttttatttgaatattctagtgtccactgtagacctgtgctctttcactttgctgtgctacttgtacagcatgatttttcatcattcacttttaaatctaaacatgcattaggagttaatgcaagaatctgccatttcattgtcatctaatgtgcctgagcacttatgtaaattgaaatggtcatgcttgaacagttgcatattgaaatccatatttttataattcactttcgctctatatcaccgtaatgctttagttaaggctttacatttattttctttttgaaattatcacatacgtgtatgtgtgattagaagggaattttgatcagggtcgcatggggatatcgttaatacgtgttataaaaagcggatatttgttctgatagagtggagaaccactattttaagtaatcctcaaaaaacactttgaagttggctacaagtagggtgactgctccccacttttcctggaacagtcctagctttctcctgctatcctggcatgattattaattgcatctctctcagtgttgagagtctctgtttggatgataaattatatcaccgcacatttttagaagcatttcggctcctttcaattttgatcacattattcactttttgagcagtatgttctgacccgattcagtctttctgtatcacctgacaaacagagctaggtctaccttatcccttccaccactgaactttccaatcctaagacctgccagcattctcttttacttgtctttgaaaaatctaagatcaaataccgtcagtgtcttggcctctcctttttctcagcaacttgcttctgtcctcaccagttctcttaactcattcttctattttttgcatttctactttaatcccctttccacttatttttctacataaccttactgttctgccagattttcatacttttacaaaattaattttgccttatctaacaatttgcaacttcaaatttttcctataaatagaccctgttagtaattttagcctaaattctttttgtcttgatgtgaactctctgttaactcatattaaaataagcatccatcaattccatttttagctgactgctttatgtgatatgttttcatcataccctcttaccctgacatagaagtatctctccccagcattcttttgctattctttgggaaagtgccatgtttttgcttttatttattttttaaggaagaaaggaatttaagccttttggattargatatttagctcccaagactttttaaaatgctcagtctaattttttttattgtggtaaaatatacatacctaacataaaatttaccattttaaccattttaaagtgtacaattgtcattaagtacattcacagtgttgtgcagccatcactgctatctcattccaggacttgtttattaccccaaatggaaaccccatacctattgagcattaattccccatcccctcctcccccagctcctggcaactactaaccaccatctttctctatggatttgcctctcctggacatttcatatgaacggaatcctatcatacatggccttttgggtctgagctccttcacttaatgcactttttcaatgtccatccatgttgtaccacgtgttagtacttcattccttttacagctgaataatacttcattgtatggatgcaccacattttctttatccattcatcagttaatcagtctaatttttataaaatctttattcccagatgaaatgagtgatacagtagtgtgggtagtacaatggatggtacacggatattttgtgatgaaatgttagagactggataatgctgttgtatggagcgtgtttagaaggccctatccatcctctatttggatgccagattttactttcttcctccctgcccctttttttgcaactagattatgtttttcatgttttatttcttctttaccattgtatttataggttttagaaaatacagctgaataaaattactcagagtaccacaacccccaaaataatcagtattaataacatgataccttttcttgtcattttcctgtctttgggtattttagttttacctaattatgatcacattaaataggtaattttgtatgctgcacaaaatgtatttaacaaatatttaaatacctacaatgtgctgggatttgttccggatacatctgatgagtgaataagaagttctagtggggatatgggttgggtctttagcatatagatgatatttaaagctatgggactaagacctcctgggagaaattagatggagctggggagaggcccaggactcagccctagggtgccccagcatgcaaaggttgagcagagaaggaggttgagagaagatgaataacctggtaaaagcaggaaagtctagaagagaaagtgctttgaaggggagtgggaccttgtgtcagatactactgagcatctgagtgagatggagacagagtgtcaaccattgggtttgacaagattgtggctgggatggagcccagtggagcggagaggatcatagcccatttggagtgtgctgaggaacgaatgagataatatcctaacatgtacctgcacgtttcagatattcttaaacataatttaatggcagaataagatgtctaattgtacattttacctgactacttattttcttcctactgagtgacatttatgttgcttctaactttcactattacaaataagataaaagtgaatagctgtgtaaactttctcttctaactttagcrtcgtttcctttgaatggagtcacagaaacggaggtgctgkcccaagagcagagcatctttaaagcttatgatttttcctcactcaagtattyccaggaggactggacagttggctctgcctccagcagcatctgagggcccagcatcttgactgtcagttgggtcctttcaaaacaagtctctccttttatcaatttagaagttcttttacttttgaatagagaatggaatgacaaaaaccaaaacactttcaggaatgaaaactagacacagctcactaagtaatgttaaacagaaatgcctgtatcgtaatcaccaattatatggagccacagcttaaatgtgatgccagtgtttgttattaatcccttttcactaaagttctggtggaatcttaaaccgggtgtggctgatgaaaatagccatgatttttctcctccacacctatgttcttacacagtcatataaatgtgatcagagtcaaagttaaggaagtttactcttttgcagtaaactccctgcaaattccccacagcaactgtctgctgatatcagaggatgactctaccctccctgggatagggttttataaacatccccagcttgcggcaaaagaagaacaactttcagggtgatcatcatctcaaaaawgacctcttcctcccaccccacccctcaaaataaaactcccactactttagagttatttcatggtgacattgtgaattgtccctcccagctgcaggagctggatgaaaggagctaaccccagctgccttgctggctttgctatttaatggcctcctgcctagcacggcaacagctcacccaggatcagcagcgcccagtaggatagcgcctactatggcctcatcatctcacctaggaccgactggcagtgcccagcatagcagcgccttgcccaggactggcagtgtctagcatagcagcgccttgcccaggactggcagtgtccagcatagcagcgccttgcccaggactggcagtgtccagcatagcagcaccttgcccaggactggcagtgttcagtgtggcagcactgcagattctgcaggagctgctggctccgctgtagctcatctgcagtgacctgtcctgctctctttcagcttgctgctacttgccaggccttaagtggaagaatggagtgttgattgtgtcagtcaagagtaggtgtggtaagagataggcatgggcctttccctccctccctttaactgagaaaatgttctggagaggtcctgaatcacccccaaataatccccaaaatggaaggtagagcgtactaccctaacaactcagcagggtggttgagagttttagaatctggcagacctgggtgaatttctgcactgttactgactttgtgaccttgtatggatgacttctctgaatcttatttctctcatctgtttaaaaaataggataatgtagtatcagcttcataaaattattgcaagaaattcacatgataatgtatgtaaacacctaccatagtatccatagtgacacagcccatgctcagtcaagattaatgatcaccatcactatcccacccacccctgctgttgaatctttttactttcattgctccaasttggtggctcagacctgactcatcaactctttttcttgcaggaagttttgcgaagcagcttggtcagcctgttgtttccaaaaccttagggtaagtcctggatgttcaagacagagtaagggttggattgctttcctgctgacttgagcaggataggtctggggagtaagtcttggctctcctaggttataataacyaaagggcgggagcctagtacaatgagatgtgtcatttacacagcacctcctgacctggctgcctctgtgattggctcctttgactggcccagctgctaaatgtaaggaagtgggagaggtggccagagtctgcagtggactctaacaatcaaggcaatagtcagaagattgaaataagcaagcctagaagaggcgggtaacagtagctgctgtaacagacaagcctcaaatcacagtggctcaacccagggaaagtttgtttcttactcagggaaagttcagttcagatatcctggaacatggggagagccttccacattatcttccaggagcccaggcttcttccattttatagtttcatctcctaggcccttgagcccccactgggccttctgcatctcaccagcagagtggacgagagactgcagagcctcayaggaggttcttatgagtcggccctggaagtggcatacagctcttctgctcatggtctcctggctaaaacccaggctttcagccagggctcagtggaattcaggcatgcctaactgcaaggaaggctagtaaatgaagtctagctgcatgcccaagaggtagaggaaataggttttggtgccacacatttttctagagagagcatgagaaagtttctgaggcataaaattgggaaggctacactttgatggcttctgaccttaacttagtgcctttgagtgaggtggagagaggatggttgaattgctgccttgtctgggactggattctctgccaatttccttacagggatagattttcagctycagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaaggtgaggtttctgtctgccctgaccctgatccatcctgtattagtctgttctcatgctgctaatagacatacccgagactgggtaatttatgaaggaaagaggtttaatggactcaccgttccacatggctggggaggcctcacaatcatgacagaaggtgaatgaggagccaagtcatgccttatatggcggcaggcaagagagcatgtgcaggggaactcctctttataaaaccatcagatcacatgagacttattcactgtcatgagaatagcatgagaaaacccaccctatgattcagttacctcccactgggtccctcccacaacacgtgggaattatgggagctacatttcaagatgagatttgggtggggacacagccaaaccatatcatagccctagggaccctgaaaattcagggttagacccttcaactagtaggagtctttccattctgttcctcctgtttcaggcggttctcaggggttctctgtatgtttgttagggatgcatgttcctgtccctattacaactctccctctgttactcagaccacagtgttctgacaattctcacactcacaaaatagcagaaaacttctgagtcaagacaagcctgacaatctcaagagtggactgtgaagttagggttctaggtgttaagccacagctccctggtttataaagcctgtgaagctggataagtcatttgacttcttggaatcctggtttccttatcggtgagatagaaataataccacctacctcaaaatattgtcaggagcctccatgtagaagggatttataaatcattcagggctgggggaagtgaagcttaagggggagaggtgggcgggcagggaggcagtggcatggggttggggatggctgttaaacagggcagtgaggatcctaggggaacaggtagagtcatggccaggggaataggtttttcagagttggaatgcctgggtaaaagtgggtattgacaccttttacctgcttcctaattctcttgaactcccctaggaaaagaataaaaggaatggggaggtaaggaaaaactgaagtgaggaatatgggatttcctacctcaaactcaggctcctttgaaacagttttcaggcaactgctctaagcaggacagagcaccacaccacatccacagacctcaagtcagggcccctgaactgtttaaagttggctctctgagcacattgacagggcccacagcagaggacgctgctgcccaggccctggagtctatcccactaggattggcaggaggcaggaggacacagccagaaggtragcagatttgtwtgaccaagttaccccattgccatccacagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtatcgaccagtggacggctagtgcagaacgatccctgcctggtgccgcaccctcctagaggagctgcttgttcactgcgcacctgtgtgtgtatacacctggcccactcacayacccaggcactccccaggggcaggtctttttttttttttttctcttcagacagagtcttgctctgtcgcccatgctggagtgcagtgacatgacctcagctcactgcaacctccgccacccaggttcaagcgattctcctgcctcagcctcctgagtggctgggactacaggcacacaccaccacgcccggctgatttttgtattttttgtagagacagggttttaccatgttggccaggctgacctcaagtgatctgcctgccttggcctcccaaagtgctgggattacaggtgtgagccaccacgcccggccacaaggggcaggtctttgacaagaagaaagggtgaacagggcagcgcagacctggccacgagggaagatgccctgtgcttggctgccaccttcccttgtgttcccatagtctcccccaccatgtcttcagtcctttcttctcacccggactcccttttgtatctgtggttgccaactggaagaatgaatgttgctaacgtcttgccatcaccccaaatttaacctgcccagaatttactgatartttactctgtctttcaagtcaggcgatccttcgacttgaccccctctaccagggttcccatgttccttcacacccagactggactttccagcatccttttgacccctgcctctttctccttgagtcgtcagccctgtcagttcttccttgtaagtcttgttgaacacgtctcctccttacagttctttggttcctcaagtccgggctgaggagggagtgcagggatggggaaggggctgcatgtcactttactggagcaggaactcgggggtcaggaagggaagtggctttcagtccttcctccttctttgtccctctcttttcttctgatttttctgttctgcatctccttcttcttagaaacgattcatctttgctcttgttactttttttggcctgggtatttttcacaatctacagaaagaaatatatttcacagtacattgcaacccagaacatgtatacataggtaaacaagtttcaggaaaccatcctgaccgtactgtgtacagtgcatgctggtattctctatttcacttgacatcactaaaacaagaaatcctggtcctgaccggaggacctgacttggtggctcactgctgaataaggagatgccaccagacacccagagcaatgtgtgcctgccctgacattcagttaaatactattccctcctgatggacttcatgacaaaatatgttgcctgatatttgttttaaaatactcaaaaacaaataaacgaaagaaaacaaaaatggatatataagactggcaaaatgtggtatctccttaatcgtggtgatggctttcagggtttgttatctctttctactattgtatatttttaagtttaccatgataaaatttgagaaagaatatagcaggaaaaatatgtattttatgttttttctttgaagaactggataacattaaaagtatgcttttctgtacactgctaagttacagcatttgggtttggaattttcagtagatgtttgtttgtccctggattggttttttttccttctgtttagtgaacagaaacagattccatgccctcagggtatggtagcaccagccactattaagaagcccaaaggacagaacctgaagctttgacaatgtactctagggctggggggagttcaaaggccaaagacgttcagcaccagggaagctggaargagccagcagggtgggaccacggtgatgaggaagtgcctggggagggaaattttggtgtatacagcattctactaacagtctttccacccttccccctttttccaggtttggacagtgccaataggtatgtctaggctttgtgacttttacgttttccctcttgaaatgccctgcamggatgttaccgagaaatgccctgaatttctgaatcatcttatggggcagaagaattggccatttggaggatgttgttttattttgggtgttttgtcttgttctcctattgtaatatgacacacgggttctatctcaggttgctgtcagtattgagactggaaaactcagtgttgccacctttcacagtatctacacagtctcttctctggttagcatcctgaggaagaacactgctctgagaaggccgccttcctcattccagggcggaatctgttcactcatccagcccagacccagcaggagcctctttcctgtgtgtgaggctcggcgctagatgctggatgtgcaggggtgggcgtagaggagggcttaaaccacacgaacgcacattaccaactgggatgggtctgtgaggaaggacaacaggaaggcactgattagaatagaggggcagggaagccattttgggaacttggtatttgagctcagacctgtgcaaaggaatgttagctggtgaagaaaagctcagggagtgtgctccaaacagcagggatagcatgtacaagctgtgaaccaagagatgggcccatggggacccagaaggacgccagtgtggccgcagcctggtgaatggcaggccaatgtctgtacgatcaggagctggcattcctgtgggccctcttgtggggctcagtttcattcttaaagtagtggaaaagctgttggaaaatccttgggcttgaaatgacataatttgattaatgtttttaaaagatcgactatggtcgctgtatagaaaatagattagagagggcagagtggacacgggacaccggtggcagaggttgaactacggaggcactagtagagaagggaactgtagggaaagcagggctctgggcagggttgtgggacaggcaagtgtcgggaatggctgcttgtgctgtggcttgggaaactgggcaaactgcagagaaagatgctcttacttgcccttaacttgtgggcttttgtgatccctggaatccgtgcttgtgatgagtaatatttgtgagtaaccagatgatcattctattctcccctctcctcacccaccctacccccaccctcaccaccacacaggtcatttgygagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagacyccggtccttcagaagacttccagctccatcaccctgcaggccgcaagagttcagccggaaccaagagcaccaggcctgggggtcctatcaccttctggagaagagaggaagaggccagctcctcccsgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaaggtgagtagaggtaattagggtcaccrattgccaaaatgtagccccttggtggccactcccttccttcagcacccagctagtctgcatcacctatatccactcatcttcttggactagctcccctagaaaaccaccttacaagggccttccccttaggagtgactcattgtagaaatgccctttattctggagagacccctaacagtagcctgttgtttgctcttggatagagtactggccctggccctagttcttaccaccctagaagaaacaccctcattatcgccaacatcgaaaagcaaacctcatggtctcctccgccctttcttccccttgcctggctttggccaacctggagaccttgcccatcacgctgtattcatcctcctcaaggcccctgactctctcaagaggtttcgtcttgtggagtgtggttgagggtgaggaagcagactcagaggtgggagggcagctccacaccaaactgagccctttcctccagctcacaccttccccacctacctcacaatcacagggtgctctccagggcatagggagctcacgttctttacctggccctgtagtttccgggattccaaagyctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccaggtgtcctgtagctggaccctccaagtggaaagtgagtacacttctcyaggtcaccccgcattctctgtgggacaaccattcatggggtgcttcaccttctgcagatggttcatctcctatagccccctgccttggtgcacagcccgacagaaatgtcacccccaatcacatgccaaggccaagtgtgttgctctaggccagtgattcataatcaggagttcacatcagaatcacctcaaaataaacatgcatggccccacacccagcccaactgacagctacctttcctaggtccctcagctgtttgaatagtgccgtgactcacgtttgtaaccacagagaactgagtgttcattaaatatacaggtttagagtaatgtgagatgatgtgggatcccacatcttttatgtttattgtactgtctgtttataaaagtaatgcatgttcattgtggggaatttaaacaatatataaccttatgactcagaaataaattatattttaatgttttttatacaaacttaccattgtggtatttgtatactgctttctatcctaatttgctcatgtgatattaacatctttttatacaattcttggaaagcatgacttttagtagccatataatattgcatgaaatggctgtatctaatttaggtatgctgttatttgttgaataattaaattgtttccatttttcactattataacatacctatgataaatattcttgtacctgtctatctctataaaatttcccccttactctaaatgcatatgtaagccccaggcccatgccatacccttgagaaatgcattaacaaataccacaagagtagaatctgcaaattgcaggctgctggaaactgtggaacaaataactttcacccattttttttccacatacaaattgcaagcaaaaaaaaaaaaaaagacaacctatagaaaacttatattagaaggtatatagtaacatcaacaattacaataatttttgataatcttctgccaatcctgactgagataatctttaaaaagtttttatgggaacatcaagagaatttggacactgataagatttaatataaaggaattcgtggtgttttaagatgtgatggtggtcttgttacttttttttttttataagttcatctgtttgagagatatatcctgagttatttactggtgaaatgatatggctttttatatttgacttagaaataattcatgtttggggagcactggcagggatatcaatgaaataatattgatataaatgaaagttgagagatgggtacataggaattcactacactgctttgtctacttttgtgtgtgtttgaaaattttcaaaatgcacatttccaaaagaaaaaaagasttagtgatgtatccatatagtagaatgccagacaacatcctgtagactgatgctaaaacatgttcaagatgcactaggaagggagaggagcaaagtacaggctcatgtgtaaatggaagaaaagatctgtgtacacacatgcaaaagatgcctgtgtgtgcacaaatcatttctggaagagcacaaaagtccctctaggaaggggaaactaggggttcacaggaaggaatggggcatcttacttttcactgtatactgttgattcactgggattttaactgttgtttaactgggatttttactatcctcgtgaattcctttacaagaaatattatccatgccatttgcaggtgggagtgctggtaggcagagttcacaggtctaggagatcaagcctcatcatccaggccaggtctctatccctgcgcaggggacagaaatatggtgtcaggtccaccacagattaatggcgtatccagagggcctagattctcctgtggcttcttctgctgtgaattcatctaagtctcacagaagactatttttagcctgttcgcgtcatggggtaatacatctcaggttgattccctatcttgttgtgttttgtgtgacagctttattgagatataattcacataacataaaaagcacccttttaaagtacacaattcagtggtttttaatatattcacagagttgtgtggccatcaccatcatctgatttcagaacattttcactacccctcccaaaaaaatcctacccattagctgtcactccctgttctcccatccccacaacccctgatagccactaatatactttttgtctctatgggttttcctcttctgaacatttgatgttaaatggaatcattcaatatgtggccttttgtgtctggcttctttctcttagcttaatgttttcagggttcatctgtgttgtagcaggtgttagtacttcattcatccatgtggctgaatcatattgcattgtatgggtatagcatacagtgttttgtttatccacgcatcacttaaggtccatgtggttgtttctactttttagctatggtgaaaagtgttgctatgcacatttatgtatgagttgttttcaatacctgttttcaattttgatgtttagaccacatatattgttgggtcataaggtaattctggatttaaccctctgaggaactaacaaactgtttttcaccattttacattcttctagcaatgtacaagtgttgcagtttttccacattctcaccaatacttgttattttcttgcttgcttgcttggtttcttgctttttttaaaaaatgaggtcttgctttgccaatggggctagagtgcagtggcatgataatagctcactgtaaccttgaactcctgggctcaagcaatcctcctgcctcgcctcctgagtaggtgggactaaaggtgcttgccaccacactcggctaattttttttattatttgtagagatggaggtctcactatgttgcccaggctggtctcaaacccctagacttgagtgatcctcccacttcaacctcccaaagcactgggattataagcatgagccactgcactcagcctgttttctattttttcattatagccattcacaatcatctgactatgattttttttttttttttgaaacagggtctcactctgttgcccaggctggagtgcagtggcgtgataatagctcattgctgcctcaacatcccagcctcaagtgatccttcccacctcagcctcctgggtagctgggaccacaggcatatgccactatacccagctaattttgtttatttttgtagataaaaggtcttactatgttgcccaggctggacttgaactccttgctcaaacagtcctcccactttagcctcctaaagtgctgggtttacaggcatgagctgccacacccagcctgactgcaattttgatttgcatttctctgatgactagtgattttgagcatcatttcatatacttattggacatttgtatatctccttcagagaaatgcctattcaaatactttacccatgttttaattgcatcatttacttttttattgttgagttgcaagagttctttatgtattctggatacaagtcatttaccagacatgatttacaataatcctctcccattctgtaaaggctggattatttgtcatgtgcggccacagaagtccctgcttagttagtttagtgatcacctaattgattggatggagagttccttaaatgccttgaactaatacttttcccagcctttgccaaggggctctgtgtgtgtgttacgcccatcttcagtgctccggccagcagtttacagctctgctttagcctttactttctgcttgcaccaaagctccaagtcagccagaggtgagacaggagggccttcttacatctttcctgggcaggctcacagccctgcacawccatttgggctcctcagttctcaggaatctgtcagagcttttcaaagtcctggacatctcattccccagtttttcctttgaagttttttggtcaggctcttgttagctccgaatgatattgctgtctcaagtagctataaygttaaacaattgctactgattgattttaacaaacatcctggagacagggccatccacacagagtaaactttgagtcggattaaacaaagacaacccggaaaatggagtcgttgaaggagctgccagacagggcaaatagtgaccattctcttacrcatggggtttttcaggagctctgaacccatcctgccccttgctaagtggctgattttcacaagtaccataggtactgtcggttttcagagttaccccagagctggggcaaggggcacaagagtgaaaaagcacatagcttgctgttcttaccaagattcagctatgttttattgttgttgttgttgttgttgttgttgtttgttgtttgggagggtggaggggcagggtattgttgtttggggttttttgttgttgtttattgtttttactttttagagacagagtctcgctctgtcacccagactggagtgcaatggcgtgatcatagcttgctacagcctcaaactcttgggctcaagcaatcctcctgcctcagcctactaagtgagactacaggcacatgccatcatgcctggctaatattttaattttattttttttggtagagacaagagtcttgctatgtttcccaggctggtttcaaacttctggctcaagcagtccttctgccttggcctaccaaagtgctgagattaaagacttgagccaccactcctggatgtttgtttgtttttattgaatgctcctcagaatgttgcaagcctgtggttaatttctggcattctgaaaccgttgcttttgactctttttgccagtattgttgttgcttttatggaggagtagatcttcagaggtctttactttgccattccacatcctatcttcttgatgaagacactcgcttttctaaaacttctccagttcctaaacatcctagctaattcttggcagatgagtttaccatgaagcaggtcatctgatgggtgttcttttagctcctcctacatacttctctctttctgttttcctatactacagaatacctgtctgtttcccttcccaagacttctctttctgtcccttcccatcttcacaaggatctgatctaacaatgatttactctctcaccacttcttcaatctttccccttcccttattgagagacctcttttttctccctacaagcatgctgtagttgtccctatgctgaaaaaggaaagaaaatcttccttccacttgagagcccctgcagctcctactctatccctccactctctttcatccctagactatatttgcctcaagtagagtctctatgcacagcttctacttgataataacagctaacactcactgaggatgtgctatgctgggttttgtgctaaatgctctacctgaattgtttcatttagttatcccaacaatcttacaagaaaatcatacccatttcctagataagaatactgatctttagtaaggttaaatgacttgtccaagttcacatgccttgtaaaagagagcatatttctaacccaaactgacctggcatgaaagcctatatccttttttgataactcccaaaggcatttctctaatgagggagttcaacactggccaaggggagggatggagagggtgcctccccacaccttctgggtggtctgtctgaccctccctcagtgccaggcctgtccaggtacaccatcactctgtcttgtcgctgccctcccatcgcctatcctcccctaggatctggaggagaaagtgcagctgtacagtcagagctggctgtaaaacttggcttcagcatcgagttcaactatgggaaattagtaaccttgtctgtaaaatgaactcaagagaacaacctcataacattgtcgtaatcacatctggaaaagtacctggcacatagtaggccctcacatcttattagctttcttgcccataaacccctgcagtataatatgacatttcttctcatttctgtattgaataggctctcttgaaaagcaccagtgatatatcttctaagcaccaaatccagttccaccttttctcagctatcagccaccttgacacatgtacagcatgttctggttgtcatagaagagattatccctattgctyttaattaagktccccaaactagaaaatgtcccctaattcactgatgtagaaggcttttggaaagttcagctcagcagttctcaaccagaatgtgcattcaaaccacacaagggcatcattactgcatattcccaggtccccggcagctctgagcccttgacctagaatggggtkcaagctgtgcttagaaaactggagcacatgtgagtcctatgattcagttctggaattggaaaaaaatcattgtaataatttaaaattgaaatgtcctcacctgtgagcctgtggcttatacaagtaaagagatactcacaagattgtgtaatcactgatgggacatattaaagaagataagagacactagaaaatagagtaggaccaacaagcaggaaggagctctccagaggctcgagggcagcaaaagccaaggcaaagcaggaggcacctgagtcacagaggagagaaggcaggcccaggttctaagcaccccagggctagggtgttttgtgactgtgaaaaagcccctgcgggtgactctgcttcaggctscatgtccctacatcactggtgctgcctgtttcttaagcrtgaagagagagaagccaaaggcaggctgccgagggtacccaggtgtccaggacagtgaggcgtgcctgggaggctggrgtgactgcaggcatcaccagagtgggcaagctgtgatctgagctgacctgtccttttccctcacagggcttgccgtgatggaggtggccccctccttctccagtgtcctgaaggactgcgctgttattgagggccaggattttgtgctgcagtgctccgtacgggggaccccagtgccccggatcacttggctgctgaatggtgagwtccccctgccccagctctctgctcccatcccctgggccctttggcgctgcctgaattctcacttatccctctgagccatttatgccttggacatcctggtggtatgagaaggaagcacagggcacaaagagagcacgggcactgggatcctgctcccgactggctgagcaagttactactcctgtctgagccttgagttctccatctacatggcaggaatcatgctgcctatgtgcagggtggtggttgtgaaattaaattagattatttctataaagtggttaatgagatgcctgacacataggggcatgagcagttggatttcttttcttatggccaaactcatagtaggccctcaattaatatttattgagtcaataaatgaacaaataaatgaataaactaatgaaccactctcaaagtcgcatgagggatcttaccttttatttagtggcaggtggttctgggactcacagaccagttattctttttaaactgatagtcctatagagactcgccaactcttttttttgtcaagtaaggtcctttaaaaaattatttgccgtatattatcacccttttctttttaaaggaccatttaatttcaacagtgtgggagaactctgactttagaagactgagaactgtccattaaactgataagatggagcagggactactgtggggatccccagggagggtgaaagagcccctgctgagagtcaggagacacaggcacttgtccttctccaccactgagtggtcgggtgaccttggacacttcacccctcggggtaccagcttctttatctatgagaagatagggtggaaaagaaggtttgggatctcagctcactctcatacctaatagaatacactccttaagacagcagtgggccaggtgyggtggctcatgcctgtaatccgcactttgggaggctgaggtgggtggatcacctgaggtcaggagttcgagaccagcctggccaacatgatgagacccccatctctactaaaaatacaaaacttagccgaacatggtgccaggtgcctgtaatcccagctactccggaggctaggcaggagaatcgcttgaacccagaagccagaggttgcagtgagccgagattgcgccattgcactccagcctgggtgacaagagcaaaactccaataaataaataaataaatgaaagagcgagcaagcgagcgagcagtggtccccaacacttatgcaccaaatagtccccatttgtgtctgcrtcattgatgtattgcctgtgaaccttccttgttggtgtagtttgctcaggctttgctagaagctgtctttagtgagtaagaggaagtgccatctagtcttcctacatgtagtgttcttgggtaggtaagtgagaattgaggtctgccttccctcccagcccttagcaaaggacagaagtcctattggatccagtgattgacttcaaggaggcagcctccttgtggctggaatgcaatatgggcgttaaggactaataacggagtctagactaagtatcaacaaacattttctataaagggccaggtagtagctattttcagcttttcaggccatacagcctctttaacaactctcaactctgctgttgtggtataaaagcagccataggaggctgggcgcagtggcccactcctgtaatcccagcactctgggaggccaaggcaggtggattgcctgagctcaggagttcaagaccagcctggccaacacagtgaacctgtctctacaaaaaaaaaaaaaaaaaaaaaargcaaaacttagccaggcttagcaaaacttagccactgcactccaacctgggtaataagagtgagaccctgtctcaaaaagtaaaagaatagacaatacataagccatagacaataagtgaaagaacgagtgtggctatgttgcagtaaaactttatgaatactgaaatgtgagtttcacataatttttacatatcatgagatatattacctttatatttttcggccatttaaaatatgtaaaaactattcttagcttgcaggcgctacaaaaacaagctgcaattagcattctgcccaggagccatagcttgctgtctcctagtttatacatcactcaagacggtgttttctcagcgactcttagcgtttccacacccattccactagagggcgatcatgctcaagttgggtttccttggctgctaactttagtttaacccagcctccgagctgggagagcctaatgtctcccaattctgatgtgccctgagccaacagctcctttctggggcctccatcccatcccatgtttgtggggccacagtgagttacgttccagttaaaggagagctctcaaaaggcttgtcagcacatgtttggacagaagagacacattggcggcagtcagggaatacactggtattgtcaaggaagagaggtttggagggtaccattgtgacaaaaagtaaaaacaaagagcagtgctcacttctctcagtggcaggatccaggcccctgcctttcccagccctcggccccacttttatgaaatgcaataggttgagaggaatcttcccctctagtcctatgatgtgcttgctggtctctttgccaaactgtcatggagacatgaagtgttgctatgtgcagaagaaaacactgcattgcagggagacgacttctttctgtactgtctcccttccccactggccgaccccaattttatgaagtgcaaaccaggaccctggggcctggcaagggaagaaactgacagttgcttcctatatggcagctggacacattcctgctccgaggacagactcttcagtaatgagattttttttttcctggaaatgaaaagtcacatcccagaatgataaactcccaggaacatagagcattaaggaaaccactgaagctcattgcatgcactcctgtctccatgcaggactttatgttacctggaacatgtcacatgtaagggactctggaaaaaaggagccgagtcatttttagttccctatatttatcttttctgtgaaccctaaaatacacctaattgcatagaagaaaygcacctaactgcaacagtgggtgggggatgcagaattgctttttgataaatatctacagtggaaaattgaatcgttgtttctggagacatctaagtggagctgggcaccccatgttcagcctgggaaagctccgttttgcctgaggctgggctatgggccagatgaccgtgtaaaagtctctccaggctcagaattctgtgaagttgaggatgtggatttggagactgtttaacacagaatgcccaaaactctgtccctttccctcctgcatttttaattcctccagattctccctcccccatccctctaggccccgtcttcctcctccaccacacaattactccctttccttcatctccttagcccctggctctttctccagcccataagcctctgtccagctggctggagatgtgcatggtacatcattagccctcartggatctgacaagcatgacaagtctcagcgtcatgacagcagcagccctgctgaggacagggctyccrtccctactgccagtgctgcctggcctgagccttcctgtgcttcctccacagggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatggtaggagyctctgggcacctgggtagaagcacctttcctgcaggcacttctgctttggaggaagggcacatttgtagaaaatggtatcatgagctcaaatccagggagcagaggtgcacatggcactactccacaccactggcagcggcaggtgccgtgacagaggagtggctgctgcaacctcttagggacagaggagagggtccttaaaaagtgctgcacctgcaggtaggaagtgagggagatgacctccaggagttcacagcsacaagggwgtcatcagaggtggccttttcctcaccccctcwctccactggggccatggaaaggtatgggggaaagagatagggctcccttagctccagaagctccaggtctggtcagaagaaaacctcgcacactacaaaaggacttgggagagcactcacgtattccctgancagtcagtggcctcccagtgaccccttacatgctgggggaccctgggtcacaghgtgcacactgaggcttccagagggtcacaggttgtcccctttctgcccccnttctactcacgggcccaggcttgtttttacacatcagcagcctggtctccagtaatctgattatcatggtcatccattcatcagccaagcacttagtccccgggaactgcagggagcctcagactcaagacagatctgtctgggctgtggtatcagcaggcctggtgacagttcccgyggaagtgcttcttgggtccagggctttcaggtaagcctgatcccaccatcaccctgagcctatgcccccggctcctgtgcrtgactgggtcctctggtgctagcactgagtgcagcgtgactggtctcccatcagacaagcaggaggatacatctctccattccccggggctcaggcctgtcaggaacatctccgtgttgtatgagtagccactgtctgggaggctgcaggaggaagtttcgcagaaaaggaaaggggaagaaacatttgtggcttactgtgttaaatactttcacctcacccgtattctctcactgagacctcagtagcctaggggacaaggatgctgtcctgatttcagacagaaggctctggaagtctcgggaattgaatgtaacttgcctaagcgcatcacgttagtctgcaaagctgcaccctggagcccacagcctgtgactttcaagtctgtgctcattcctatgccctgacctttttcagaggacacatcccctggctcaaaggggaagactggccactgtgggctgggcagtgtcagtcccttagggatgaaggaactggcactgatggagaatgtgactgacgctggctctgtgaagctctctgccgggagtgagcacgagaaactggtccaccccttccttccaggaaacccaccacactgggttcagagcccagctctggcctctgggaatttgcagccagattctggtttacaaacttactcatttatcctcatagttctaacttcatgactccctgggagccaggtggggagctcaggaaattgtgataatgagatttcagaggaaacctgaactgctgagaaccttgtctctgaggtccaggaagcaggactcacctgggggctcttcttggaggccagcgtggccaaccccagagtcragtaaggggcagcaagagtcagaatgctacacgtagagccgccgtggctcagccctctgttttctgatactccctccacagccacagccaaggactaatccaatgtctgtcctggcttgcctgtgtttagattggattagagtgacccagctgagctaagagtcccctggaggtgggagtcccaggcaaaggatcaagaattctttagggccatcctcctgactcccgggcctgtgggggctgggacctgaaggatcaccacccatccaaaggaaaacaaaaagcacagagaggtcccaggcaaaaactctgccaaggaagtttggatttgctcggagaagaggcctgcatgasagaaccccctcccagtgtgggggatgtactgggctataaagaccagacaggctcagataccataaatggtgaacaaggctgaagacgcagccgcacgctcaggcccggcagcatttgggctcttggcayaggattggagcagggtgagcctggcacagcgacaccccctggcayggtgccctgagacactcrggaggctcggggctgctccctgcrctgtcctcyrctgtggagtttttctgacttgattggcagccccgttggctctggrtcctygggrsaagcctgggctgggrgagatgatcacagtggaggtgtttgttccctactgcactgatggctgcttcacccctcccttagctgtccaggtccagccctctcttgcccttagtgtggcaccaggccayggtggggagcatggatgtggagccagcggcctgggtgtgagtcctgctctgccacttactagccctgcaccctggcrttttagcattccagacctcagcttcctcttgtgtgaaatggagatgctgacagtcgcggtactgtgaggattaagtgaatgaatgtgcaaagtatccccagagcataggatagcacacaccctccataggtatgtgctgtgattatgattgtccagcagagcccacctttaaacaagatacaatccttacaaatgccaagactgaggaggggttttcccaaaggatccactttgctacagtattgtgtgtttgtttggccatcagagaatcagaggagggaggtgtccagccagacacaagcsatgaacacwcgygcctgcttccaagggctctggccacaargtggcrccatgcagcaacgcgtgtccctccagttgtcttctctcrggggtggttgaggggcagctctgctgcaagcaagcttattctgagagctcagcagatacygtgccaaaggccagatgcaggggctctttctcacctctcgccttttgccgakattttgcratcatcgagattgctggtgcagccctcaraygcgatttctgcagccagcccttcatgctttctctgcctyccctcctyagtgactctcttcttctccaaatcctggaaactcccacaaatrtcactttctctgggaagcctaccctaatcaccccagaatgcgttccctgaacaccgtgtgcttctagtattacacttacttatcaacaagtctttactgcgcgcctatattgatcagtgccaggcattgttctggggaaactgcagtagacaggacagctgagggccctgcctgcagggtgcttacgttctgatgaggatgccagcagcartcagcacctggcctcatttcaaatgctggcacgtgctgttaagaacatgagcaggtcacaaaggaataattataaagagaaaaagccagtgagtggggtgtgtgaatcgaggagggtgagagggtgtatctttagtgctgkgaggaagcctcagaggtgtccatggcctggggaaagagagctctaggtgggcagcacagcaagtgcaaggccctgagtcaggagcaaggttgacccattcgaggagtagcaagacagcagcctctgtggctgcagcaaagtagacggggcagtgtgatagaaagtgagttcagaatgcgggggctcaccattccaggcctctggaggagaggagaaaacaatttactccgtgaaaattcactttcattttactctacttgcttaattatcttcctctccacactgtaagctccctgcagggagggatcacgtcatactgtgtgtagagccaggcctgccatgggagcatgcattccctgaatggatgagagcacagaggttgccgaacctcccctgcagtgcagggaggcattccctagaattcctcgcttttctgggggctcagtgcccattagggtgtgcaggaaatctgcaaattaccttcaagagtccctcaacagggctaggcacagtgtctcatgcctgtaatcccagcactttgggaggycaaggcaggtggatctcttgagccgaggagttcgagaccaccttgggcaacacggcaacacaccgtctccacaaaaaacacaaaaattagccgggagtggtggcccatgcctctagtcccagctactcaggaggctgaggcagraggattgcttgagcctgcgaggtcgagactgcagttgcagtgagccgtaatcacaccactggacttcagcctggatgacagagcaagaccctgtctcaaaaaaaaaaaaaaaaaaagagtccctcaacaaatattccttctttccccaacacaggctagggaaaaaaaattccccaatagttaaccaagcaatgaatgtctttcctcctgacccaggatgagtcctgatccaggatgattaattcaaattcctgcagagcccaggaatatctgaaatacagtatatatttcacagcgtttggactgagtcattgctgggggcttccttgggctagaatatttaaaatttttttccccctggagtatctccatcaaggctaaaattcttaagtgtctagatttattaatagcctgccagttgtgcccatttgacatagtttctcagcctaacggtttgtttatttaactgaaggcctagtgggcctgtttaaggcatctaaggacataaaatgtgggtargttaaaaagatgaaaagatcatctctagaatagataataaaatataacaagcatatttattagagtatttgttttgatgcagagcttctaatgaagacaacaggcatcagtgaagtcagcgtttgcttggcaatgagtagaggcacagtttgttttcagattaataccagrcactctgcggggcagcctggagccacctcctttgtcttccctggttatgcacaggtactttggacactatacaatctatccagttaacataacgtatggatcctgacctcctcaagcttaaaaacactgacaacttcttaaatacttacattggctacagaaaaatatattgaagaagaataaataccagttttaacttgccttttttatatatattaagaagcttagtttattcaaaacatctgtccacaagcctttaaactgtaagaaggcaagcaattaattacatgttaaaatttataaccaatattttcattttatgtaggttgagtacagaattgggtttgtgtaccacatgggttctttgtgttacagaaagacttctgagcatatacrtgtacgtttgtgcccatgccatagaatttgagcctcattttactaatagggccattatagagctttataactctccacctctacagcccatagtcagtcataattacatagagacccagatcaagaatgctatccagaatcgcagsattgagctcctagtggcaaaatgtgacccatgtgatgacagtgtaactgagagtgtggcttccaggcccgcactgggagggaacagtgggtggtttggatgccatacctttatgtttagagtgtgattatagcttctaagacagtggaaaggctgtggtttcagtgatccttgcttcccagctagcaaccctatcattactggtcagagatcttttttgggatattatacgtcattgttcctttcattcttttcctcgcacacttctcttcccatttgcttcttaagttctgggaggaagggaggccaaaagaaaacaaggctatgggaggaaaaatccttttaatgccacaaagtagccattttgctgacttcaagaaggttctgtttggttaggagacagacttttgtttaaggggaattcagatgccccggggatttacagcttgcacaaaccccctggaaatgggaaggggctgtgtggcgtgtcagcagggagaatgtaactcttctttgatgaatcctccagagttaacaatcctggaatttagggaaaggaggaggctggtggtgatccctggaccatgctggattttgaactccaaataaagaaagatgggggcactgtgcttccatggtgccccctcaattggtgatctgttgaatttccatagtataacagggtttggagtgaatcagaattgctgttggaatggcattttgcattgtaataactaaggaatacagctcatgttcaaagcctaaggaaaatatttggtagatccaagattaaggcaaacatgyrttgaatgcaaatttggatccaggaccttggggcttcagaaagtagcaagttgaccagcaaatgttggcaggtagaaaaacacacttataaggagaaattcagaatttagttgtttttcctactaaaacaacggaaagaaaaggaagggctgtgaagggaagacaggagaattattgtagtgcagaaggagatggcagatcctggtcagccaccaggacaaaggcaacagtgggttcctagtgtcaggtcctagaggaggtaaaggcctcactcctggtgctgggtttgaagaagaggctttactggttattttataagaagaattagtgcaagaggtagcaaactgctcctaactcttcctctaaataaaagctttccaaaacgccatgttgggtatcaatttatattaggtttttaaagtaaaaccactatcaatttgtttttaagaaggaattgtttgataggaaagtctaattggctagaaaagctggcttgttttatttaattctcacaacaactccacttgacacttccgaattcactttacagatgaagaaagtgatgctcaggaggtgatgtcagctgcccacagtagtccaggtgatcagcagcagcaccaggccaccacctgcttcagcccatgggctttctgcatggctgctcttggatcctgataggtcatttgtttgatgcttttgcttcaccagagcgatcatttcatgtttagtttcatgactaggaactggcttcaaaaacaacttctagtgagtcaaaaacagccaaaatggcaaggacggaaaaactccatgggtcagtagaatcataaaggggagagtgcgtatatctgtctgtctctcattctctcccccttcctttgcttcccttttccccctctctcttcytcacattgcctctttttctttctcttctctctgttcttccctttctccattcttgctctttcttaagtcctattaacagcttcgtctacatggcatcgtttttacttgtcagcartctgcttgggcttattcktagtcattgtgcttgtctttcccattggacgacagcccgatcaatccttttccattctgtcaaaatgggacagtggcagtttaatgactgagtccaggagtgaattggctaataccaagtaacagagcaacagataaatgcactttagatccttaatcctaggcaaggaaagcaaggagactcagccctttctgcactccagaaagaaggccctctctgggctcagtctcagcagagcagcaggaagcacagctgtggggaaacccggggtatatttagtttggccccatttgagcygggcaagtctgtcactgggtcycagcaaagcatcccttgctatttgtgtgccatggccagtgggtgtcctcccaagacgaagaagtcttgggctctctgagacaaccttgtcactgggggcctcttgcctcagaccctggtccttaaaccaggatgatgctagaaggaggccaaggacaagcagagaggagtgactcccagggtaatgggtagctctggacatgaatatggatgatgacagaaagctcctcacagaattgagacctgcctctgctcccaggacagtcaagggaaagcacccagaccaggaccccaccagcagcatctccctcctcatggggcatcgcagccccaggaccttaggacaggygagcttctttctctgagtctcagctccctccactgtaaaacagacacaatctgcccaatacttccgagatgttgagggtaacactgaattagctatgaacatcttttggaatcctggagcgctgggctttataaggaatcatcgttacatgaaagttctggtttggggggtttttctcattggagttattatcaggttgaatttccacaaccaaaggagttagttgggttgggaaagtcagaaaacattgatttttatactgcttgtgtgccatgtattgttctagctgttttatatgttactttctaatcatctaaaaccctgcaatattaccatgcattagactgatgatgcagacatcatacttctcagtattatgttgccataagtttggaggagagaacaccgaggcttgctttgggaaggttgcttcagatcacacagccagggccacgagttaagaatgccagtttccatctgtcctttcgtattttacttaagtccacagaagagtgagcagaaactgatagaggctagaggccagagatgagccggaataatttgtttggctttggaatgaattgcaatacacacacacacacacacacacacacacacacacacattgtgttgctcttttcacctggcttgtctctgttctgctttagtttttctcrgttgtcaaggatctaggatgtgggtcagctgacagtgtgtttgtcctggagcggtcaccatgggcaccgttggaggagactggttccctttgaagggacgcctaygtaacatcccggccttgtcatcagaaggcctgggcatgagctctgggtctgcccacactggccccatgatgttagccaagtcacttcccgttagttaagtctctcctggtctctacaccagtacagtggaatggtgagttgggactgggtcccaccttgccggtctgagaacaggctcgttctgaacattcactcccaatcatttccatcttcccttctttcttgctgtagggctttggggaacaaaacacaggaccgggggcaatgagtgacaccgaactaaatgtctgccgatcggccggtttcccccaagttcactcactcatctcctggagggggtgcaatgaaagcttgtcctcaatttactttgagatatatcccatgatatttttaagcaacgcatttgtattcctaatagtatttgcctcaggtcctataaaaatgagtccataatccttgggtgaagcccagactccattggttctttgactgctgataaacccattgagtaattgagcccaagtggatagatgtgagtcagttctcatgctaggctcrtacaaatgttctcattgataatgaatggttgtacaaagtwtttttacctattatctctttaaaactacccaaagtcctgtgatgataccacgactccccstagagaccgatgaggaagtggggcttcagacggaggcagacttgcctgaggccaggatcccctccacagctgcaggtggaaccagtgagctgccaggtgggaggcagctcccaggccaccctttcatgcatacttctgagctcccaggggagggagaggcagataggcttttagtccccaatggctgagacccacagggtgacttggctttgccaaacccccaggaaacaggggctgtgggaagaacccagagaaggtggggttgaagaggagactgccacaggcttaaaggggagtgcgctggagttggtgacgttcccgtagcatctaggaatttgagcccatctgcatgaagctctgtaaggctggggactcgctgagattgcagagaggcaggaacagggaatgctatagaaagacaaaaacattttgtccttgagccttctcagtctgtgcaagacaggaaattcctcaactctcccgaggcagccagctctcctgactgctgcagcctagtgagagaaacgagatagatcaatgcatttccaatcctgtgcccccaagcccactcccagagcttctgccaaggcccctggcggccctccrtcgaaggctgcggtgctgagtcagcagcaccagagagcagcaggggcctgagagccccatcttccaaggggaccgtggggggttacctgctctcacactcaggctccatgcccttcaactgcacctgctttgggggaagttttcctccagcctcctggaccttcccagcctctccccatccaggttcccagaggctgggctaggagagttctacagtaggcctgctttcattttcagtggcagtggataaaaattcggtggcaactttggaggtgacacctgcccagatacattacataccctggaaacctccccatggctccacttcctgaagaaggtctagtatttgtggtcctgtgttgagaagaacccaaaatgcctgtggccctttccccagaaacttagggtttaagttagagatatcctaaccctccctttctcaacagttgaacctgccaaaaacaaaaacaaaaattgctaaaatggcattactgaaagtcaagctgcctggctcacagaaccaagggagakaccagaggctgggcagccatggcttgtcctgcaccaggattgttccctgtgagacgtggatggcagggccagccactctgcagtcccctccccttcagctcctgtgaggcagggattctaagcatgaggaaaggctgttcacccacctccacaagaaactgaatgtgagtgaggcgccaggcctctcaccctcctccttgacttgccgayacactccctgtctcagagaaattgattttttctcccagtttttattgaggtattattgatgtacaataaactatggagacttaaggtgttcagtttgataagttttgacatatgcacacacatgaaacctttgccatgatttttaaaagtgaaattctcattgtccccaaatgtttcctcatgcccctttataatccaaccccccgtcccctgccccacaccactactgacctgctttctgtcactggactttgcattttctagaattttatataaatggagtcatccaacatgcactctctctttggcatcttcctttttttttttgagacagaatcttgctctgtctcccaggctggagtgcagtggtgtgatcatggcttactgcagcctcaacctcccaggctcaagtgatcctcccacctcagcctcccaagtagctgggactacagcttggtgtctttcattcaacataattattgtgagattcatccctgttgcggtaccctcagtagttcattcttttgtgttgctgagtaatattccattgtgtggatatatcacaatttgttttactcayctgttaatggacatttgggtcatttctagtttgcagctattgtgaatgaagctgctctgaatgtttgtgtacaagactttgtatggatatgtgcttgcgtttctctcagggacatacccaggagtagcatgactagatcctaagggaagtatatgtttaactttttaagaaactgccaaaatgttttcagaaggttctgtaccacctgccatgtatgagagatgcaagtttttccacatccttgtcaagaccaattcctgggatgtgatgtctttttatttttagccattctaatgagtgtagtgtctttggcttttgtgaggtgcttaaaacctcctaggatgggaatggagcaccatataattatcgaaaatgacaaagaagctcttcagttctgtcttatgagagacaccaagatgtattgttaaagggatgccaagcattttgtgtaacgtgctttcatttacttttttaagaagaaaataaatgcctgtttgcttctrtatgttacacacgtagatcatttctggcaagatgaacaagaaactgaaaactcgttgcctctgaggagagatcactggtggctgggggatggggtgggagggagacttgccatactctttggtaccttttgaattttgtgccatgtgagtgtatcatttatctgaaaaataaataaaatattttttaaaactcacaaacttataagaactcattgttcattcctggctatcaggcaagaacatcgtcattgccaagcagagaaatgggaggcatcttgttcctaatgatctctagaaactccaaacactctttatctgttagctgccagtttctggtgggaactgagcatcaacacagtcatgtaccaagtggtcatttagtctgtgtttgttgaatgaatgcatgaatgttcaccccacgttctgttttctaccacacagaaaagaagagtagcaggaagagtgagtaccttctgcctgtggctcccagcaagcccactgcacccatcttcctgcagggcctctctgatctcaaagtcatggatggaagccaggtcactatgactgtccaagtgtcaggtctgtctctgcagctctctcttggggattaacatgaaaatggtcttggttgcaatgggtattgctctccgaggacccgctcagatccttgatccaccagaaaatcagatgggaccatcaggtgatggacccaaagaaatggagactcttgtcctctcttttctgccttctctgggtaggattttctggattcatgattaaatggtccagaggaagaagatggccatagagctagagcagtgaaagattaatttgaaaatatagtgtggccagtgtagctggaaggttttgaagactggtacaaaaccagattatgggccgggcacggtggctcacgcctgtaatcccagcactttgtgaggccgaggcagcagatcacaaggtcaggagatcgagaccatcctggctaacacggtgaaaccctgtctctactaaaaaatacaaaaaattagctgggtgtggtggccggtgcctgtagtcccagctactcgggaggctgaggcaggagaatggcgtgaacctgggaggtggagcttgcagtgagccgagatcgcaccactgcactgcagcctgggcgacagagcaaagactctgtctcaaaaaaaaaaaaaaaaaaaaaaattatgtgagaacttcccaaatctcagaagatgttctcagttgcactattcaaattttaaggtcctcccaacaaacccatgaggtagatcctgtttgaattcctattttactgatggggaagtgaaagcatagagagttgttggagtgtttcatccaatatcactgcattcagcgcagagttgctgcatggccggggaggacctccctaaccaatcccccttcccctcctcctggttcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaaggtgaggctgacccactcagagcgagtgggaaggagatgctgctgcagcccctccaaaagtgatttggaggcaaggaaaccacatgaggctactttgttcccactgagggccctctcgtccctcagtcccaccccagccccagaggccagctccctgtccaacatcacaagctctgactgagtggggctgcctttcccagctttctgaagtccctgccctctctgggttactggtgccaaggtgcatagagtactaagagggaaatctgtaatacacttaacaatttggcagcgatagattttgaggtgagttataggcttaacagggtccttgccattagataacatatttaagaggagaggcaagttaagcacacataaagtgagtgacaactcttaatcacacrcattggatacagatcattagcacctggctcggtgccccgtgccttctgggctacctccccttacattggatatacagtcatgttaatattatcctctgagaatgtatccgagatggatgtgcaatgagaagggtgtgctgcatttgtgtatccaatcacagtgatttctggacaatctgttacttgggtgacatgctatcttcccatccttcacctccatggagaattgagtggacactgcctgctgagggacatccctgtttagctctgccctttgccaatttccagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagtgagtctgcatgtccagccagcctcccttaacccttccctccaaattcctagctcccctaacctgggtctgggcagccagaagaagcacaaactgatgtggggcttggacttccaggtaaagcaagtgcgggctcagtgctgctcacaagcttttgcttcttccacttcagtatagcaaatgttcattagaactttcccttttgagctcagttccccagaatcctgtcttgttacatccttgttcccccattatgtggtgtatggtgagtatgaaggaaggaggaatggatcaaagttggaaaagcagggggatagggggaatgcatttgttatctgttgctgtgtaacaaattaccctgaaacttagcagcttgaaacatttatcrtctcccagctgggaatttggaagcagcttagctggatgattttgaagtttcagtcaagatgtcrgcaggggctgcagtytctgaaggcctgackgacactgsaggatcygcttccaaggctcactcccgtgactgtggcaggaggcctcagctcctcactggttgtaggtgggargcctyggctcctcactggctgttggtgggaggactcagctccttgcsttgtggacctctccgtggggctgcttgagtgtcttttwtagcatggcagctggcttccccagagctagtgatcraagagggagcccaggtcrgagcttgcagtgtcttttaagacctacccttggaagccacacgccatcacttccgactttgttagaagtgagtcactaagtacagcccgtactcaaggggaggtaaattcagttccacctcttggagagaagaatttgcagacattttaaaactaccacagggaggytacctttccccattacttttttctctccttttcaagggcttgctaggttacatgggaaggtcagctccatgaggcacactgctacatttccatgaggcacactgctacatttccatgaggcacactgctacatttccatgaggcacactgctacatttccaggcctggaacagtggagagcccatagtcgacattgggtagctatttattagatgaatgtgattcagaaatgctcttttaccttgaaaatgccctgtctcttaaaatcctatgccagccctggattgatggagacagaatgccttctgtgggtcctggggttggtgtaagcatcgaagaagagcatttgtttgcacctaacctacaaataggaggtcgtgccacatcctgaggatggttagacctgtcctggcccgggtgcctgaccactttgcaaggggctttctcgcctgtactttatcatctccccatgctgagcccatcatgttcacagctctgagctacaaataagctctagagctaaatgccaaggctactgcaaaacccaatatgtaccccatccccttaggtcctttgtgaccatgtgctttatacctgaatcagttatcttttgctgcataacgaaccaccccaatacttaataactattaaaaatagctcgtttatttttaaagcagtttcattatttcttaggagtctttgggtctcctataaagttctgctgatttaggcaaggctaatctcagctgagctcaatgacatgtctgttgtggtcaagtgatgggatgcttgtgagctgctggtccccctactattattagcggtacactcagaatgcatcaactgcctttgcattatgcttgaactagttattaccaggaaggccactctgcctccaaaatggggagaaggtacacgcttaccccctaggtcagtacaaagaatggaaaccgatgatgtgtaaaaatacctgctgatgatctcgtcagtatagaaggagtagcactttgagataatacttacattactcaagccagacatcctagaggagatgagcttgtttggggattttgatggaaaaggaaggctgartcttggcaaatgtgataaggcttagctgttgagtaggccgagcaagaaagggtggggtgggggcagagccaagcaaagggctgtgggaagtttgccaggccagagaggaggcgtgcaccaggaggtcggcaggcagactgtctggggccagctggggacagtcataaaatttagactgtcccagcaggaaggggcttcagaagttatccagcctcatcgtcatttaataacgggggacactgaggtctcagggtcgtggacttgcttgtggccatccaaaggcaagtaacagagcccaagttcaagccctcatcttttgacttaaatcagatgctcttccattccttatggctctgcttggggagtttctcccaagtgcacagggaactggaaggacctgggaaaccacactggagcctccagcctgcagcctttgcctctttttcttccccaaagtccagcctcttcattcctttcggaggccactgccctggccttggctttttccccacctgagaagaagcaagtcagtggagagtttcctgagggtacgtggcaggcctgccagagacctcactcctccagcaacctagacgtagagcagggtgcctttcgaggggaatgactggatggctgggaggaagccgggggtccggtgtgcagggggtagaggggtgggcagatcctgcctgtccctgctaggattgtgaggcaggtatgggtgggtagtttctgcctctcttcccttcctagctcttgtctactgtaccaaaaggggaaatgacaaaaagtcagctcaaaattccagctggaatacttgaaacacttgacacttgccaggaaattagttcttttttatttattttttattttttgacagaatctcactctgtcgcccaggctggagtgcagtggcacgatcttggctcactgcaagctccacctcccgggttcacgccattctcctgcctcagcctcctgagtagctgggactacaggtgcctaccaccacgcccggctaattttttttttttttttttttttgkatttttagtagagacggggtttcactgtgttagccaggatggtctcaatctcctgacctcatgattcgcccacctcagcctcccaaagtgctgggattacaggtgtgagccaccatgcccggccgaaattagttctttaaagtaatttttccatatagaacccatccaagaggtagatgattcagggtgggacaggatccaaggctttgtaaccagagtggaactcttattcagagcttagtaagccaaggcaaaaggactctttgtgaaaggttcagtttataggatgatagccccatatgctctgtggcagctcctgggatggggcctcatcttcagccccggccctgattttgtaactggttatgtgcagatgtcaaagatggccccaagaccctgttccagcagcttaggtgatctgacatgtgggtcccaggcaggaggccactatgaactttataggctrcaaatgaacccatggtttgctttaaaggcccagcagagatttaagggtatggctgtaggaatagttactgctattgccctgccaccaggtgatccacttaatgcgtcagcctttgtatcccaagtcctccacctttctctgaccccttagactgctgggkgccacagggtaaggcctggggctggattggacaggagcccttgagaggcttgtctgagtctgtgctccccaccttgagcacaggtcatggaaagtgacagaagcccttacctgcttcccccatggggagaatcggcttactccagcttgsggcacagggctgtccaccaccaaagcctcagaggagtccagctggggtaaagccgccatctgggcagtgtctgctcctgatgtttgcatctgggctgtgttctactggtgacaggaggaaactctgctgaggagatgctgaaagggctgccaggcaaacacagcccttgggcatctcatcttcctgctccatgtcaacccaggcaccacaaggctgtgcttaaaggtaggaaaagagtggcctgacactggccagcagcctggcagaagcagggtgacctcacacagttattctacaagctcacccaaagtccataagcctttttaagtgttgagaactcggggmacrctgaggacctcttcgttctcccagggcctggcacccatgaggtttctaattgctgtttgttgagcaaaggaacaacctgaactcaaaattctccagacttgagactccctgcaccttgaatctgtgccctctgacagtctgagcattgaggagggtggctgggaggggacaggctatgggatacatggccagggaggagagaggagtgaaagagctaaggcagtcaggaaggcacctgcaccagcacagcctgggacagcacgagggcactggagagaaggacaaaggagaggagcccagcaggcgggaggagggctggaggayagcaacgattggcttctccttgcttcaaatgggtgccagcacccaagggtgagcagcgccccagagcccctgagaatcctgggccaggccrtgggctaccagtgtctgtccactgggagggaggccaggcagagtgaggtggagacccacacacgccagcagaatacacaagaacgcatgctcagatgcctgtccaggtggatgtaactcatatgtgcacatattcccaaacacagacctccaggtgcaggtgcctgccagctagaccagtatatgtgtacatcatgtgtatggttgataactacatatgtgcatgaacacacacatgtcccagaccagatttgtactgataagcacagtagggtagagtgcaaaggtcatagggtcacaggtcccaacccctccctccactagcaagctctgtgtgtttaggcaaattacttaaccttgaccttcagtattatattttttaatagaggtaaggtcttgctatgttgcccaagctggtgtcaaacgtgcgagctcaagcaatcctcccacttcagcctcccaaagtgctgggattacaggcatgaaccactgygcctggactactttacctttataagcctcatatttcttaccttataaaaacagtggtgactctaatctcacagagctgttctaagattaaatgagatggctcatgtaaagaatctgtcacagagcttggcacatctgctattgggtctgagtgctagtgagacggccacatccaggggcatgagtgggagcactgttgtcagagaccctgagggtcccaccccagagccccctttccttatctttaaattgggcatggcagtactctatacctctctggcatgctgtggatatcaagaaagaactgcgtgtgggtgtcatgaaagctggagggtgctgtatgaaatgcagttgttacaaccatcactagtcacctctggctcgcagacctgcccccaccccttcccctagcctgagcagaaccttcttgtctggtcagagctcagaaatgccagcaggtggcagccttatggggttggagggacaatctgctgcaaatccactgcactgtagccagacagggtacagcccctcccctgagcagagggcctgagcctctgtgcaccagcaggagactgaccaggtttatggacaygaagaatccagagccctccccacctgaaggaagaagagaaagggccactcatgtaggaaaacacttgttgggtttttaacacaaaaagttctgatctgagagcattatcaatgagtgggggttaagggtgcttccattccygagcaagagagggaaaggaactacttctgtgttaagggatcatggagtcagagtcaaggtcactgggcaggcccaccaccagggcctatctgtctagaccaasctgctacatcacagttcccagcagggttagcctttctccttccccttttattggttgagtgagtgagtgattgattgaatgattatattatatacttacagaaaagtgttcctayttctggatgcctgccttagctgttgtccagacattctttttttcttcttctttttaaataagagctgagaaaataaagggtgaccacacagtgagagggtcctgccctaaatctaaggctggggtgaatgtctcagtcaagccggcgacttccatcttccccgctggccagcagcctgtgatcaagtccacactgaacaggccctttgcccagagggcctcttgatctttattgatctttggaattcttcaggaaccgggttggcgaatgcagttgccaggtgtcactgatgctacagaacagctctgccagagcccttccacggtgagtgcccccaggagctgcccctccaggccatgcccccatccccaccttcctcctggccccggcagctccagcccagcagccctagattgtttgtgtcctgcagctgaggctgccaaagccagaagggagagcctggaaggggaatgagggagggagagcaggggaaggagggggtgattttttttttttttttttttttgcacacacccttataaggctactgaagtcattaccgatgtaataaaccaactaagcaagcgagcgcctctcaccaatgttcccatctataaacacagcctggccggcctcccccatcccctcccgctcccctctaccctcccaccctcagggatttgctctcccctgaagtttctttcttacccagccccttttcctcctgctactttcctttttccctacactggttgcagggggagggagcctgccagctgcgaggacctctgtggtggaggagttggtgctgatggtggtggtagtgacygctatgggtccctgaggcctggctggccagcaagagggcagggttggcyagaggaggaagacggcgaggacgtgcgaggggtgctgaagaggcgcrtggagacgaggcagcacactgaggaggcgatccgccagcaggaggtggagcagctggacttccgmgacctcctgggsaagaaggtgagtacaaagaccctatcggaagacgamctgaaggagatcccrgccgagcagatggatttccgygccaacctgcagcggcaartgaagccaaagactgtgtctgaggaagagaggaaggtgcacagcccccarcaggtcgattttcgctcygtcctrgccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaayggaaagaccctcaagaccaccaagttcatcatcctctcccaggaaggtaaatgascatgggggttggggaagaaggggcctctgtaccagggccactcctagctcatggagcgttggtctcgctgacccctgttagcagcccataggtaggctgctaacctggtttagcaggtaggagggcctgctgggtaggagggccgcgtccctgtttcctgctaactcaaggataggtcccggctcaggggccttgggtacatgcaccaaggctggggctaagggctgggatcctggtccttgtggcacatgcccacatctcggcacccatctggcagagccctctcatggcaccgccacctgtggctccccagaggagacctgagcctgagttaattccaagctccggcatggagagggctctgtctacaggcttggaggtgggggacacagaggctggagccagggagaagctctgagtaaagagctgtttagagaagcatcttaggtttggggaacggtgtgcagtgaccagatggcacggagctctgagttggggtcaacaataacttcagtcttgatagcactgtgggtttgaagggatctgtcgggaaacccaaaatcccaaaacagcccctacagcacacactcacgggcagacagagctactcgcttcytaatttggatgagacttttgtttgctggtatttcacattcttggatggtggggagaggaggggggccccaaatccttccatctgtgtggacttttggggtctggagttttcagaggagccagtttatacttggagaagagatgggggtgacacaggagtattttctctggaccctcaatttggtttgaagtgcttttgtaaatcccaagtctgggtgggagctctgaggccggccgacctccacaccccattctggcagccagcggagggataggttgccagcacagaacagagtcctgcctgagctgatgctggtggctccagacagggtagggtacaaagaagctcccaggaagtgacatttcacccttgaggggcagagggcagccacagaagaagccggagtggacaggtcctgtcaaatctgagtcagctgaggtgtcagagtgctcttcctgtgggctgctcccctccctggcccctggcagcaccctccccactccctccctcaccttttatcgtgcctgccttcccctcacaagcagaatggagcatttgaagatcacagaatccctctcagcccccggtaagggtctgtcttccctctacatctgggacagcacacctggagcagctgagtatattgaatctcagygctgaaagagtgaaggggacactggctggcagagagaaacatgttattttctgctaatgtgttgacgcagtaacttttccatgtggatgtcctcagattggcagggtcctccagaagtcgtctcctccatcccccacctctgctggctcagcccccctcccctgaggcatgggggattattgggctggggtgagacttcagaggagcagacgccacaacctgtcctgccgcccctgtggggctctcccacttggaaagtccttggtaaaactgattggaaaccctgactgggaacatttcccaggtcaccctacggtgatctctccaggcaggatgcagggtggcatccaccatcctcaggacaaggttggggctgtcccctggctctctgatctcttttcattatctgtggtccctgcatggcctctcttgcagttcgcatcattcttaatatctttcttgagttcttctttgctagtggatttcaggttctcatcaggcttggcgctgcccatgggcttcagggtctcagcaggtttggcgttgggaggtctgtggctgctccagcctcagggaaactgaggttaagtcagttgggggcagctgttcttgggcttgcatggggtttaaacccagagccatcaacagccacttacaaacaattcactcaactaagcgatgtaaggcagaccccaggcctggtctcagaaactcttctgagccattagccactgtcttctcgtgccctgagtgcctgcagtatgttttccctgctggtcccttagtggtaaagagcctagagatcctagccactccagcctcccttcccatggaaaccgtcccagagggaacagttcagatccagagcagcagcagaagaaatgatccaaggaaggctgcacacgaaggggagagagagaccaggagaggtggaaagggattccagagagagccccaaatcaaactgtaagacatcttctaaatatttttaaattgtgtttaaagaatagctgacatatgttgaacactatgtgttagacactatcttaggcctcttacacttttcacccatttaatcctcccaacaatgactgtactgtccacctaacagagaagttaagtaccttgccaaatgcaaggtgctgggggtaacagagctgggatttgaactcaggtggctgagttcccgtgcctagaccaccgtgctatatgacctcttagttaattcctattattttatcagggtactggtggcagctgagaatttgtctatcaacagaaaacactaatgactatttactcctcgattttgttaagagttgtccaaaggttgaaacactgatggtgcccctagccttgccaggtttctggtattttccctgcagtggtggaagcagaccttgcaatgggcctgtcttgcttcagtacaggagagtgcgttgtctcaaaaaatcggccccaccttctgtcccttcactcgccaagacttcaagagcccagtgttttgttaaggaaaaaacttatcttaaggcttcatctatcagtcaccatttaagcaggtccctcctcaggcagtagggcattctgagaggtggagggagtcttttctcaatagatgtggaaggagaagacacactcacagtgataaaattgttacagccaagtgctgacaagtgctatgagtgtgtcgggaggagctgctggaagtgggaagagagggagctgagtgctggactttgatctaagccccgaagacaggccagaggggacgggcttccaggcgggggccccgcagcagcagaggcrtcctgctaacagcttgttctgggctggagaggatgacatggccccagtttcatcctatattctgccaaggaattccagtctaaaggcagtagggaatcatgcaagattttgggatgaagaacactgtacatgaagctcagtttaggggttttggtggactctgtgcccaaaagacaaatacagagcctactgaagaggtcgagaggaagatggtgaggcctagactagcgtagtagccacaaccacagtcagggaatgaccagttcragaagcaaggatagaagtaatggcacctgttgcctggcttggaagggcaggatgggggtgggggtaggtaaagaagatgaaggaatggaagaccactaagtgtgggtgcctgagtggctggggtctcagtggtcgtgtcagtgggaataaggaagccggtggttggaggaggcttctaggggaaggtgagggaatggctccgctggcctcccgtcctgcatccttcacactcagctcagcactggccctgcccccggcttcctgacttggagccctttttgctccactgcactgatccccaccctgtcagctctgctacaaacaagattcacttcctccaggatgccttcctgttgtcacccacctttggccacgagagactcttgcactgtcccctccccatcaacctgtgtatctgcgtgcaccaactgctagtggacgtgctgtttataggtttcaggggacttctctgatgtctgtagcttagatagggctcatagcccacagacccccacccaaacaggattacatcaccccatttagttcaccccctttcgtgctgaggaaagcagaagaggtttgacagccatgggctagagttcaccactagttgatttgtggcaggacacagacacgtggaggtgtccttcctcttcctgtacccctagagctgcagggctgatgggattcagagttaccaccaactgggcctgccctctgcccccaagtcttttcctagcccttccgggacctgcctctgctgaggggtggtgggaggccgatggtcccgtgagctgaggggagctctgtggtggcctgagaagagctttatctttatgctttgtttcctgtctccaggccaggctcctcctcctggcaaaacacttttccgagtctaacaatgaggattcatttttgttgctgttgtgaataggtaattcatttttaattgccttcagggtagaattttgcaaaggctttttaaaaacccatgtaagttcatcctacgaaaaatkgatttatgcagcatctactatgagcaaggcattattctaatgccctttgttgtgtgcataatccactcraagaactctgaattttcttttttcagaaactatatattatctttttcaatagtaagttatatttaactgtttgtgaccttttcttacatagatcctaccagatcacctgctwcagaaatatgccttcatccttctcagaatgacaaatatgttttactgtgactgcattccaggcttaggaaaaacagtggtgttagacagggtcactgccctctgagagctggtgtgggagacaggcatgcaggtcagcaatggccttgtgagccgtgctttgacatgggtgagctcagagttgggagcacagaagaggtccgcctaggcctgggggattagggggaacaaggaggacaccatgcctgcaggggtgacctggagatgagtcttactgtctgggcttgccaggtgggctgggtaggctgactgaggcagccctatagcagagcctccaggaagctccctccctccatccacatccccttcctcccctctgcccccaactcagaaaaggagagagctgggggagcttcagacccaggagcgcttactccaccacagccctgaggggctctcccaggcggagctctgcagtgatgctgacctctcccatccccctcatctccctctcagaattccccaccaggctgaggcttctcaaaaaaaaacctctgggaaacagcttttcttctrgaggtcaagaatgaactgtcccacaggaaataccagattcttcatctggggtagccaagcctgcaagcctgctaggggggcctccccaagcccatgcacatggccaggggtccaggctctgggcaggttggaaaagctgcctgccccatgccttgccctgggagaggaggcaggggccgggtccacatgcccctctactctctgtgtactgtctttgcagcttgtatcattttgacttaagactcaaggcagctgagggactgaaactgaaagaaaatcaaggatttgaacaggatgtgcgttgggggtgggatatctgttcccaaagccttagccccaccctgacttgagggaaaatttccagatgggattggtctctgctaagcctctgagcccctctagttggggccagaggtcatcttggcatcctcccgcccacccagatgaatggaaagttctctctccaggacatggttatcctcattccccactcytgtgcctcacgattcttactcttwtgacagacttcctaaaattccagcctaaatcctctccattacagtttctacaaattctgactcctaactacaaagggaagagaacagagtgaagccttcccgaggtttggggtctgtataagggtataggaagtggggagtggggtgcagatcagccctcttgcccyaggtggtttataggatgaaggtttctctgtttaaaacagtaccctggtggcaaggagtaaaggggaatattacacccttccttcctcttccagccttagtgaggttttctgggcagaactgatatccttactctttctaatctccttgtatttgctggtcaaggctgtgcatttgtgtaatggggggcagggacagtagttggtgtccactcagaatgcacccagctcttccctcccaatgccagtggcttgtgggacatgagatgggagctccaggcagcaaagtgcatgtggccctggctctgtcctcctgtgtgacggttgcttccctgacaacaggggcagctttgagcaggatgccctgctatttacttgtttgtgcatctgaaagcaagaataaggaactgctgcccttctgcctggcccagcaggcctctttccacaccctgagggaacctccccaaggggtggcccagaggagaagtaaccagttctgggatgagagagctggcaggggccaggacgagaccctagattcctgtgtgtgcctagctgacacctccttccccaaaccaggccagaagatggtgctgggagtgaaggcaggcccaggggagagtccatggagaagaaaggccatccccacttctctctggggcaaccagaagacccaactccgaagggaggcagccccagagggcccctctgcaggtccagtccccctcattggccgtggttctccagctcagacacctttcctaaaaagtcagctcctggsgccctggstgtagtcaccacctcccaacagatcttcccacaggccggtgcccctcctggacaagggctcctagcctcctccacccacttctttgctcaaagcttcaaagctcccttttccagaatgcagtcacagcatcactgctgtaaacaaagtgggacctcctcacctgtcactgttcctaacacaggtctgtaaccctgtgtcggactccttttctctcttggtgacgtccagggggcagggcctgtgtgcatctccttgtattgtattggatggtctccaaaggcagaggctatttctctcccttcttttgcagctttctattatgtccccacaagaggactctttggagtgggggaggaggtatcaggaaggaacgtatttagggatcagttattttggacatgggttataagcagaaagttccctggctttggtgaggagtgggggattggttcccacaaggcctctggcttctgggctcccagaggctgcccgtgcgagtaacactcacctgctgcgctccagatgccagggcaggtactacgaccacacctggttcactccacaattcttcctccccaggctcactctgctccgtctccatcgagaaggcactgcctgaggacagaggcttatacaagtgtgtagccaagaatgacgctggccaggcggagtgctcctgccaagtcacygtggatggtaggtcgtgcccacccatcgccgccacccatacacaggggtcccatttctcagcccctsccttccttaccataccttgcctgtcagacagaactgcctccaacactgccctccctacccaaaggcattcattttggatgaatgaatatcttttgccaaaagaaaaagagacaggaaggaaagtggcagctctacttgatcacctacatggcttcacccctcccctggctgtcctgtccccctcccagtcctgatccccacacccagaaccttctgagctgggaagctggggcactgggcagtagaaaagacacacccacaggaaaatgactacagagtattttacaaaagccacaacaaacaagtgtccgagctggcaggacgacccagcagggtcagccgtgaggaggagggagcagagcgaggtccgtgtgggagacttcctagaggaggtgagtcggggctgagtctctggacagagaggacagggcagcctctgccaaaacaaaatggtagtagtaataataatactgcagagggaggtgggaggacacatcggggagaaagcaggcctgccaggtcttagcggagtttctgtgttaggaagaggcagtgccaagctgcgaggaactgggctttgtcctaaggaaatgcaggaagtgcattcatgactcttttttctctccttcctggggagtatagaattggaacctgagaagtaggatgaacctcgtgatgatttagatgaacaccctcattttacagataagaaactgagggcatccagagaggaaatgcattttggaggggggctctctggcccatttagggccaagctggggccagaaccccatcccaggactcacaacccaggatcatttctttgtatttggcacttacctggaaatgtctcaaaaggtagttttggggaaatagtttcttgcccttgaaatgtctggttaataaccatcagagacacatcaaaaactagtgtccaaataaggcatcttgaagcccagcttggttgttcttctccctcctgtgtgtgatcagttgagttctgaagtcctagcccgtctcactgccattccacaccatgtagagcccrtgtcctcattctggactttacaattggtttcctgatcacagagctgagctctatggaacatgatgaatgggagagaggtggaaaagaaagtcttttttataaaaacacaatggcagcacgaattaattgttaatagccgaaaggtaagctgaactcatctaatactgtgtacttctccttggagatcgtgcgtatatgtgctataggggctctgagtctaaggaagcggacttgatgtgtccaagtttatgctcaattcagagggggcatgggacacattttgaggttctgcacagtggatgctgtggctgatgactcctgtgtgggagtctctcctcacccaggctgtcacccacccagatcacagtcctgcttctttctatacaggtgctgcactgtaaagtatagcgtttctgaaaacatgrtccttgaagcccacgtctaacacccctctgctcrtttgggactcacactggttcccgagctagtgaaggaggttatcggctttcggagcctctttaggtcctgtttacatggctagctgaaggcaggagagcaattcattctccctatctgtaaaatgtcagcaccttttctagatttgttttcaagatgaaatttccttttcccctactgaatacacttggggattttttttttaaggtttggggaattcattctgcaasttaaaaggctttgtttgcccagagtctgctggcagattcccttgtcctctccactaatcttgatgaccatcattatttatccctaattccttcaaatgcagagttaggcctccagctgcaaattgggagctgggtcttggaagaagagctagaaaagtgataggagggagcccagctgagataacaggactgactctcagtccattgggtttggttttgttgacagaaaggataagggtggcctcttccccctgcttttctttccctgttgctatacttacagatatattagcatcctgtttgcccacatttagctttattttttcatcaagagcctctctaggaaagtagtaaaggactgttgtcactttgacagctcccctgtcgcctttctatcgtctggtgctccaccccactggctaggctacrtctcctgccctcattctgtcccctcatcccctcagctctccctactccccaaggcatcatacttgacttggggatcccagtgggtttgtgcctcccctgaaattacaggcaaaatgttgcattatgtgggttggagcatctttctgaagagaggggtccatagtttttagtcaaattctcaaaaggagtcatgaatcagaatacgttgaagaactacttgccgtaagcagcaacaatgactgaattttcaagcccagccattgtgtgggctcttccagcctgtctccagctgcaactgcccacccaacctctgcatagaaccaggccttcatccctcttatggggcaatgaggtccatctccactaggcgatgggactacagctggtgctgacttcagactggcttccccagccactcagcagggctggcctggcccctgaaagtcgctatcattcactcatcctgtgccaaacaccatcgagaccatacatctgaggccaacatatctttcaaaatctcataaaaatgaggcaaatggggctaaaatagcattacccacactactgattccctcatatcataaagataagggatgtaacctttataacacagcacagctggctattttaatcatgtgtttgggtctttttcctaagaaaaggggtgtttatgaacttgcttgattatggtcatatcacccttccttctgaactcagcagaagacaagggttaacttgtgccacatagaagggagctaaaacytagagtaaacgtggacttgcccgaaaactcacccaggaggagaasaagctgaccttcaatgcctgtcctggccagagactcttgtgcactttgcattttcagtctatgcaacagttgggcagggtgtctttctcagtgagcaaactgaggctcaccaagggtcagctgccttccaggccccacagacagtaggtgtagatctggtgttggggctccaccctgcacagtgaattacaacatgaaatatcctggcaggactcagtggtctggctckgaaacctgttcctttccacagcctgacacagcctccccgggcagtgaattaccatggtggggcccgctcccagagtgatccagacctccctgagtaacagtcctccctgtggggaggtccttctgcacgtgggactcagtaacccctttcctctcattccaacccagatgagcagtgaggaaactaagtccttcctaggccagaatcccatgagaggastcaaaaaacaccttagcccctcactggctcatccagtcattctcaactcaggcctcctgtccccagccaccctggccagggcatccagcttttggtaccagtgagaccagggctttgtgaccacagagggtcatgcatgattgtgatgggaagggacactccagtgggtactcatgccatcactcagtcattcaactaatatctgagtgcccactctgtgccaggcactgccataggagctggttttaaaacagtaaatgaagtaggaaaagttccagcttttgggacttttctagtgggaaagaggcagtaatgcaggtgaacagctgtgtcatatcctcaggtaatgtcaccagctatgaagaaagcaaagcagggtaatgggggagrgaataccatttttggagggggtggtcactgaggcccctctgaggaaggaacatttgaacagagactgaaggaagcagggaaggaagagggacaaggtgacaacaagagcatagccctgagctgaggacactgtgcttaaggcgtttcaggaggcaggaggccagggtggtggagccatgagcaaggggcaggatggtaggaagtgaggttgaggaggaccgtggaccagatccaggcagtgttggctaggacaaaaaaaatgagattttattctaagtgttatgggccaacactggacatttatgaaggatcactcatgtccatgtgatgaccagacccaggatgagtcagagggaaagcagggagcacaatggggggttgccacaatagggacaggaagtgatcagattcataacctctttggctgtagagctgatatgagttgctggtgagctgggtatggagagagagagaagttaaagatgactcagttttcatgggggagtgaagaccaatggtggggctggggggcacgatcaagagtttagtgcatgtgaagtttaagattgctatttgacctctcaagcggtcctgtcacataggcaggtgtttaggtgaacctggagttgagggggaggtcagagttggaggtgggatacagggagccatccacacacagaggccattcactgccctggggttgaatgaggtccctggagagtacagaggtggctataagaagagggagagagagagaggcaggggcaggacaggggcctgcgaagaagactaagaaggaagtactccagtgagatgggaagaaacccaggagatgggggtgtcccagaaaccaaatgctaagaacttcaaaaaggaaggaatgatcaagattagtgtgccaggccaggtgtggtggctcacacctgtaataccaacactttgagaagcaggtgaattgcttgagccaggagttcaatatcagcctgggctacatggtgaaaccctgtctctacaaaaaatacaaaagttgcctggatgctgtggggcatgcctgtagtcccagctactcaggaggatgagccaggaggacagcttgagcatgggaggttgaggctacagtgagccaagattgtaccacggtactccagcctgtgggacagagggagaccctgtcaaaaaaaaagaagaaaggaagaaaaggaagaaagggaaggaaggaaggagggaaggaaggaaaggaaggaaggaakgaaggtaggaaggaaggaaggaaggaagaaaggaaggaaggaagggtcaggtgctgctgccaaataaagatgagcctgagcactggctattgggtttgccaacattgaggtcattggtgaccttgcaagagggcttcaggggagtgatagtaacaatagcctcatctcaggcaaacagagactgagtcacctgctcaaggtcaccctaactagcagagtgggaagttaaacccaagccttggtgcctaaccactgtgatccactgttatcttggcccctgggcacttctgattattgctgagctgattttgatccacccctcctttcttggcctcagccctgccatattactaagtctgctcccacccccacatttatttatttatttattttgagacagagtttcactctttttgcccaggctggagtgcagtggcatgatctcggctcactgcaacctctgtctcctggattcaagccattctgctgcctcagcctcccaagtagctgaggttacaggcacccgccaacacgcccagctaatttttgtatttttagtagagaaggggtttcaccatgttggccagtctggtctcaaactcctgacctcaggtgatccacccgcctcagcctcccaaagtgctgggattayaggcgtgagctaccgcgcctggcccacatttattctttaaatcatcacagacaactaacgggtattatgtgaaactaaataaaattgctgtttttgtaggtcaaaaacacttcaatactggcgaatggtgtagttcaacctgatctgagcatacaaagtacttagcmccgtgcatacatggagtcaatacccagtaaatgtcagccatcaccttacgacttggccacacctccctcactcttctattgaggtgatgttatttcggttttccttgtgaggaagctcagactcagaaaagttcaggaacttgcccagggactcacaactcctaagcagcagagccagaaagcgcaagcatcctgatctctcttccttactacgctagcacactgcttgcactcagtcagagagagaggccagcaaggagggatgagccaacccagggagaggctggagcccagcccctctgccctgccccactgggggcccctagaagctggacccctcccagaagcttcccaagacctcatgccccctgcgtggggtcagagttcagggaaccagcctcttgggggagattaaaaaaaaaaaaaacgctgcccagakagcttgagtccagagcccaggagtgggaggggtgaggcattgtctatataaggacacattttcctctcaatgtagaggccccccacttcctcacacctccatcttcctcccccacacttctttggggacacaagcaaaggacttcagccttgggggcctagatctagaaatggagtttaatttcatcacaaaatgattaaaatagaaaatacaagctgcycttaaacttatattactattatttttatcccctgggcagccatgtgagcacaaagctggttttgattaggcacatggcccttcgagcccactccttgctgcagttcgcatggaggtctgctggctccgcatccctggcagggccccgtggtgcatgcacagccccaccgtgctgacacttcargtggagcgcggccaccccctggggctccgagtctggggtgtgcctagtttgaaagggggacttcagcccctttcctcatggccagatggaargataaagtgctgcagaaacttctaaaaataagactcaaagcacattacagggtagtgtactgacacgtccagtgaaaacccagcaccctagggccgaggacggaggcagaggcagatggggcagggcagggagtgttttctgaaggtggaaaattttaaagctgattcagaaggaggtaagggaatgtggctatcaagaggaattaattcataagtgatcattttcattttctttttttttttttttttcattttttggagacagggtctcactctgtcatccatgctggagttaagtggcatgatcactgcagcggcacgatcattgcagcctcaagctctgtgggctcaggtgatcctcccacctcagcctccaaagcagctgggactacaagcacatgccacagtgcctggctaatttttgtaaattttgtagagacggggtttcaccatgttgcccasgctggtcttgaacttctgggtccaagtgatccaactgccttggcctcccaaagtcctgggattacaggcgtgagccaccacgctgggctgataaatgatcatttcctgctttccaaaacaccgttgcatgtgttctctcctttgggcktcaaaacaccatgaggtagagaaaataagtgattcccttgtacagatgtggaaacagagatgggacagtttaaattatttgcccaagttcccaaggttgctgatgacaaagccaaagctagagctgtactctcttggcctctactgtggtgatgcttggaagtaaagcccaacacaaccccatgaggacgaaaggagtctcagtacctgctgcccttctttcaggagcccaggaaaactgggcctctcatactttgctttcttgtgcctcagcttactcatcagttaaaaaagcaaacctgatccttcttcttctccctcctctatgctccaagactcaccaggagaatgagtgctgaagccaaggagtgcagaactgcatacatagtctgccctgtactcctcttccttaagaagggccgggtgccgtggctcacgccagtaatcccagtactttgggaggctgacgcaggcagatcacctgaggccaggaattcaagaccagcctggccaacatggcgaaaccccatctctactgaaaatacgaaaaattagtcaggcgtgtactcaggaggctactcaggaggctgaggcatgagaatcacttgaacctgggaggcagaggttgcagtgagccgagatcatgtcactgcagtccagcctgggtgacagagtgagattccatttcaaaaaaaaaagggggccaaacaaaacaattactgggtacacctttctttacattgtcattggtgactgttagaaatgctggtcttcaaggaagggaagaagggagaggcccggacaagggaagcttagactgactccatgcccctggtttatggcaccctcatccccagatatcaaggggaggctctgctaggtttttctgcctcttggaatagtcctggagccactccctgcgcactccctgtgcttgaggagagacgaggagttttctgttggccaaatatcagtcatccatggagcttctggatcatatcgtgcccagaccccaacccagaccaatgaaaccaggacctgtggggtgtgataccctggcacacgtgcttctaacatacagctgaggctgagatccaccgaggctgacaaataactatgtccagaggatttttctgtagctgagaatgaccacgatccttggggaaaatgtccagtgtaagaaaatgaaatcatccctgccccatggctttctgcttctctgtgtcctcatggaactggcatgctgggttacaggcagcctcctgaggagcttaagagtgtccactccagatagcagggacccctgatgtgccatctggggctcctttgcccgtatgggaggtggcaggagttcagcttgcagtggggagtggaggcaagggagcgttttggtgtcaagtgctacttgaaagggttgctttggctgtctgctccccccaacaccccgtcacatactgctaagtagtcctacttaaggcccacaatggtgcatgcagggctttcggctgtctttggtgggggattgcccccacagcccccggaggcctgtctgcttctgagctgccatgagcctgcaacacccgcacagggcctcctccctggattacccatarcagagaggaggcaggcactaggttgggaagaaagcctatcggggtgatgatgagcagagggactcawgcaggcagatccatgttctggagaaggcgaggggcctaaatgcctcccagaaggagaaatgcatccagaggcagctcagagtccacttgctgggagaagtatgttcccagcccccagttctgctccctgcgcccacccctcagagccccaggagcccagtctaggcaagatcagccctgactgccagtcctggaggcggaccatgagagggcacttcctccccagccaagcctcaggaatgtggcggagcctytgctggaaagtccccccacccacccccacccccacttagcttcstctcctcaggagcaggaaaaggatgcccagggagggggcttcaagggggagactctctcagcgccgtccccaaagagtgctccttgtggggaaaggaaggccagtgaaagtgctggggcccagtgatagccactcaaccagctcctccttatcccagttcctggatggtttccccatagtgtcctgggggccagtgagggcctttccacccagcccagcccagccaagtgatgtcgccctgcttgccctccatgaggaagggtttcctctggcagagggagtgtggaacagagcctgagggcaggcaccgcccagcatctttaggtccgcccagcaggcagctgtgcccagcttcactgggcctgttgggggaggtctagcagaagccccacagtggggcctagaccccgtctcagaggtgggaggcatgctggctgtgtgctcagaggcctccgtttggtttgtcactgcaaagtttggtctgcagaagaaagtcagagaaatcagaagctgtgcgccacctctagtccatgatcccaagggcggggaccctgtcccctccygcccctgttggagaggagacccaagatttctagcatgagggagacaaggcctgatggaggagaaagccagggaaggtgagcaaggggtgactctgccagcaatggcattccgggggagcatcccaagctccctgggcagcctgtgcgctcatcttgccaaggtgacggtgctgtccccactggattaatcaggcccagggtagtggacggtccttctttgatgctctcatggagagtgaaataggttgcctggacacaggcgctgttctgcccagcgggcacaaagggccctcagagttggggaggagtttggctgaggtgggattttgactgagagaccccctttgctcatttcctcagcagctgctaacatttattgttacctgtttcattccagatgctccagccagtgagaacaccaaggccccagagatgaaatcccggaggcccaagagctctcttcctcccgtgctaggaactgagagtgagtactcrcccagcttcaccaggcagaggcagaggcaggggcaggcacccyggggactgagggcagcctcagagcccccactttctggtcactcactcttgcctgaatccctggaagtctgatgtctgcccacaccctgaagtgcccagtgaactcccaataacagagccagtggccttttctcaccccatcccagtgctctctccagcctgtctccagcctgggtggtgttgcacatctcatctgagctcctatctacctcccctgcccaacctccttcatgccctttcacttcccaccaagactctaggagagctcctcctaatttctccccagttgatcctgccctcccaggggctctttctggattgtaactctgatctcatcactcctggttgaaatatgcagtggcccccagagcctgcaaaacccacaagcaaagctccacatgttagtgccgaggacatacctagctcgcatgtgcacacgtggtcccacatgtggcctgccccccgcctgtctttcccggtgctgcccccagctcctttacttctattttatactcaggccaaactgagctcttcactgcacactacacagcccccaagttccttccttcatgccttctctggcacctctctccatgggacacctttctgccaaactcctctgaaaagtctctcatccctgagttcttcctcacctcagctcccacagtgtcagcacctggctcctccactacctccttcccaatgtcacggagatgtgtctgggtctcatcctccctcctccattgtacagggtctgttcaagcaattacctttcagaatgacacatgctgcgccttgctcgtggaaggcccttcccagtttctcttagagtcaaatcgcagtgtggtataaaaagccaagagagaaaggagcctctccgtgaccataggcagctacctccctctttttggatctcagcttccccgtagcccacacatccattaggcaccatgcgtagggtccacagtgcttttacaggcctgccaaatgctgtaatatcttataaaattagaagaaaaaagggaactyttaagtcaaagaaaaggttttaattcatgacatgaatatattcatctttatacccatgcagttaaaagtgtagtttacataattcaaatataatacttgatatgtaattaaatctatttacttttttttggtggaggagggggctataaaggcagaagtgcctcagaagtcacaatgtcaccctggcttcccttataatttttaatctaactttgacagcagaactaccctttgaaaactacaatttcaacagagggtgcagagttgcttgaacatccccagcacatgctgtgttttaaaacaaacaaacaaaaaacaagatgagctcctaattgcccgtactgatagrggaaaataattgagccgggttaactcagactacartctttttccattacaatgcagtgttttgtgactttattttattcttaccttcctaatgatgaacttgggttcctcaaacataccccagccaggctgttgggggaactcagccttcagtatgttggggcagagaaattggaattaatttctcattgatacttaaccaaggtagatagcctgagaatatcaagaatggacatttaataagttgttggaaatgcatacataataccaagaaaaatctggtgagaatgggttaataattttatcttccaaaaatattccytggacctgtgctatacttggtatggaaaaccgtgagcagaagagatagagaatgtaggaagggcaccaggggctgtgaattggggctatggcatggctgtccccgactcctgggtgcagaagctacagkgcaggtattgatctggtgggcagcctccagccctcagctccagcacacccactccagtgagcccctgaggaggtgagatggggtcagagccgagctgtggaggaggaaaacaagcttgagaygatgagcagagcaggagctgggctctctgccctgagaacagaaggctgtggaaaccccatgcaagctgtcactgtccgagtctggagcagcagctcgcacccctggctgtgtgttatattcacctggggagcatttaaaccactgccgcacaggcttcccctgcccccagaccaattacatcagaatctcaggggtgggtgccaggcctcagtatttgttcaagctccaggtcacgtcatgtgcagtcaagctggaaaccagctgttccagggagaaacctggtgcccacactgtgggtcttgagaagcagaagggggtctcccctgctgcctctgttaagtgtggaactgcctcggggaccctcacatcaacatccttagggtatcatgttgcccagagagccgaacaaggcaccttgtggtggagaagctggaagcagggaatgaagctcagtctgagttagtgggggagcagcaggctagtagcaagtgcttcatctttacagaaaacacacattcatgactggattaactccagtagaccccacttggatttcactctgtgtgcagagcccccatgttggaatttcagacatcttgctcctgaaagaatgggagtgtgtgtctctacacactccaaagtcatggccactttgtacccttttgctggcccaccctccaatctctgttactccaaacctgctaccccaacactgagagcggtgccaggctggctctagctgccctccacctgcttgcacccctgcactcttgtccttcagaagcctgtaccctgggggcctgagagataccctgggatttgtttctggagcctcctgagaagctcctgagaaggcagctgcccagagatgggaagtgaaggagatgtcttgttttgtttttttttttttttttgagacagagtctcgctctgtcaccaggctggagtgcagtggcgcgatctccgctcactacaacctccgcctcctggtttcaagcgattctcctgcctcagcctgcctagtagctgggactacagctgcgcaccaccacgcccaactaatttttgtatttttagtagagatggggtttcgccatgtgggccaggatggtctcgatctcttgacctcgtgatccgcccgcctcagcctcccaaagtgctgggattacaggcgtgagccaccgcgcccggccgaagatgtcttttagatttgcacccattcttttctccctttggaggataattgttagtttattgattatatacattatatatgcacacattcttatttaaycattttaaacaatatagaaatatactatgtacaacatgaaagtcctctttcatctcaccccaattctactcacgccccaaaaatactcagtgacttttttctatgcatttttatatacaggcacaagtacatcaattggatttttgtcccacagagatggaattgcacagtctgtatacctctgcaacttgcctttttttcttagctttgccatccccagtcccagacacctctgattccatgagtgatctggctgtgtgtgtgtgtgtgtttgtgtgtgtgttcctctgtgtcaagggctgagaagtacctagtctaagagggaaatccatctttcctgaggtgagcctgagtgattttttcatcaaatagatcatgaccagttccctcttctgcacacccccctccctgctgagcactgacaagcatgagggaaaagccaagggcatccaccccaacccaagcaaggacggggtgagagaaagcggacagaagtacaagttaaccggccagacactgactcmcaagtgcaggagggaggtgggagcagcttgggaagatttcgggatgaggaaaacggggtcaggttatggaggaggagaggaatgtggtttatgtggtttggctggagagaaaatgataacatcagttggggagaaggcagacagggaggagccacacagatgctggagtgaagattgtgagggcacctgtctcaggacagctgcaggctgaacaaaatcagagtctaccgagtgcctgtgcactgggagcaccttaggagctcgatctatgtcacttcagccgagtctcactcaactgcgctataaatagctgttcccattttagggatgaacaaaacagagcctcagagaactaaactgccctgtccagggtctcacagctagtaagatgtggaactgtggtgccaaccctgacctgcattctggccactacaccctggcctggctgcagtctcaggatgtactctgtgtgtgtgtgtgtgtatatatatatatatatatatatatatatatatatatatatatatatatatatatatatatatatatatatatatatatatatatatatatatatatatatttattcatttagatagagataggtacctaccattttaggccaaattggagatatcatgcccttgaattctaactatgctgttgtcctaagaacataactacaatgcaattattgaaatcaaaatcaaagagtaaatttgacattgaaccaatactgttgtctaattgattcatagtctacatttattgtcaattgttctaataatgttctttgtggctatctttttctcctgttgatgaatatttaataataacactcctaaaacacttcgtgcactcctccagcccagagtgggtcctctcctccctttggagatggaacaggaaagaagttcacaggcccaggggagaaacaccccacactcttccacctaagctgagtagggcatggggagacagaaatactcctgtcggactccaggtgccaacttactatgatcagttctggggcagcactcaggcacaagacacagcaagaaagccaatgagcaggagacgaaggtcttggttctcccagtagttaaatatgtggccttggtcaaagcccttcattcctctggacttgggcttccttgccagtcagatggggagtttctccagctgacctcaggcctttcccaactctgacatcagcatcagcccgttggatggaaagcttttgagtgacacagttcagttgagattaataactctccttcatatcatctgaagtgtgaaggagtccaaagctacagcaagtatagtttaggtcacacagcagcaaaagtgtcctgagggaaagaggccttaagcatacaggtttaggggagtcccagctggagggggcccaaatggccagsggagttcttgggaattttgcgtgaggggaracaagcatgctggctgtgtaaaggaggcattgatggggcttaagaagtggccttaggaaatgcacatgaggtgatgccagtttgataccagactctgggarttcctcctagcagtctatataagctgatggtctttcagaagagatataaacggacatccatgtggggcttttacaccttgaagacagaaaccaggtcctgtccatctccaaaacttcattagctggtctctcagtaggtttataataaatatttgatttttcaaaccagttcataagttcccatgctccaagggtccctgcctccactgtggttctgccactggggatgatgccaatggaacatccctttgcagtccatgcctggccttggcctgagcttcacctctgacatcagtcactttggaacatcccagattatgagactctcagatatctttgcctagacctcccatatgtgtctgcctctaaaatggaaagttgtgtcaatttgaaagcatctctggatattaaaaactgtcccttttccatgcaagatttccccaggatcaaatcttttttttaaacattcctcctcaggtcatgaggaatgttcaatcctgatgggattcaaaaggctggaagagaggttgggatttggcatcaagacttgcctgacagtgaaagatgtggggccctgggagagaggctgggctatttccatgaatgtttctgaaagctggcaccaactcccagttactcccaaccaaaatgtgggtctgggaggaggaatagtgcctacctggcacactcccacccacaggcatgtgaccctatgacttccamccactactcctcccaactcacccagtgtctcccataagccagtgaactggccagaggggagacctggaaggtacccaccaagcaatgctggcacccctggcccagcacacctctttcacaaccatcctgatgctctgtgtcctgggggtttgggaatggatgtaatcagaggagcagtgtttctttgcaatctccttatgtgacagcccttgctttgaggaaggtgagcaagaaatttgcccagagatgttaattctgggaaaatgaccaatattcctccacgtatctgtaagcatgtactggatgagaccagcgtatacagtaggggagtgggtcaggtcacccagggccagtgtggtaggactcagccttccatcctcaggtacccccacctccttcctgctccgatacagcctcatggggtgggtgctcactccatgctcaacccagctggagtccttttcaggagcctttggcagaaagttcatgctgattttgggaattttgaaggatttgatgtctatttttaactacctacctaaaaagggaaatgtccccagagaggcagacatccagggacctccctgtacccaaggctggtaaggctagttccctaattctcctttgctttccattatctcagaccttttgactccgtgagacccaccttcaggctctgcacctatcttgcaaatgtttactctggtctctctgccctgctgattttccatgtttcagagcgaggcattcaggtgccttcagactgagcatctggaaacttctgtgggttactgacctccttttttttccccaggactaggttagggcttgggtcagctggaacagattacctgaacaattaggaggctggcctccccacccctgccccaggtttcccaggaggcttccagatccaatgctttgattcatgtttttattgggctatttcacttcctctaatatcaatctcctatctagagtggaaggctcagcacctggcagctttgatcccagaggggacagcagagactgatccttttcatagaaagttatataaaaattcaagccccagggctatatttctcagcatcagtgcccagggctgggggagaatgttccttgggaattcccgggttaacagaaatccttgagggtttcactcattcctttaatggccatttatcaggcatgtgccaggtactatgctaggcactgcagatacagaaggtagaccctatccttgtccccagaagcttgccgtggtgtgtccatgttggggacaggtttctgaaatagcggtgcctgatgaatgctgtgatggagctacctcagagggccatgaaccccgtggggcattagtggtgcatgagctggggcgacctgcccaaagaatatgcaagagccatccaagagaagagggcccagcatgtgcaaaggagcgaaggcaagagcctggtgttgcagaaactgaaagacattccatgtagattacagagcagtacttcccaaaggaaggtgcagggaccagcagcagtagcagcaccagcacctggaagccaagaatctatgtttttattaagtcttccaggcaatcataatgtaggctaaattttgagaaccactgatattgagtattgaggttgtgatgaaagttgttccctcttgggaaagcaagcaagaaagttggggatgaaagccagggacagagctcaaagacctcgtaagatgagttgaatttgatcctgagtggcaatgggcagccactgaacaggttcaggcagtgaagtgacatcatatttgcatttgagaaagatcactttggccacagagtgacaaatgtgacgggggacaggggaccagaagcctaggaggtgatgcagttgggactacaatgctgayggtgggaaggtagaaattggcagactgaggaggtacttagttggtgtagacaacaggcatttgtcagtggatatgggcagggagggggccttgggagaaatggggacagggagcaggtttggggaaaaggtcttggatttggttttgcacgtttggctggcagtacgtgtttggcatctccctgggagatgatggtcaggtagttggatgtattggtatgggctcaggagagaggtctggcttcaggggaaatggaggaaagagaataggggatagaaagaggagctcaaagggcagcgatgagcacagtaccccggggcagtgctctaccaggaaggatgtgctgcctgggctgactgcctaaaggaggtggctgagcccctcttcagaggagcagcctgagtagggcgtgctctgccctccctgcctgtcccatggccagcagccatcatggagtttgcaaaggtggatgggttttattttccttctaggatgttcctctctgactggctggtacacaaagtttagggtgtcagagaagaggatgagagacacagggctgacaggaataataagataataagagtgactccagaggagaggaaactagttagtgagccagggagtactgtgagtttgtttgggcatctggacctgcagaatgtcccctcttctgaggacctggactggggagaagaagcacaggtgccacatgagagctctcaggttagtgtaaggctgaactgaccaacagggtaccacatagatgaaagggccaaacttgtcccaaaggacagagaagtcctctggggatctgtttgtttcagagagcgggggagtggggggaggggctgatgttagaacatgcactgaggctgagcatggtggctcacgtctgtaatcccagcactttgggaggccaragtgggagctcacttgagctcaggagtttgagaccagcctgcgcaacatagtgagtctctacaaaaaattagctgagtgggtgctgagatgaggatcactttagcccagcaggtcgaggctacagtgagctgtgatcatgccactgtactcatcttggatgacacagcaaggccttgtgtcaaaaaaaaaaaaaaaaaaaagaaaagaaaaaaagaacatgctgcactatatgctatacttcccttacaatgtagcttaactctttacaacaaattttatttattccataccctgggtggcaggaggctcagatcccatttccagctccagaacatcaggttttatgaacctagcaagtcaccagacttttatgagatgccatctcctttttcataaaatggaaacattatgatactccctgctgtgtttgattgggatgagaaccaagtgaaatgctccctctgagaaaccgggttttagaaccaggtgctttcccctataagcccagcacacaattagtggatttcagcagatggtcatataaaatatgtataraataggatataaaacattgttaacgcttaaattgtttttactgataggaaccaagccagtttcaaatgctaaccaattcaaacaatggtagctccaaatttacagaacaaacataaaaatttgaccttcaatcctatttaaccatgacactgaaagattagttagggcttctcttccagtcaaatgggtttacccagagccaccaagtatggggcaggactttggagtcccctgatttcatgctgtgctcctagctcatcaccccagggattgtcarcctccttctcacacctggtgcccaccccactggtgcccaccccactaatgatgcccatccacagctatattagtcttctagggctgacttaacaaagtacggcagactgggtagcttaaccacagaaattgattctcacagctctggaggctagaagtccaagatcgaggtttctgcttgaaaatggcagtctttcccctgtgtcctcacatgktcttttctctgtgtgtgcatttgtctggtctctctcgctctcctccctccttctcccttcctccctctttctctctcgctcctttctctctctctctctctctctcctccccctgcccctgtctctcttcttcctaatctcttcttataaggacaccaaattggactatggcccaccctaatggcctcgttttaatttaattacctctttgaaggccctatttctaaatacggtcacattctgaggtaccaagggttagagcttcaacatgtgaatttggggagacacagttcagcccatgacaacagccctccacgtagctcctctgaacagatggcctcctctctccagagatcatatctgggctccggtagaagccctctcttcttccctggagagcttctctcttcccaacagtcctggacaaagaggggcagggcctttgtggctcagccagtcacaggcgtcccatatcccatctggtctcccccaccaaaggatttggctccccgtgctcttccctctagtgtctttgggctctctctctccactgtgccctagccattgccttccaccttgtcatcttctctcttctctcacctcagaagaaacctgagcttcatattccctcttgtttccttgcttctctttgtcctttcacctccaggatccttgactattttactccccactgtttgctcaagaatctcctctggggtgactttggaccatgctgtcccatggaacctggcctctccagcatcaccgtctctcactccatgctgggcacacctggtgctcttcccagcatctgtcctctacccttgcttgtggcgacactcctcctgctctcagggtccttccacagccctctcctgtgtctcggcttctttactgtggacacacctgggatcaaaccctggcctccgcccctctttcattgcattctctttccccaaagaattgacccatcttcaaggtttccattctaatggcttctttaattctggaatctttcacttccagtctccacaaacttccctctggaattctgatcctgggcttctaacctacaaacagattcaagctgaaatattaatcttgtactcctaattctatattccttcaatatgactttccacgtgtatctatgcaagaaatctcaaagtaatctgtgtacctccttcttgtttagccccttaaattattttaactttcctctgcctctcatttgcatcttcttttctgcatggatcttgatcagtgccttccaaggtatggcaatagcctcctaattggatctgtcccgcaagagctggaaagacctatcagggacctctagcccagcctgactgctgtttgagtgaggacatgctgttcaatcaggacaaagccttagctcgtgagcttagcatttgaggccagcactgtctaacagaaccctctgtgatgaaagaaatgtcctacgtcaacacaatgtgatagctactaaccacctatggctattgagaacctgaaatgtgactagtgcaaccaaggaatcaaatttttaattttctttcttttttttctgagataaggtctctctctgtcacccaggctggagtgtagtggcaaaatcatagctactgtaacctcgaactcctgggctcaagcaatccctcccaagtaactgagactacagacaggcaccaccatacctggctgtttttattattttttacagagacagggtcttgccgtgttgcccaggttagtctcgaactcctggcctcaagtgatcttgccacctctgcctcccaaagcgctgggattacaggctgagccactatgcctcaccttaattttatttaatttagagtgcccactatcctcataccactgctgtccaatatcagccctgtgctctgccagcctccaccaaacatcaccctgattctcacctctgagccactgtctattcctgacctgtgggttctcctctttctccagttcagaccttccctagccttcaggtccatcttacatcctgtcttttagccttctaactaaccatctcctccaccaacagtgttccttttccattcaaacagccacatcacgttgactgaataacatctttttttataactttctatttaacttttatcttgaaataatttgagactcacagaaaaaattgtaaaaatagcatgaaaaattattgtatatacccttcatctagattcctcaaaggttaacattttactatgtttgcttttttttttttttttttttttgagatggagtctcgctctgtcacccaggctggagtgcggtggcacgatctcagctcattgcagcctctacctcctgggttcatgcaattcttctgcctcagccgcctgagtagctgggattacaggcgcacaccaccacacctggctaatttttctatttttcgtagagatggggttttgccatgttggtcaggctggtctcaaacttccgacttctggtgatccacccgcctcagcctcccaaagtgctgggattacaggtgtgagccaatgcacctggccttgctttttcatatattctttctctccctctctttttccatttctctgttccttctacttctccacacatatatacatgtatatatacacacacatatatatgtatataccatgaacagtttgaaagttgcacacaggataccctctacacctaaatacttcagtgtgtatttcctaaaaacaagaacaatctcttataaagccacagtttgatgatcaaaacatgaaattaacactaatccaatactatcctctaatttattgaccttattcagatgttgccagttatcctataaatgtcctttatggcaaaagaaaaaaaaaaaaagcctttcctctttcctgtggaccacgtcttgatatttaagaccttgaggcctgatttcttacattgtttggtttcctcctcagtacccaggttagtcgtgtgtactgactagcatttgcctggcacacagtaggccctgagtaactttttggagatggacggatggatcaatgatgacaatgagccagagggaacctggtggaagccctcatcctgggcttaaccacacagccggcagccatcagctcggtgatctcagtgtgcccctgccagggatcactgcctcacgcagtcctcctggggcattcactgggcagcagcacgtgtcctgtcgtggaaatgcacaagttccacaagttactaatttgcctgtggtcacagggcaacccatatccaagccaatgacaccgcttccccttcatctgcagaggtgaagttatctggatgaataattgttaatattagcccactcattcattcaacaaatcgttattgtgtgccaggcccattgatatacagcagtgaaccaaaaaagtccctggcctcaaaaagctcacagtttaggaggaggagaagggcagacagtaaataaataagtgaagatatagtttttcacatggtgataagtgctatggggtgggaggaccataaagcgagatgagaaggatgaggggtgctgggggcagggctgctgtttgtatggggtggttagggaagatctcactggtgaagtggcttttcctcattttttatgttaaggtataatttccctgcagtgaacttcaccctctttggtgcacagttccgtgagtcttgataaattaatgtcatcatggactcccagcatggtcaagatctggttctgtcaccacagaacatttccctgtgcccctttgcagcccacccctcccccaccctacctctggcaaccattcattaatctgttctccattcctatagttctgccttttctagaatgtcgtataaatggaatcatacagtatgtgaccttttgaatttggcttctctgagcagaagaaaaagagaaatcattgagattcatccatgttctgtgtatcagtagtttcttcctttttattggtggcatcaaagtgccacagttcatccatttggataccttctagtttttggcaattatgaataaggccactgcaaatattcgcatacagatatttgtgtgcctgtaggttttcattttatttggatagataggttagatggcttttgagcaaagacctggaagggatttgaaacaagccgtgaagacagctcaagatgttttcgcacgtgcactatattgtgatttagccaagtgaataggtttgtgctgcatgactgttctgtttgagtcatttttctcatttgagttatttggaggaagtaagagtaagaagggaggagaccatttattcattcatccattcatccatccaacaaactttaaaaaaatgaaagccaccagtcaacagtctgtgacccaaaggaagcttgcgacccttggatccacaccaaaggctaattttagttggtttatctgacatgacataatttcctttctgagtttcctgaaagttagggtgagagagtggttaatgagtgtggcattatcgtcttcgaaaagggctatgggagcacgagcattttagagagtttttaatctcattggaggcttcagagaccctttcataggtccctgagaactgatattcttttttgtctgtgaggttgtctgtgtgaaagggcaaagtgatctctcaaaagacatattcatttactttcttttttctttttttttttttgagacagagtctcactctgtcacccaggctggagtgcagtggtgcaatctctgctcactgcagcctccacctcccaggttaaagcgattctcctgcctcagcttcctgggtagctgggattacaggtgcacaccaccatgcccagctaatttttttgtatttttagtagagatggggtttcaccacgctggccaggctggtctcaaactcctgacctctagtggtccacctgcctcggcctcccaaagtgctgagattacaggtgtgagccaccgtgctcagcctgaaaagacatgttcaaataagagtcctccctggatgaggggccagtggacaagactgcatcttcctaggatcaggagctttgtgaaaaaaacagaactacaggaaataacttgtgaacttctttgtttcaggtgatgcgactgtgaaaaagaaacctgcccccaagacacctccgaaggcaggtaattggccacggcactatctggggtcaaagaagtcatctaccatgggggttttgcctttaccttgctagactgacacctgggtatgtgatcccaggagacaccccactgcaaccccacccccaccctcagttccagctctgcatttytcaggctgagtttgctcatggagagcctctgcacagcctggctcctggtccccttccacagctttgtctttccatctgcctcccatgttgacagcatcatacaggactagcagctctcctgcctgccccttctacgaattctgccctgctgtccatcytctgccctacccttgtgtacatgaccctcttggggctatttttgtgcccagctctgtgtgtccttgttatatggaacccttgtctgttttccattggatgacacttgaggacttgaatcaagcctgccagccagggtgacctggagtttagaaggcaaggtgatgcttaattcataagtgagttaggacctcaattcaaaaaattagggtaagtcacaaattccagtacaacccataaatggagaatcatgccatgtaagtagtgtgggtcacttctgagggaatcagaaagaagaggtgaacaaacctagcaggtccatgaacttggatgtcctgcagcaggatcactgcccctcagtcttaccctgaaggttccggaagccaagagagaagccaacagaccactgtggacaatggcgtcgaatgtgatcagaatgcctgagacccttctgcctcgctcactttctccctgtcctccctcagcaatgccccctcagatcatccagttccctgaggaccagaaggtacgcgcaggagagtcagtggagctgtttggcaaagtgacaggcactcagcccatcacctgtacctggatgaagttccgaaagcaggtcagtgacggtatggggtgggcactgggggtgctgggaataatccgtacagcctttggaccgaaagggatgagaaatgccgtgctggagatggcctcactcttcgtagctttagaaatrggagaggccactcccctacccatcgctcacctgccaaacctgagttcttgttaacctttgcttctgaatctaccaataatccccgcctttgtagacaatttgtgtaatagaagtgtgaggggaaaagtagaaaccatccatgtccctcatctggtttgatagcacagtctagaatcctattcagagtcaggaaagtcgagcctgtgacccaagatgacccttagactccatgagcttgctgtgattctgtgccagcccactgattcctgtctgttataaccacttaaacttgccacatgctgaagggacaaaagcaaatgtgagtatttggatagaagaattgtatgataaatagaattgtgtctgactgacccagaaatctagctacaatttatcataatggttcctatggaacaatgtttgaatttctagacaaccagcattgaaaggacttggggagcccagcagctccaccaatccacggtggtagtgtgtgcctgtatgcatgatcagcagagaccctggaatgatgggttggcacaggagtgggaagttgtgaagatttattctgagccctctgttactctgttttaaaatcactcaaattctcctagccccagagatgaacacttagtactaacagggaggaaagtagggttggtctcaaaagatggaaatgagaagtttgcctttagcatcccagagcatgtttgccctgagcgacatctggactactgttgtctgaaataagatggaatctcatcacttttcagagacatttagccaagtcccagctctgtccttcagaactttctgccctgatgaaagtgttatctctgtgctatccaatatggcagccaccagccatatacatggggctattgagcacttgaaatgtggctagtgcaactgaggaactgaatatttaattttaattaattaaaaattgttatagcagctttgttaagatataattcatatgccataaaattcaccctcttgaagtgtacacttcagtggttttcagtagattcacaaggttgtgcaagcatcaccattatctaattctagaatactttcatcatcccagtaagaaaccccagacccattagcagacattcctctccttcccccaggccctgacaaccactcatctactctcagtatttatggatttgcatattctggacatttcatatcaatggaatcatacagtatgtcattctctctgtgtagctttctctttttttgacttagcatactcttttcagggctcattcttattgtaacatgaatcagtacttcattcctttcaatgaattaataataaatattccattgtcaggatagaccatattttgtttatttgttcatcagttgatggacatctgggttgtttccacttaactaattaaaatttaaatagccacatgtgactagtggctacagcattggacagcacagaagaggctagaacccactggagtggatcttgtgaatgactttgctgagatgtgttctcctatcatcccattccagagaggtagagggagaccaggatatttctgggagcagtgagtgctcagctagttcatccatcctgcccctgctccacaccctccctgcccaccccagacctggcaccctcagggaagctggactctggatgtaggagagaaggggcctcagggagaagggcagagtccagaccagactgagcccccccacagcttgtccagctgcatccttcaggaagtagggaatggggaggagcccccttcctttcctagcccaggggcccaaggctccagcacctgctccatcctccgcccctagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtgggtgagtctggtggctgggtggcatggagcttggggcaaggggaaggcagggagcccccaggcaagatacgtgggcctcaggacttcatcacccattatctctcaccactcctgtgcctgayttataaggcaccacagaaagaagatcacggcaacccacagactccctgctagaccctgctgacctccaggctcagcagaggggccaaggctgggcagaaatccttttccctgtctctatcaacacctctctgtgatagctgttcctggagttccccgccctcaggccttggcatctagcttatttgagaaataagagacatgaggcataaacttggtcaacttcttggcccctacgccacaggtgtctgtatctgtccccatcctgactccaccctccaggctctggggatggcccaccttggtcccaccaaaggctgctcccttctcctgtgctctggaccccaggtccttgggggctccaccatccctacttctctcttcaacctcttcctctctcctggctcctcccagcagcccgtaagtgtcgccatcttagccagatgcacaggcattaataactcctgcaatgttctctctcactctagccaccctaccttctctctctgacaggggtgagtctctactgcacttccgcttcttcaccccccagcaccctccagctgcctatggcctcacccccacgccccattagtctgcagggactgttcttctgaggtcaccatgacctcccaatcctgactccactcgattttccttaccttcataccaggatttccttcatcccaggattgagtggggtctgtctccagactgattctcaagttcacttttcctctcctcccttamcactgtcttcgtgccctggtcagctctctcctggagcatcaagagagttttctaaccagtctcccgctgttgtcatgttctgctccagttgttccccgtgtggcaggtgcttgggacagcagaagaatgagcaggcagaggagcagacagagagagagagtagactctatgcctcatgcatttgtgggccttcatatgttgtgcatgtgaaagcctttgacctggcatttattgatatgtgcacgagacccgagcgggttttccatttgtccttggctttcaagcttatagggtacatttgtgaaaattagaaaaaggggccttgctgggcagagtgaaaagggtacagcacccccagcctcaccccagaactcatgacctggccttggggaggacaggttggcccagatgcccccactagaccccttttatgcagtgcacaaaactctcagctgtgtgtgctgatcccaaccttaacttcctgcaaactagcctttcctgtgtgttcctggtgcacacacacgtgggcacacagaacaaaaggatctgttggtaacagggcttgtgtggctaccgtggttagaagtcttccactggaatctctcttatggaagtatctagatatgaagttagaagttgtagacattgactcttaaggtctcttgtagctctgacattctatgattccccaactctattctctgacattctgattcctcgactctattctctgacattctatggttcctcacctctgttctctggtggtctgtgattccttgactttgttctctgacattctgtgattccctgacttagttctcaagcagtttttctcccctatcttcatctcgtatcatcaccttaggactaggatggacaggactgatgtttccagccttatgcaggagaaactgaggcctaatctgaacaaagtaacatagtgcatcagaggctaagtgggaactagctctaaactttcaaacacttgtcctccagtgccactcatgggagtgtgaagtaggtacagaatgtcccaaaaggtaaaggaacactctggctgcaaaactcatcttgaggggagacatgcaagccttttggggagctgtccacatgccagagagttgttgatgtctgtgcctccatttttctcatgctgagccttaggaagccctgtagcacttcccttcagcccctaagcagctggggaagaagaagtccttgtccaaccaggtgaataaggaagacacgaggataaaggtcaaagtaatacagagctgggaagacaaatgaggtggccartgagctatgcccatgccagctaccagaacagaccacaggttccacaccctggcccgactccccagagaggaagtactgcaaagccccctggaagattgtccctggacacaggggacccgggagagggaattcacagaggactgagctccagcatccactccccacccccagttgtccatatttctgtttaccttctctcttgctctgttcctctccctggccttgtttctttaccctgtgttctgtttcagccatttctcagtgtccgtcaccctgtcccatgtcccctcttttccctttgtcttccttcctctgaccctgttcttttgtttcttttggttagaagtttcagatcggggaagactggtgtacaaaggggtcagggaatgggtttttcatttctaaaggagaagaacaacccttttctcactctgtctctttttggtgactccaggtgtttatttgaataatttcctcccaaggagtcaggaacctgtggaggcttggtgstagtgatccactttactggtacatttagatctgttctgaagcactgatttggccctgtactcccgtcctatcagcaagcatcagtttaaacttttctttgatgttctctctcatctgctcctccttaagcaactttggggtcagcttctttgaactgcttttctacagaaaagctctccctccccccagcccccacgatgcccagctcctgcgcagtgccacgcactcccctcctccgatcaccactrcgcgggctgcagttctggccttttatggtttagtttcttattctctgcagccagtgctgacagggccattggcgtggctgtctgccagctggcaggagcagcatgttaaatgccgtcctgggaggggaatggaatggaggagaaccgaggctttctgtctgcctccccctcaaagaactaagaatagaattgctcaataaaataggactcacattgatggatacagcaaagccacattcattcagagcctgtacacttagaattagttcaaagtaaacctggatgaagctcagatttacctgtgcatcttcagggacatctctgtattccctgatcagggtttattaagcagatgtaaaatgtacatgaggtaaaacaggaatcacttggtctgctccggacagttttcatgcatttacagaccagctaaataaggccagtttaatacaactcctccttgttagcagcaaacttctcttattgtatattctttaaagggccactttcttttcagatcctctctggctcctatttttcaaacaataataaaaactagcctttccctctgttagcttaaatgagtgatatttagctattttggagacttattattattatattttaaaaggcagcccaggaatttgcaatgctcagagcctcttcctgcacatgcgcccctggtcttggcctgtggggaataagggaggggacagtgagcagcatacccagatggattccttaaggtcactcacccagcacgagaaaagcaggtctcttttcatatctttaaaggagaaaaacaaagtagagagaaccccaaatacccaataatccccaaatactaactgagtttggagcttgcatgatttcccatcttaatgctcagctcaggcttaagcaagatgccttcttgagctcattctgcctgatagcctggaaagtcttgagccctggagcgagggtccagaggctttttggaatctccttttggctctgccactgactactgggttttcttgataagcaaaatgccttagctgctgaggacccatttcccaagggctaggattatccaggtagatgacatgtgggggcccttccagcagctgctgaagtcccagggaagggacatccaggtggggctaggcatagccactggtcatcttcaaataagcgaggaccaagrgacctcaagagcagttactctagtgggaagctgtaggacaggatcctccattttcctggaaattagaacatttgctgaggagaaaatcctggagctggtgccactggagactcttgtcttagactgagctgagtttcctattctgttagtcaagcctccagggagccctgggagaattcagaggaaatgtggagtctcctttgcccagagatgcccagggtctccctcccagtctgagtgtgtcgccgtggaggacaagctcacaggagctccctgttctaaggacatctgttcttttctgasagttttcatccctttactagttcagccactgcatggggctcatagcttagaaagaacagaaagcattaggtgcagcccacagctctaaaggcaggtggaggagtgggaggcctccaatctcctaggacttctgacttgggtcttttctgaactccttaatttggtagcaaattccttaaaaatgttggagttttacttggaattaaagtccctcgccccaaattttgcatcttctcttgtgtgacaagtcttacgtatcacatatgtcatgtataggttctcattttcagccaagagacatgtgtaacagggtagggtacaaatggcacctcttctgcaacacccatttctcagttttcttttcttgaccaaagcagaaggaagatcagttggcagagtgcattcgtttataagcccacacaactccaactgtggccaatcacatggtctccaggcagtcttctctgggaggaatagtgggtctgtcttccatccctcttcaggtttttttacttccttagctgggtcttgagaggacttgaaccacttgtctttaagagagtttagagtaataaacatcttagccaaaaccagaaatgtttcaaaaaaggccaatatatctctcagaacaaacagtttttctaagagaacatattaaacagccagtgaaagtgcttccatcacaggaggcctctggcatgactgccagcactgggaagtggctctgtcacaatcccagaatcattcccagggctttggttattggggtagacagtttctgggcagtgcattctgggctggaatgtggatcggcagggctgggagaggggacaagaatgaatatgagtatgagtatatatactcatatacacatgtatatacatgcagatttttcttctccatatacacagggtcatttgcagccattgcctttggccttcctgccttgctggaggtgggagagtagcggtcaagtactttatctatgtttgcttacttgatgcttgcaaaaaccctaagaggtaggaacatattagcaccattctctgaatgagaaagccaggcaaacaaaccagtttcaaatttgctggggttgacatagcttaaaagcatggtttcaattgctagtttgtgaggcttcatgaaatcaaacagcattgggggagatgaagggttaatgaacacaacacagatatctgtaactaaccaaccatctgcaaaaactaaatctgaaaaataggagagttttgctcagataagcaactaataaaatcagcaaaactcaagagcctcattaaagtattggctaccatgatttgacttgaagttggcagtactgctagttctgaggccaggtcatctgaatgagaaggcagccagccaaaagggccacttcttatttgtgtcctcagctcattttctgtccattagtcagggatggctgtgatttgctattgtggtttgcttttgaaattatttatatctcaacagccctctgagaataaaagaggtagggtaggagtaatttttaagtatataaagttagaaataaactcctrcaataatcttgatagtaatgactagtcaagccagccactcttctaagaatttcttacaaccacctgtgatacaagtgctgttgttattcacattttacagatgaggaaactgaggctcagggcaattaacagctactgtgtggggacagatctgtgttcaaacttgaatctgtctgacttcagagcacaaacactgtgctataccaccccttggtggggcaggcatttctcaagacccagagaaagtggaggcagacccctagttatgtcacaggtcattggccaagggcctgaaggacagacacacacactcatgctgaactctctctctcaaaacatgttttcgataggaaatagtccacgccttctgggcagcttcctagatctgtttactctgacaaatatgtttatgacttgggcaaagtacaggaaatcgtgacttgcatgtagactggaaaactagcaaaaaaaagcgagggggccttttttggagcaaataattatacatggggctttccgtacaggtgggtttgtacatagctctaactgtgatgtgcggatgagggaaagagaygcaggaccagggactttggattgggttctctaggctgccttccccccatgacacaggtaattcaaaaacttcctttgcctgcaattctggaaagtgtgggtgatgttgtgcttctttatccccagakaagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccaygaatataagttccgtgtacgtgcaatcaacgtgtrtggaaccagtgagccaagccaggagtctgaactcacaacggtaggagagaaacctgaaggtaggctgccatcacttcatcagtggcttgaaacaaatgtgcgtgactgaccttgtgtatgtaaagactgtactgaaaggggtgaaaaggaactgaggaaacattaatgatgactggcagggtcttttggggtcttggtttccaagacagtgatgttgagccattcttcaaaaaaagtattaatacttaggacatttcaaaaaacattgaaccagcaattttggcatgctgccaccagggggtgatggtatgttactcaggagcataggagttcaagcggcctcatgttcctcttccaccctccaccccttctcttctcctcttgtatccatatttgagtgtctacttggtgtcagattcttggaacacaaagataagacatggagcttaaaatctagaggaagagaggtgtgtatggctaactataatgagaagggatgcatcctattatagctgggtaaaaaaagaaccaaggggacataacaaaatgcatggagcatttttccatggagaccaaggaaggctttctggagaaggtgacacttagtctgagtcttggaaaaagggataggattctaaaaggcagggaagataaggaaaggcactctacaagaggaaacagcatgagcaaaggttacaaagccatggcagtgtgtgacattttcagatgctcrtgtgtggccaaggcatatgttgtgtgagacagaacaggaggaagtaagactaaaagggcattttaggtaaagttgtgaagttcatcaaagattctcaggcaggggatcgagacgattagagctggttttcagagaactagggaaaaagcagggatttgctattcacagtgcagttgtggaccagcagccttggcatcctgggagcttcttagcaagcagactcccccaggcccttctgggccttgactgaaaatgatccactccttggggattcagatgcacacgaacatttgagaagcactggagtggtgggtgggtcagaggagatgagactgcagtcagccatatcagatgggcctctgggatgacagtccaggggagggatggaaagggcacgaacttcaagcctcaggaggtagaagtgaccatacttgatgactttttgcatagtgagttgaggaagagaactggaagattctaagatgacttacagttcctggctggggtaactgaacacaaattcaagagccagctagaggtttattgttataattcaccatggctaacatgtattgagcacttactctaagcttacgatgtgttaatcactttatatgcatcatttcatccaatcccaatagcccaatgaagcagatactgttattaccctcattttacagataggagaaatgagatttagaggggagaagctacttgcccaaagtcacagagcttgtaattggtgaactgatgcttgaactcagagctgtctggcctgaagcttgtgctcctttggttagactgagggaagaggtcaggctgtcttccaggttcctgacttgagtaacttggaggttacataacagtctgggaggagaggggagctgcggtttcagccctgctgagttgaggcatctaagggctagccgagggaaggtatcctaagactgttgggtctagagcccaggagaaaggtttaagctagtgtggcaggcttggaagtcttcactatttaattaataattgcaaccatgggcattgataaggttacagagagtgtggtagagaaagtcaataccaacaccataaagaaggaacttgcagtaccaggagaaaggactgagaggggagagaaccaagaggaggctggagtctcaaagaaacaggggagggagaaggtgcaaagagggcttcataaactgcatccaatgctaaataaaaatgaaggagatgaggactcagagggtctttggatttagtcctttggttggtagtgatctttgtgatccaagtctgtagagtttccactgagtgaaaagatggttgccctggttaaggaataaatggaagaaagagaggccagaagcatggaatattatttcaagaagttttatgtgaagaacaggaaaaggacattgtaaatttaggataagaggccgggcgtggtggctcacacctgtaatcccagcaatttgggaggctgaagcgggtggatcgcctgagctcaggagttcaagagtagcctgggcaacatggcaaaaccccatctctactaaaagtacaaaaaattagctgggcatggtggcatgcgcctgtggtcccagctactcaggaggttgaggcaggaggatcgcttgaacccaggaggcagaggttgtagtgagccaagattgcaccactgaactccagcctgggtgacacagtgagactccgtctcaaaaaaaaaaaaaaaaaaaaagaattaaagaatataggataagaaaaagttgggggttaggagaaggtggagggacatcaagggaagagagctcttggagacaggagaatgtagagttgtgaggcagatggtagaagactcaagtatcaaaggagactgagctccacatgcagaatgtcacttgaaaaccaaaactgatcagtaggtgagaatgtatttgacttcttctaattacaaggaattagaaatcaagtgaggcaaatagtgaacctgagcaaagctcagaaagcgagaaagcgagcaggcctggcatcaccagggagctagagccatcgtgagtatggaaactgtcatctgattcaatgaccctgtttagttttgaaaaaamaattgaaaattaggtacaaaataggtattaaaattttactttcaattaaacaagggctccagaaagaaagaaagttagggtaccaatgggaaacataccaactttacaattttatgctagcagctgtgtgtcaggcggcctttacccgttgagccatgtcaatatgcatagagcaggtctccttgagagctatggtgcaagtcacggagacgtgatgcctgctcctgggacagctttcgcagggatcccaaccactagccactcccaaatgtctgtcaggggacactgagtaacaaaactgccatcactgtcttcttacacacacacacacacacacacacacacacacacacacacacmcaacatccctctgaaatgagcagagtgggggctgcatagagtgtgggtcccaggggggcaatcaagttccagtctgtggtgttaggatgttacttggaaaagtgacaggaaaaggagtaagattgcagtgtgaagatgttcattggctggaaaggaaatcatccaggtctgtgctatggtgtaaagagggagagactggagaatccccgactaaccccaggcagcaggaccagaggccacgggagctacaaggtgtggcccccaggrgtctaggacagctgctcccagggctgtgtggagactctgccaggaggaagagctgtgactgcctgtctggggcaagtggcctctcccttgttccctgccatcagcccgctgaaccctctctgggccttcagactcccctcccctgctgccacccctcccagctgggaatagacaaagggcaatgttgaaatcacttgaaatccagaggaggagtccagtccacccagggcttccagacaggaagctactccccagctgaggctggctggattaccaagggggaggaggaagagggcagaacagttggcaagtgttaggcctcagggcagaggactctggttgaggggattccaggcaaaagtcctccacggtctgctcagatgcttgttagttataaagcttcataggccatccctctgctgaagagggaaatggctctcagggaagtggcgtgtgtgttcacgcacgtgtgtgtgtgtgtgttggcagagaggtgggatcaagtgacaggtcattgtaggtcatttctgtggagcagatggggtgggatcatattaaaaaggcagtgctgattaacccacactccatgaagcccrgctaatgttggctctgaccttcaccactaccaccacagccactgccactcctgcctctcgctcttctacttcattctcatgcctcatttgcatccctgttggtaccctagccctcatcccacatccactcaccatgtgttctgtgcccctcctgtgttctaggcactgccatgggcactggggatacactgggggacaaagcatgggttccccgtggagctccagtggcttctctatgccagagccactcctaagactagggtccctgaactgacaatgyactcccaaacccaagtgcacagagccagaaccttaccacagccccgctccctcccagcccagccaggtcttgaactgtactcctcctcaaatcctgctgtcactcaaatccactccatccctgctccttaccctaatttgttctagtctgtataattgttagcaaaacagctactgtgactgaggcttcttgcagaactggagcctccttgcaacccccaggacagttcgagatataaagcctgtaccgctcccatcccaggctgcagctacgccctggcctcagaggccgtctccggggcgggggtgccctctagtgttctctgggtgtgcaacagtccttggctgcaggaagggacaattctctgtccaggggactgactggacttgtgccatgtgagggtcctgagcactcagctgatcctctcccaaacactccagggtaacgagactctcatctgtttgcagaaatatctcagaaccatcttccaaatagccttccacttagctcatggatctcatagctcattctgaacagattttttttttttttaagttcagtggaagacccttccctagtggaaagatggaaaccagttcacctttctcaacaaccctttatgcaccaagagctctgctaattgaactgtrgtctttcctctacttctctctcactcctccccttgtggtcaaatagaagagaggcaggacaagaagggaaaagcagaaggggatgtagcagcctggaatctttctcttttttaaagagatcgggtctcactctgttgcacaggctggatttgaactcctagacgcaagcattcctcccgcctcagcctcccgaatagctgggactacaggcacttgccactgctccctgcttagtccggactcttgatccgagtttcctgcagcataaaggaacacagtgcactagaaagaggggctggaattccttgagaatgatctaggtccttcccccagagcattagcatgagaatcagatctgccacagacctctggggtgagaggcgaaggtgaggcatggatgtgggctcatgagtgaggccagaggctggccctgtggctgtctacctggactcacagtgacaggcaggggccagctctaggactggatgcccccttcaaggcacgcagggaaagcctcctgctgccgggccattggcaagactgcttctcctgacaccaggccaggaaagctgccctctcctttccctctcactctgctgcttggaatacactggtctccatgccacgccgggaaaatgtggcacaggaacaagaaataaaggatgactcaactggtgaaccactatatcaggcagcagcaccacaggtcaagacaggggcctccctgacagtaaataggatgattctgtgtcgaagacctagtccagtgactggtccacctggtgtcccatcactcattgactccaatattgttgcttctcttaaaaccctgtttataatatcatcactgaactaacctaaatgtctattgaacatacttattattctagtggtacttctcatgtgtgagttccatatccctccagccttcctcctacgtgaggtagaacactaaatggttcccccaagatgcagtagtcatgagttgatgaaaagtctgaaactctcatctcatccttggcgattgtgtgattctctttaaagtcatgtccattttagacttctttcccaacctcagaggcctcaccttttctgattaagacatagcccttcccttcagtggtcttgcttgccacctccagctccattgtggcttttggactgccgacagccagagctccagggcaggcacccagggcgctctcaacagctacccagtactcacccctgtttggggcccatgcacactttgccctgtgacagcatctgacagcccaagcagtagattgaggagctgctgtttctgtcttgggtwttaactatggactttagggttcaccaccctaaaaggtagaatgatcagattctcctgaacactaactccattcctggcttctagttgcattgctctcaggtcatcctttccacctgtgaattggacaatgccactcttaactctccaacatgtggatttaggaatattgaccagttaggcccacatcccgacagtaaccgtgaaacccacctctgatacttcagctagactatctgggtgtccctgtctatctcatccttttttatttttccatggcagcttcctttctgtgataaaatatactttccaatcccattcatgtttagttttagtctttttttaaaaaaactaagctttgtcagcagcattttaagaactctaaacacactcacactcacactcacaccggtacacccgcactcacactcatatgcccactctctctcacacacacacacatacacacacactcacactttaaaaatccttttcctccctctatgctttctctcctgtctttgttttgcttccttgggaaacctcccattcattgtccagctgtcagccaggacgcagcccagacgatggctgaggaacacacagcacatgacgaagcgtgrcatccagagctagccagggccagagacatcaggtgcaacccttcctcttacagatggggaaaccaaggcccaggaagggaaaggcaatcagccaaggtcaggaagccagagtggctcgattgtcaacaaacaaacctgtatcgaggcaaaggaaggcctggagctctgaagtgggcrtgctgtgctggatgcccccctgttccggggaacccctcctgttccccggaccctgttcactcctgacacggccatgggagcagctggcatgactgtgtccctccctgccctgcctcacaaatacctattggtttcatttgtgtgacatcactcacgccttcattgtattccatcatttcctgtaagacgcaactcaaaggctatttcttctaagaataattgctctcacttacaattgcaccattttgtgtcaccctcctctgttgtgtattcactttgaaccatggtgatatgtgcgtgattatggtacactttgtaaattgttacttcaagtatatatgtttttgcctcttgaactaaattataagctataagaaaggagagaccatgccttctgtgtaatatgttttgaatgcccacaataactggcattcaagatgcttggtccagtgctgggatgccgtcaacaatgttcaatgaatggctacatggatttgacactagaagcagttataagttgctgacttttgagccagggcagaaagagactgtcacagttgtgtgtaggttctgaaagtcagaaagggttggatgagatgtggagaagggtatatctggggaccatgaggctagagaggatgggacagaggggagacctggtggagaagtggagctgagtggagggaggaggctggcacctgccagtctgcactgggccctatttgctatatggactgaccagccccaggggatgcccagagctctggacctggtagtcgtctgcctggggaggctgaggcctggcagggcccccagcacatcttgctctcagtgggccttcagtactaatcacctgtgtcctctctgtccttccttgtgccccccccagagccgaaggatgaagtggaggtgtcagaygatggtgagtgcagcccctgtcttcgggtcaggctcttggggtggagggggctgagtgggggcatctgagactcacaccaaccctgacctgtgccccacagatgagaaggagcccgaggttgattaccggacagtgacaatcaatactgaacaaaaagtatctgacttctacgacattgaggagagattaggatcgtaagtggagtgggaagttgcctctgggctcccagggtgagggtggtgcgggtctcacagttagattcagtgcctcagcttcctgttgctccctggggcctscctcctccccagactgagagtcctgcaggatccaaaggactgacscacgaaagcatcactcactcacccaggactctctgcagagttgcccatgcggtcctacactgccccaactctgcaaaggctgtgggcaagtccttccttttctgtgcctctgttcagagcccaggaccaaaatgagacacagggaggggaataacactcactggggcctgtcaggggagagcagggggtgcggggagcagaacattagggagaagagctaatgcatgctgagcttaatacctagatggtggggtgttaggtgcagcaaaccaccatggcacacgtttacctacgtaacgtacacatcctgcacatgtaccctggaacttaaaaacaataaaataaaataatttttaaaataaaataaaatgagaggactggatcagattatctttggcaccccttccatttgatccacagaagtcagtgtagcctgatcagtgctcactgtaaagcaatgcctgcgttagtgctccattaaacgcgcagcagtcatcaagctccctcatgaacttggctcgcactgcttactctggcttctccctagggcatggaggatagagtgggctcagaccccaaccctgagccaagctgttcatctgcccttacgctgtccctggaggaatagaagaggtgggagagaaaggagtgggactccacttgtatttccagtggtttctgggaaatgaaggagtgatgcaaactgggtaacagtgtcagaaagaagtcagtgccatcacagaggagccccactctcccctctctcagcagtaggaagcaggaccctgcctgggccatcaccagggggtcagtggtagggagtggaaggaaggaaggcaactgctcagtaatactctgcatttgggaagggctgtctccacccatcttcatgggttccactgcagggaggggaagagatgccatcagccaaagttgacagtaggcttgtcaacattagaaatgtgcttcaaaggccaggtgtggtggctcaygcttgtaatctcagcactttgggaggccgaggtgggaggattgcttgaggccaggagttcaagaccagcctgggcaacatagcgagaccccatctctaaaaaaaaaaaaatgtttaaagataagaaaaaacaaatgtgcctcattgctctagagcaggagtctgggcctttcataaaggctgatatcttagattttatgggcgatatgcctttagctctgccactgtagcacaaaagctgccatagacaacatgcaaacagccaggcagggctgtgctccagtaacaccttacttataaaaggaggtgggccagatctgtcccatgggccataatttgccaaccccaagttagcggaaagcttggctaaatgtggcttttctctcctccccctttcatttgcagtgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatgtgagtggcccactgccagcagcgtgggcaccacagggagcccccaaacgtgtctcccctactgccctaccccagccacctctgccccaagatggaaagcactgcagacaggagtgtgatatgtaagatgctcaccagccatacagccaggcctgaccaaacagaaccgaaggtctgtgcacagtgctggccctgagcctctgagcaccagcccagctgcagccttgtgcttatttccaaaacaaaccagtagatctttgaggaccctggtgtctttctcgccctcatctccccatgaaagggccaaagctatccctaggctccttggtttcatttggggcattcacacctgaaggtggtttaggggagggacagggcagcttcctgacttccctgtgaaagataaggggrcccctggctgggggcttgaaatccaggatggaagcctctctctggtcctcagtcccatcctgtgtctccacatgcccctggtctactcttgtttgtactctttggacttctcactcactaaagagtggtgctttccctatggggttgtacaaaggcagggggattatcagatgacctccagccaagcctttcgcagaattcattgtttcttctgcacctgaatcctccacctcccttacctctgagctgttggtgcatgcgtgtacacacgcacacacacacatgcacacacacacacatacagtcaagcatgcacactggcatcagcaagccaggcatcccccacagcatctgcattcttaacagtttccttttttatctgaatttttagaatatatgctacaatcacctcaaaaaatattaggaaatacacagtgaaaagtctaatttccaccattattcctgtctatcctttcctaaacacyacaaccatcaccaacacaaacaattttattggcttttatctgtatccttccaaagtttctttatgaaaatataagtgtatacagacacacacacacatatatatattcttattttcttgccttttaacacaaaaagtaacttcttatactcactgtcatatactttgcttttttagtttggtttgtttgttgttgttgttgtttgagacagagtctcactctgtcgccgaggctggagggcagtggtgccatctcggcttattgcaacctccgcctcccaggttcaagcgatcctcccacctcaccacaggctcacgccacctcacccagctaatttttgtatttttgtacagataggatttcaccatgttgcccaggctggtctcgaactcctgggctcaagcgatccatctgcctcagcctcccaaagtgctgggattacaggcgtgagccaccgcacccaacctactttgctttttcagcaaattgctatgggagttagtcccatctcactacctagtgagcttcctcattctcacagctctgtggggttttgttgtatagaaaatcacaattcatttaagcagccttcttttgatagagattgagtggtttccagccttttgcttttacaaacaagcatcgtttgtaaccttgtacacacatcttttcactcatgcctgtgaatatctataggataaactcccagaagtgaaggagagctgggttaaagggtatgcacatttgaaatctttagagatattgtgaaattgctttcaacatccttgaaatgctcatcctgaacttggggggtctctgtcctttggtgagggctctgttagcatcttggaattctctcccrggaaagttgagtccagtaagacatccccaagctgtagatatgagtggaatattagtcttttctctcccctcatgccattaacattctggcacacaagtatttcctttccgtatgtgttccttaggaaaggcaatagtagttccgagtgtaggcttgagtcagatgaaccttacttcaaatcccagctctgcttctaacttgttatttgaccttgagtaagttattctattgtaccaatccctagttttattatccataaatgtagatacgacacccacctcatgaacgctgtgggattcaatgcaataatgcatatagggcacagtgctctataatggggagttattgttagtagtatgatacattgactttttttgtatcctggtttttttccacttaaaaatactttttgagcatttaacttccaacaaggtgttgtggaacaaatcctccctagtattcaggaagcctggcttcagtttctgctactattgagtcatgattttgcaattgtcaaatcctatcagcacgaagaagtacttggattagaacagtcaatctcaagatgccccttttggttataaaattctactatttcatggaaccataaaagacgcggtgaagaatttccattcgtatcttacaatctacattcagccccaaattcaaatgttcctccccattttcaggaaatacgtagcccacatctgtgacctcattctttacaccctcacaatagccccgtgggctgcatcttttcacatttattctagaacaggttgcttagtccaggcggtgtgggcatgtgaggacatgtggagaaatgtcttatctttagaagttaaaccttgagcaagttgagagggtgcagggagggcaggagtcacagggcctggggaaggctaggcagcagcaccagtgggcagaataccatacttagcttggaattgggagttggcaagctggatggaaaaagcaaagagaaaatgtaagaaagcttcagctagtctggctttcatccctccaccccatgcctcccctgtggacagcagcaggtcttccatgcccagataccagaaaatttgcctgcacttgggaccttggccaggtcgccaagagtaggaacttggtaagaactcagtcaaccaaagaagaagggaacaggttcatactccatctatacatcccttccagcttaaacactctaagacttgaccactgagaagggaaagaatgattttcaccagtgcaatgtgctaaccttgttggatggagaaactgagattaaaagaaggatgatgcctggggatagaataatggaaatgtattccagggtcccwgccttaagtccagttgcttcagatctagtgggaaatagtaatgaatgtgtcttcatcctttctgacttctgattactggatgagcccccaccatatagtagttggtctgacacagcrgttccttcaggcccctggcctacttgggcttgtccttttggaagtgcttgggacattccaggtggttgtgggaccctgagcattgaagacaatgtgaagtttaagctgtgtcatccatggctcatctcatgtttgtgctactattagcaaaatttatcaaagaacgttccagctggctgccatagggcaaggagcggagggtctcgagtccagtgatagcaccattccttcttgcttcctatgagagctagccaaggtctagggtttgggggatgaatctgattccttaggatagggatcacttatttatttagtcattcactcactcaccattaatttaagcctaatcttggcccttggcattatcccattactgtgggtggcagtttctgtctatcaaaccaatattttccacccatagcattaagtattttgaagataaacccacagaaccattaatcctgcctctttaaycccttccatcttagaaagttgaaccataggaacagttttcaaaatataataagtatatctgaataggattgaacctatttgaatttatattgaataggtttcctccagaaatgcagcaggaattatctccatggctcagattcccaccactcactgcctcagacattcccaagggcattgaaaacaatggttgcttgctttttcagaatatttaaaatttaaatgtaaacattttggagcaccttgtctgtgccaaatatagtcggaggcaaataagggtctagagatgagcctgccacctgtgatgtgttcagaacttcaaggcaaagccaacttgatacacaaagtgcggagacgaggccatggacataaggccatggaaagtgcagagacaaggctatggacataaggccatggatgcccagtgagggaaagatcattccatgtgaagaaatggggagtgactttttcagagggcgtgaatttcagctggcctcccaggagtggtagttgagtaagccagtatttctcaaacttgtctgatcataaggatgacctggagtaattattacaaatatagatcctcagatctctcccaagactttctaaatcaaaatctccagaggaggagcttgggaatttgtatttttaataagagccccaagtgattctttacatagaaaattgatcattaatattgagcattgactgtgtgccagacacttccaagcactttacctgtgttgactcatttagtctttgaagccaccctgtgaggtgaggctgtttttaatctgcatcttacagatgaggaaaatgaagcacagagatgttaataactggctgagacctaagaatacttgtagatgagagtttgtcttggagccttggcagagagcaatagaaatggagggcataaggacaagagcgccacctgcaggccatttggggaccttcttctcagatgggttttaaagtatgagttctagctccctccagctgtcactggcacagactgaccttctccagttcagcccttccagaagtgagtgtgtgtgtcacgtggcagaggctgtggtatgctgggccccacagtgcatccctgtctctctcctgcaggggtcagtgacaagatccacctagcccaccacagcttatcaaacgataagtaataagtgttgagcaccttctgtgtgttaggcatgatactttacaaagcctcctacattcctaaaaactctatgaggcagggatagataaggaaactgggactcagaaaggttaagcaacttgcccaatgtcacacagctcataaaaggcagaagcaggattcaaactcagctcctttcctcttcgtgaggactctctgtaggagaggaaatacccttgcaagaggacaggcccagaacccacccggccttgttcaactggtggacctacaggccactgcagaaacatgagcttatgactgggtgacagagagagaccctgtctctacaaaacattaaaaaaattagccaggtgcggtggcacatacctgtagtcctagctacttnnnnnnnnnnnnnnnnnnnnctttttctttttttttttattttcccttctttttcttttctccctctcctcttcccccctctttatttttcattcccctttttctccctcattttattcttcttctcactctctcttccttttctttttccccctccttttctaatccttttttctctcttctttctctccctcttaccctttctctcccttttttttcttcttttttttctctctatctcttcttctccccccccccctaaattctcccattctcctctcctctttctctttttttatcttcttcatcttcttttcctccctaccttcttccttttccttctttttctttttcttctttctctctttccctcttttttctactcgccttctttttccccccccccctctctttcccttttttccttttccttctttttgttctcctctctttctctctctctctacttttttttttttttcccccccctctcgtgcctccatcctttagttacaatttctccccgtctctcgctttataataaaaatattcctcgactcccttttttttttcccttaaaaaaaaacttctcctttcactcctgtaagacagtccaatcccccctttcattctctataaaatcccaaccaagcaagatgtgcgcggacgtgcgttggcggctcggcgggtgccttgggcggtaggtgtggaagggagggatggaagagagggagggagggaagagagggacggagggaggaaggcaggcaggacagaaggaaggacggaaggaaggaaggaaggaagataggtaggttggttggttataggccaggcatgatggcttatgcctgtaatcccagcactttgggaggctgaggtgggataatcgctggagaccaggagttccagaccagcttgggctcccctcccctcctccttcctttcctttctttcacttttgagacagggtcttgctctgtcacccaggcttgagtgcagttgtgtgatcatagctcaacataactttgaactccttgtctctaccaaaaaaaaaaaattgaaraagaaaaaaagaaaagcaagcttactgatatctgggtgctgcataagttaccagagagatgctttaaacttgctaagcagagaccaagaaaggtgggtcagagggctaggacaggggaacagagaggactcatgcaactcaggcggtggggccatgcatttgcactgaagggcaatatgctgatggctgagaccccggggcagtccctagcagaggatgcatgcctgtggctgcagaagcaaagttcactagaaatagccaggatccaaagcctatccagttagaaaggattacacagctggggtaaggaaggggtccaagggagaccagttaattatgactgcagggagtaaaccaatactataggcctggccagagtaagcaaatctgtcacagctgtaggtataatgagttacagccaactaattttagaaaatttgctgaggctcattattgatgattgaagatatttttccrttcctggctatgcagaacaaatgcttgtgggaactgtgagtattttgaacttgagttccctgtgactaaaagacacggctagagtacragaatgttcccttaggcatgtgtggtcatttgagggaaagagacygtttagaggtcactctttttgctaagaagatcatgtctggatctctgtgttcacacccacctctgaaactgcctagtgtagatgcttccctgagtccccagcagcttagaaggtgcagggcagggttccctgrtgggaaaccaggaggccctgacccttctcccatgtcggarggtggggattcaggaattgcccatcacccccattccctgggctttcctgccartttctcctacccccagcctaccctggccagactccstgccagcctggcctccatgagcctgtggcctgaccaccccrtgcacgtgttcccgcagcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctgggtaaggctcatctgcctctcccatggacaccagtgtgtattgcactggccgtttcctctcacactgagtgtgagaggaaacatacagtattggggttaaatccgagaccatgaagacttcccaggtttgaatcctgcccctaccacatactagaygtgacagtaagcctcaaattccccatcagaaaagtgggatcatagtaggacctaactcacagatttgttaggaggatcaaatgtgttaatataggtaaagggatgggaagagtgctttgcacatagtaagactgcttaggtgttagctgtatatatgatgatgattatccccttttgtttttcactctggtgccattagcagcaaaagtcattttggtgatggtggctctgcacatctgcatcatactgtacagtttctagagcactttcacataaaaaataaaccctatgattctcaccatgaggtgagcagggtagattttatgagccccaacttgtagactaggaaacaaaggttcacaatagctttgcccaggaggtcccactgtgagccaggggatgtgctgggattggaacaaggaccccagaccttgctcagggtgctctgcagcacctctgattcttatgctagccaggagagaggtcacaggggtaggcggtcagggtctcaaggccgccctgaaagcactttggtagatgcctgcctggctcacattctgcctgcatccagcctgcctctgcagccctttgatgtcccggtgattgaggaaacagcttcatcctcccttcttagccactgccctgctagcaaggagcccgagggctggggtgagctggctttatttcaccaccctgcaggkagtagaaaggaggggccaaatgaatgccacccaataaatgtctcccacgatgttcagtgctggctgaggctgtgttggtcataaagaggaaaggggtaagcaggggcgaggttccgatagactatgaccggtctggtggtcagcgcagtcaggtgagaaacatgcctcggcgctgggcgcatgtgcctgctctgctctgctcactcctgctaagaggacagggtaggggcagtggctggcatacagggcctgcctttgaacagtgaccaccaataaattaaacaaataggccactgtcctcaggagtcggcagtgtcagagcccagggaacacaatgtccagcttccactggtgagggatactgtgggaacaaccgtgtccaccaaggaccagataactgagaagtggctaaaatgtagcagaaagggctgagaggcaggaattggagcagagctttcacatctgagggctgttaaatgctttgttttagaacatttgctgtgagctctgcgaagttaagcaagaccaggcatagcccacaggtacctgccttttgcacatattaacagacatctctggtcctttatggccaagaggtaccaccctgggsttgaagcctctcccgactaccctaccagtagctcctgaaggacagccatgaagctgtgtgaggagtaggagaggcaggagggaggaacggtggtaagcatggctcaggagttggactacctgggcttgagtcccgaccaccacttgttaaccgggtggggaaatcactgcacttccctgggcctcactcatgttctcagtagcacgggcattatacctaccccttggggtgggtgagaacccttgtaaagctgccggtggggtacataggacatagtgaatgctagagattattattaagcataagtcacagtccctgcctaggggaactaactcatgagacagactcacaaaaagaccattcaggggcgggtgatttagcggcctcttctccccctgcccaccctgcacaggacatttgaggtgagtgtgaggtttgttggtttcactggtgtgttgacgcacctgtttaacaaggaggtcagatgtctctgtgcctgttctctgtgccaaagcctgtgtctggcccctcccaggttggggtcaacacacagattcgggcagctgctggtctcaagctggctccgtgatgtgctggcaatttatscctctccatcctggtttcagagaaygcggggtctctgaaggtcctctttggcaccccagaatttgtggctcctgaagtgatcaactatgagcccatcggctacgccacagacatgtggagcatcggggtcatctgctacatcctgtgagtcctggggcacttggtggactggtggaccacttggtggaccagtgggtgggggctgagggttccacaggagggtccccaggctgccctgccattgtcatgatggggagccccccccagagtcaggagggtggcaggctcccctcctatccctggcagcccaccctgctcctgggctcccagggagtcagtagcatgcatattctatagcatcatgtagctacacatgctaagatccccattctgggtgctcactgtccccaaggctggccagcctggggcctttggtcaggagggtgggaaatgtggctggcaccaagtaataaaacctcacttgtgtgggtycacaaagaaggagggcaggaggccaggggcgaatctctgggcatcctcattgtcttcagggcatagcactccatccccaaggcayggggaccccaactactagcctcatctttgagtctagtatatggatgaattaataaacactattgatgatcgagccttcaatgggactaacagataaaagaaagtaacacagtaattagaactgaaaaatcaggtgggaaatccaaagccatttcaatgaacaataatgcaggagaggggaggccagccatctaggccggcacttcacaaacattagcatgcctgactcacctaggcggctccttacattgcagggtttttgttcaggtctgggtgacctggaatgccacatttctaacaggctctaggtttgtgaatgtgctggttcaacgactgcgctctgagtaacaaggcttgagaacactctgtcggtggggtctggctgctttagtccctgaagccccagggtgcggacggtcattagcccctgaacctgtgtggccacatgcagttatgggatggtgtccccaaagatgcagatgtgtatgctttcattcaataatgtttttactgtcagaacaaaaggaaaaatttaacattttcatagaaaatgaggaagacctctatgaatactttcttagacccctggggccttcagactccagtgtgagagaaggttctgggcgattctgatgcatagccaggtttagaaaccagtgttataaaagctttagcagaagtggtgtgaattttgtgcaatgtgactttttcacatgctcaggaactttactcactatagcctgttaggacagtcccctcagtggaacctgcaccacaggcattgtagtccagacagttatcctctttcctgcctgggattagccccaccaccacagccttccccagatcagcagaaaaaccccgggccaggtgtgcatttccctgcctgtttccctgccccgccccctcttggagaaggggcgctgacaagtgaagacagcagctggactggagcttgactccctggctccctagataagtaaggaacagcagggtagggggcggggccagcctgcccctttcagggcggccccaggcctgggcagtgctaacctctggccctgggaaaaacaccagacccttgagaagcagtccttggtcagctctcactgttcagccccagctgcgctgtggtctcgcttggtcccagggtccccctccagccgtcatggagacttgccttactgtttattcttcagtgggttttcccactgccgtggcatcaggatcttctgcagctacagattttcacataggaccttgtttgatgctcacaacaaacccaagagtggrtcatggcagggattccatcttcatgtggcgttgaggtgacaggggccaaggaagcccacgtggctgcccacttcccacagtcgggccaggggaccagtcgtcccagtctgccaggatacaggacttttggtgctaacatgggaacagtcccaggcaaaccaggacaattggtctctctactggtcagtgacagagcagtgactagactgctcactaagttttcacctgtgtaacctctacccggatcaagaaaccaagcactgccaggcccccacagccctctggcacccctccctgttaccaacccccagaggtcaccattaccctcaaggctaatgtcaatgaaatcatacagaaagaagtgtctggctttttttgcttgacatcgtttgtgagactcattcatagtactatgtgtcattgtagactgtttattctcagtgttatgtagtatcccattgtgtgaatataatccagttaatttatccgttctgctttgataggcttttgagtgggttccagtttggccattggaagcattctggttcacgtgtttcagtgaatatatttgtacatttctgttggatatataatctagaactagaataattgggtcatagggcactttattgtcaaatgagagttcttttcggtggaggaacatagtaatttgggcactatgttaccttgtttaccagattacttttaaagcaaagaccaagaactagggcagagttttggaaatggggagaagatagttttgatgctgccagtgcttgggcagagggttgtcaggagggaggaggggtgtgtgtgtggcaaggacccaggccaggtggcactgactcaggctggatcaatcctgtgccacatcttagctcctggacccccactgtgagccactgccctctggggcttttccagcctggctctctcagcatggatggaagtcagggagttcccccggcaagccagggctctcaacagagagcggtgctgaaaacaaacattggcgccaaggagatggtttcctttaagcgcctgctatgcagaactctggagccactgctgggagcacccaaaagaggctctctggtggccctcatggcatcctctggcccactctatccctctctttggagcctagtcatctgtcgggcagtccctgtcagggcgacttccacctttgtaccacagagcccctcctgttctcctttctggggccagtgagagatggagaggccagggagttggaagggaaggcaacagaccgtgtcaccataggacgatgtgactttactctctcccacccagcccagccatcagggcagtttctggccctatagggaaggagcagaatggggtcgtggagcccccacactcttaccccggatcctgaaaggagatagtaggttgtgtgagtacctagagaccttctgaagttagcaatasccatgtggtttctggcaggaagtgagaataccagagagctggaggccacacttccatacgggagaaatcctaagtccacctccgtttaagagccctcctccccctgctgtctccctcccctacttcctggacttggtacttccttgctgcctgtggggaggccacaacagctcttctccgagcccttccctcaccctactccacaatgccttctctcccagcctccctcaagccagagcgaaccagcaatggctgctctgcttcctcctcctgcctcttcctgaccaggcccagcagcacagccttcccattcatgcttgtttgtttgtccaacacccaccgtggtgcagacagctgtcagctgtccctccccaccctggtgtgtggtcgggagatgccaggagggaggagaggtgtgtatggtggggaggcaggtcagctcttctggtgacagctgcccagtcagctgaggaggggtcacagtgccggggcatcgggggcctcctcagaccagggtctgactgcagggctcctcagccagatccagtaacctctgccttccccacctggggctgccgctgccctctctgctgctgagcctggaaatacgctctgattccagccctaggatccctgttccctctccaagcccggccaccaccttcaacttttactaacacaactaaaccccaggtcgctgcttcctcggccagtccacaaaatgatgcacagctcttcctgtggacctactcagccctctcagctctcccaccagagtatcagatggctaatatggataaaagactaaccccttcctagcagtcagtagttccatcagcagatgtgtggtccccttagctggccactggtacagtcggggcatctgtctgctgcttgaaacacaacacagaagccaggtgcagtagtgtgcacctgtggtcccagctactcaggaggctatgatgggaggatcacttgagatcaggagttcaagaccagcctggctgatatagcgagacccccatttcttaaaacccacacacatacacgcacacacacacacagaaagtgtagtccaagaggcatttctgcaccctctgctctcctaaccttctgcccccacagccaaacaggcttccacatcagattccctgggggaatttctttggcaatgagctgagaattaagaaattagaatgccctgcattcatgaccattgtgtttcatcagcacaaagactaatatttgaccactaaaaatcaacatgtagagtctggctgtacttgatacatccagtgaagaaaaagtaaagcatccaaggacttgcccagactgattatagttttgtgaaaaacagatcaatccattagttaaaaactagataagaccagggagataaagaggtgttttaatgctaacattatttgttgaccggttgatttttttaacaaataatgactgttatctagctgggcgcagtggctcatgcttatactcccagccctttgggaggccaaggtgagtggatggcctgagcccaggagtttgagaccagcctgggcaacatggcaaaaccccatctctgcaagaaatacataaggtagctgggcatggtggcgtgcgcctgtggtccctgctacttgggtggcttaggtgggagggtcacctaagcctggggaggttgaggctgcaatgagccatgatcacgccactgtattccagcctgggtgacagagcgagactctgtctcaaaaaaataaaaagaaataataataatgactattttataaataaaaagacaaggctgggcacagtggctcatgcctgtaatgcrctttgggaggcagaggtgggaggattgcttaagctcaggaatttgagactarcctgggcaacatggtgaaaccccatctctaccaaaatacaaaaaattagccaggtgtgttggcgcgcacctgtggttccagctactcaggagactgaggtggaaggatcgcttgagccagaggttcagtgagctgagatcgcactactgcactccaacctgggyaatagaacaagaccgcatctcaaaaaaaaaaaaaaaaattaaaagacatgatcccttatgcaaattctgccacaaagaaaaagttccccaaaaaggtttttaaaaatcctgtaaaaccccaccacccagcaacagcattactgaaaattcaaacaccctctttgtcaacatgctgtgtatgtattatattttttattccagacacaygctctttaataggaagaatgctgggggaacttgggcaggcaaggagccaggcagggtgaggagagtatttcagatggataggctgccaggaaggaggagtgccagaggccagaggcgaggaggctctccctgactgtgcccagagttgcagagattaagacctatctttgcaggaktatagttcctaataaggaarggaggtttgcagaaggggaactttctgcattccacagcagggttgtttgcttttcctgccatcttttggagtactgccggacttcccccctctctgtttccagtggaaaatgtaaagaagcagcaggtggctgacaggcaagagacaggctgcttcctgatggggcttgcatgggccacgtgggggtcggggtcacagagacagagagagctgggaggcccctaggaaatctagcctagtccccttgatgtataaaaggagaagctggctaggcgcggtggctcatgcctgtaatcccagcactttgggaggccgaggcaggcagatcacgacacgaggtcaggagatcgagaccatcctgacgaacactgtgaaaccccgtctctactaaaaatacaaaaaaaatagctgggtgtggtggtgggcacctgtagtcccagctactcgggaggctgaggcaggagaatggcatgaacccagggggcagagcttgcagtgagcagagatcgcaccactgcactccagcctgggcaacagagcaacactctgtctcaaaaaaaaaaaaaagaaaaaggagaaactgaggcccagagaggggaaaggagcagcagataacagtgcagactcggggacaggtaaatgcccacccttccctcatggggacatgaccgagaatgattctctttgccttcttaaaacataaatcagggtcttgctttaaaaaaaaatcccatccacaaagatctattattcagaaacacaaatatgttgattaggatgagacaattcacattgtaaaagctttcttctctttacaaaaggtttcaccagagggttcctcccatggcaagctttttctcccaatatttcaagtggggtttgttctgtcaaactcaaccaaagccttactcctgaagctgtcagtgcttggcttatgatgatggattcataagcatttgggagaagggacattggtaaagccctaacttgacaggttgatggcaggagggccccagacccatctctctttttttttttttttgagattgagtttcgcttgttgcccaggttggagtgcaatggtgcgatattggctcactgcaacctccacctccagggttcaagcaattctcctgcctcagcctcccgagtagctgggattacaggtgcttgccaccatgcccagctaatttttgtatttttagtagagacaggacttcaccgtgttggccaggctagcctcaaactcctgacctcaggtgatccatccattttggcctcccaaagtgctgggattacaggcatgagccaccacgcctggcccccagacccatctcatggggctcagctgagatcagggcaggaacagctacacaatttgcaacatgaaaggtggggccacttgttcaaaccttattgagaatcttgagacgacagcagcagagcattaaaccaagcmcagggcctgtctaagggtgggactgtgggcaactgtgctggtcwaacacccatgaggctgactcacaaggccctcatgaacagtggggtgagttgttgctatgaaggtgaggtgcacagaggtgagaggtaaggtcagtaagccacaaatctgctctattttgttttgaaattctttaccttataaagtttatttggcttaagctgctggtcacaaagtcattcctgyactcacagcttggtaaggcagtggagggaacccagcagaactgcatgagatctccgggcatggaccgcctccttactgtggaccaggcctggtgccagtgctgaacaytgcaatttacttcrtctttacagaaatgttaggatagtatagcatttaagaggacaggctctagaggcagatacctggcttccaatctcactggctgtgaatctttgggcaggtgacttgagcctgggctgtgyctcaattccctcatctgtaaaacaaagttataagaattacttgcatcatagggcagtgttaagattaagtgagttcacttgttttaggcacttgacccagtgcctggcacatagaaaaacctcaatgaatgtctgctgccatcatgatgatgatgaggatgaagaagtgaccaccctatagttaaatggcagcttctccattttagaggagaaaactgacacagatcagggaattgtccaaggccatacagcaagcggagaggctgcactctgtcctctgccatggcacctcatagggaagttttctagtttggcataaatgcctcaagttccccgaacctacattgctgattcaaagtccatctatccattgggcacacacttcacttgctgagcctctcttatttgccgggccctcttcttggagctgaaggtgtgtggagagaggtgggaaggaggggacagaagggtgcagtggtgatcactaccatgtgcccagtccacagagagggggcaggagcacgggaggaaggggcttggagaaggctctagcctgggctttggggaataatagaaaaccrggacagagggacttatcagccctgccgcgtaccctgcagaagcccgtaatctaaagccaacctgctgcacctcagcctcacaggtaggtggtgtcaagaggcaggtgaccaagaaaagacagggctgtgaaccacaccctcttttctttccacaagtggaagaaaggcaggtgcaaggcccacagagcatgagtttgggggtggggaggctggccgaccctcgcctttgacctcagttaccactcacctggtygtcgcgccctctcctagccacacctgctgtcctgctcttgtctctccagagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaagtaatgagttgggatttcagtctttgcttccctactccctgccctgtgttgggaagcaaagggggattcctttgcctgttggggtgccctccttgccaccccgccttgggtcgttcctagcattccctgaggaagggagggygggcatggtaagagacccgaatgcatgtgggttggggaggcgacttcctaggccctgccccctggagctagacatgggattcaccttcagaggctcagacacctgacttgaaaagcgacacttgaccacgttacagagcaaggggcagctgttctgtgtgaataatgaccacccttcttattttctgggtacagttgtggccagccacagccctcttcaggggctgcaggggaaggaccctctcaacaagcaagagcagaggacacgggcatcttagaacttctctgtgggtcccgatcatatccccagattattattattattctggcttagtgtttttttatatctcagttatttaataactgcctgcttgaatacagccaggtacsttctaacatctggccaaagggaggctatgatcccagaccactgggcttagccctctcccagctcctcctctgttgaggttccccacctgtgcctgctgcagctgtgaacataggaaagtgaacagtgggaggtcagcatgcatgggctgtggggaaaggtcaggcactcaagccctctgggtttcagtagaagattggagcttggagttgtagaggagaccagagtgggaggttggctgaaggtgggcagtgggtgtgcctagacagaatctcctggaaggaactgtcctgggctctgcatgtgtagggagagctgcccagggaaagggagcagtgggactcaggtgagaacagctggcctattgggcagctcacccactctgcaaataggtgactagatgaggcagggcctgactgtaggggtgccgaggagcttggagctatacttggcaatcccagggagcagttgtagccttgccaagaagggtggtgttgacatgggtggcgtgctagagagaaggggaggggcctggctccagggcgggcaggaggctctgcactcccaggtgactttgcagccttgcggggctgccgatggctcccctgaggaagaatggctgttcggkgcaggaaggcacagttagttgctgaaggagcaatattggagtgtctcagatggctctgtcaggctttcctgtgatgcaccccactctcagtcctttttagccagttcagggccaaactcccccagaggccacattctacactccttgacaatgagatctttttagccttttgctgtcacagtctgtatcagaaatgggcatgacccaaggagaactgagatactgtgggaagtctaaattctcttccaatatgagggacccccacacccaaggtgcctcaggagatggaaacctcctcagtaactctggtacaaggatggcttttgtcatccaagctttattcactgaagatttggtaaacaaggtattgtgtgtgtatatatcttattttctcatctgaccttgaattaagtcagtaacaggctgtactggatccctctgtgctcataaaatggattcaccaaagaactgatcttattcaaatagatcaagacactaaattcccataaactcttatacccagcctctcttcaaccagaaatcaccacctatcagcacttaaaaaaaaaattccttcctactataaaaataatgcatgaaaattatagaggatttgaagaatataataaaatttaaatcatctataatccctttatctaaagwtcactacattttgctatacttctttccagtcatttttctatgtatgttagcatttggttctttaggctttcctagtcctgttacagttaaggcaatggctctaaaatgtttctagatccccagagctttcagaaagatgaagtgagtttcagcgcagttctaaagtagtcataattcataggttataggcaggacctacttctttgagttgtaatggaaaaacctgatattcaacaacaccgtaagacattaaacatgaaagttcagtgattgtcggagattttatcctaggatttaactctcccctcctccagacagggtggcaggaggattaggctttgtgggccccagccctcatgagaggagcagaatgacgccaccctggaatagggtgccagccaatcccagaaacgtctgccctgcagcacttactcttcctcgatcccaagagcaggccatggagcccagtcacttccttggtgcttgggctttcattaacaccaacccatgcyggttctggttagtgtgacccagaccaagtgaggagaaaggtgaagagcacagtgatcctgatcacggtggatggtccgggagcaggggccctgggctctgccctcatgaccagggacaggtggcctcccatttctgaactaaccagtggtctctgaggtctcctcctgctcaaaaatctcctgatctctgcctctgtcagaaaccgcctggactgcacgcagtgccttcagcatccatggctaatgaaagataccaagaacatggaggccaagaaactctccaaggaccggatgaagaagtacatggcaagaaggaaatggcaggtaatgagagggtcactttggactgggatgttgcccctcatatttgtgttgttcaagccactttcattcccagcttgccctggcctcacaccaagaaagtttaaatttatttctgaagtagtctgggaccaatttaggcagctgattaaggtacagtggtttgcttagtcctgagtgcagagtccctttctcaaggagatgggatggattcttagcttagctgtctctctgttcctgctcacctttgccccaggggaccgtaaacccttattcagrttaagccaatgacattttgtgtcttcatggcttgggatgagcaacatcactttaaggtccatttgtcaaccctgagaatggggtggtagtatggtggtttcacatttctttatgatgaaggagggcacatgatctaaagagagagacatggtcycaccatctaggaaggttgtatgttaatagccatgtgtccttagcaaatgatgtaaccttgctgtggatttttctcatctataaagcggggataatagtggtaccaacttcacagcattgttgtgataattatgagaattacacgagatcatcctcatgtggcctttagtagtacaatgcctggcacatggtgagtgtccagaagcgatcccagtcgctaataggtatgaaggtaggccatctgtcagggaccatttaaagcactatctatgcactaaatcttttaaccctaggaggcaggtactattattatccccactttacagacaaaattgaggcagagaaaaggttaggaaagccatccaggatcacacagctaataagcagaagggtcaggattcaaacccagagcttgactgcaaaacacatagtcttaaccccaagactgcctctgataaaaggcatgggtggataaaattattatccaaaaccacaggatgtttttcagtttatcaccatcatcacctattttatcatttttattaccacaattagaattacaattcttttttttttttttttgagatggagtctcgctctgttgcccaggctggagtacagtggcacgatctcggctcactgcaagctccacctcccgggtcacaccattctcctgcctcagcctcccaagtagctgggattacaggcgcccaccaccacgcctggctaattttttgtatttttagtggagacrgggtttcaccgtgttagccaggatggtctcaatctcctgacctcgtgatccacccgcctcggcctcccaaagtgttggaattacaggcgtgagccaccactcccgacctagaattacaattcttaggctgctggagaagacatggtttcttttttttttttttyctcgagacaaagtctcactccattacccaggctggagtgcagtggcacgatctcggctcactgcagcctctgcttcccaggttcaagcaattgagaggacatggtttccttactcagggactacgtagtgcaatggggaactgaagcaactagacatgaaaggatgtaacacgcaccaagatgtataaactatccggatagttctccatagccatgggtgtgtatggatagaacggacctggtcgcaaccagagttggatgtgattatgaggaaatgctcccaggtgcaggagtttgaattaggtgtggaacctcagtcaraatacagagaagaggactgcacaggtggaggagaaggcacagaggtgggagccggacccattccggctgggcttggctggacaggagcagagtcttttagctggatactcaagggacccaggggcattgagactttgcctgggtggcaaagaaaagggaaatcactgtgttggaggcaactggaacactggtcatttaccacaccaggtgactaaatcacagttgcctcagaaagtagagtgtcactcagaggttgaaagagggagcaaaggcgaatgggggccacaagtgtggagtttaagtgaccaccatcctgagcacatatcagctgtgctcctccaccatggaagtcagttcctggctacacccctcatgggaaggtgggtctccaggcctccctcaagtgcaaggtgagttgaaacatctgtagctgcttaccttttggtgccactaggatctgagtagcaaatattctttttaaaaatgtgggggaggatctacaaagtcaaagtcagctgtattaataatcctgtagccagcaggtctcaaagaaatatttctggaaaggatagggaagctgatgtcagggcggggcagtcctcagagcagtgagtctaagtggatattgcttggctgaggctataggttaaggggcagccttatcacctgggaacatctgcagatgaactaaagccaggaggatgcctaaacccaggggctaggagcagagaagagatgaggaaacaggagaggaggcaaagggaatttttcagttaaatcagtcagggaatcatagtggtgctgattttttttttttttttttaaagagacagggtctcatgctgtcacccaggctggagggcaatggtacaatcatagcttactgcagtctcaacctcgtgggctcaagcaatcttctcgactcggcctcctgagtagctgggactacaggcatatgccaccagaccggctaatatttttttttctcctttggtagaaacagggtctcactatgttgcctagactagtcttgaactcctggcctcaagcgatgctgctgcgttggctgcccgaagtgttgagtgcccagcctatgctgatattttaatcaatttttttttcttcttgtttacggcattattagccatagggttttctggaagggcgggggaagaaaagggtagaattcagagaatgaaccttaattttatattttagtatagatggcracatttggaaatgatttttccacaaaattgcacacaaaagttgtccacaaaaattccattcaacaagtagtttccctgaagagtagcttccctggtaacagctctaaccatttcatgttacgttgctccctcaggaaaacgttttctgcattttaactgcaatcaccagggccttagctccccttggaatatgagggttccctcttgcakcagccaaggttctgtgcagtggggtggagtgggctgtgggcgggggcagagggagaggggaagatcaggctcaggtggcccagaactctctgcagctgtgccagagaaggcaccttcttgttattctggtgtggttttcataaaaagccctagaaggaatgaagtgacatgggaacaaatccctacaagcaaagctaggctgggtatagatgactaatcatattactcatcttggaatcaagttattccgaaagaaggtatattttaaatttatattaaaagaattttacaaagatatgttggaaaggtgtagcaatgggggcaggtaggttgagcagattaacagggtttccgcatgcacactggaagcaaaagactagacatcagaggcccttaggtagccatctttattttctgggaaccataaagaccccagcagtatggaccaagggcattaggggagaaaacactggactcagtatagcayggagtattcttggccatcccatttggatggtatgcactgctcaggggaaactgtagtcttggggctactggtatatatggggggctttgatgggtaaccagcttgctgtrtgtwtgtcagggaatgtcttagtattggtgccaaaagaccctaatcctgggaaactccacaagcctgcctgggcaagccaggatggctggccccacaagctctccaaggggcagggaatttgtgctgcatgaaggaggctggtgcagatactgctcaccagcgacacaggaacccagcctgggcaaytgccctcaagcaagaaaaagggagaaattacaaaatcaaaacttggcgatcttgatgttccaaaaatttccaaaggtctttggtcagtaaagcaacaaccaattgtcagctcaaaggcataaaactggaagactagaacatactgatatattcatttctagttctgacaaataacttcctcggcaattttttttcacaaatcaattcccaaatatttttctatgttttagaaattatatgctggatatctccatcttttagaaaagttctccctatgtgagacatatttatttgttaatatatttactacttcctctgaaatactmtaactcttttgtttcctcattctgatagcttcattttagtcattttgttatgaaataaaatctggaagaaaaaagacatcgtctcgccacaccacacaggtgaagacagtcctcatcagtcccaatcctgatgtctggaattggggagcccatgggctcaaggcgggtgttccttgctacacatttatggatataaaccagagtcgttctgtagaggtctggaactgcaggaagattagaatcttctgctcccaggctactgaggcccagagaggggaactgacttgcacaaggtctcccagcaattagggttagagaactaacctgtcccttgttgggaatgaaccctctgggtttagaggctcctagcccaggacaaaccaatctgtgttggataaagggaatggagagcagagaagggccgagtctgagaatcgggttgattaggaagcaggctggtctgacattgactacgtagggagggctgccatggctggtaccacctcttacctgttcctgagggcagggtaacctcccatgggaagagctgggtctctctctctctacactytgtctagcacaacaaacaggttgaaccagtaacatctcccagaagagcatgaaaggttgccacgtggcctgagcctgcagaggcattctccgcagggccacacggtggttctgcgcacagttaagttgttcagttttcatctctcaccatcttcccctcctcatcacctccacctggggctgcgtggattctgttcagcgacccagcctcactgtggtggcagaggccagaaacatacccacaccatacagtgtgatgtgtgtgagaagggatggccaggggacagagcaaggtgaaatgtctgtccaaagtgcatgagagcagtctgcagcaaggatggcaggaggcatgacagtaaggtcatcccgctcactgcagtaggtctcctctttaaccatacacacacgcacacaattttctgtatgtttccttagcacccagaagttattcactttcaaaatgatcagtctttttactgaagcttactggctttccaactagtcctaaattgtgaggctttactgaagtacttgagcatgtgaagtgaactgaggaggaaaatggctttgccggcagagtttgagatgcaacgagtacaagccatttgcctatgaagaggctgtttcctccctctctcagggaggacaagtagccagtctgtggtgacatctgttgtctagatgcacagcttttcgatgcctaaaaaagatgctttgggtgcaggggtggaaagacttggttgtgccttagttttcttatcttagtcattcctgttaaccttagaaaaaaggtgaaaaacttactgaaagataagaaacaataagacacaattgtacattattagggatcctatgcttggtagaattttcgcaatgtaaataaattacatctcaagttctgatccttttcagcagaaattctttcctctcccaagtctagtcactgagaagcaaagtgccgttgccttttatttcttcaatgcttctttttggtgcctgaatgcacaccaaggaagagctcctctccagagcttcactgcatcayagacttgtgcaggggccagccagagtgtttctcaaaatcttttaagtctctgaattataaacagagctaaatgggaccttggagatcatcttgtccagccccctcctagagaaggagactgaagctcagagtggttaagtgacttgcccaaggtcaacaggatgctgtgttattattattatgattatttttgcatcaggacttgtgggatctgtagtaactattctcttggccaattataatcacatcactggcattgttttacgagaaatagccccgctaggcccagtcagcaataagtctttggagctgtctcagcctgcagttgctttatataaaccatcccttttatgggagttgaagcactgtatgaaaagggtttttgtctcatgttgaccttgtttagtcacattaacgcacacatcagttccaggccccattccattctctgaacatcttctgacacactgacagtgctgagcagagcaaggttggkttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgggcaatgctgtgagagccattggaagactgtcctctatggcaatgatctcagggctcagtggcaggaaatcctcaacagggtcaccaaccagcccgctcaatgcagaaaaactagaatctgaaggtaaggaggagtttctccagccagctggtgagaaagaaagggctggggaacaaaggggcattttgaggttttggttggttttgttctttttttttttwwtttaatattccctgcaaggataaattcagaagtaattttgggttgccctgacaattactaagtctaataattattcttaatcgtttaactttaagcttaaccattttcggagggaaagttgttatttgtctaatagaactagatgacctcagctatgctttttcatatattttgtgttaaaattaacaaagattgtattaaaatcttcttttgttcttatggcaaaagtgatattctatattaataggcaaaaataacattaaaattacatgtagttgtgtaagatttataaaatattctattttctaccatctttgtggttttgttttaaataaaaattaactcatatggtccacattctttggcattgttcatgatgcygaatcgtgtcatttgaactgggcagactgggactggcaggtctcctcctggagactaatagggtcagttacttgctcaccatcttagatgctgtcccgtccatctcctcagtgaaarccccagcyttttcctgcttcaggtgcatgcagggccagacccttatctcatttggccagagacaccctctgtccctccctgcctggtgctttttgtatccacaggtgagaatctgagtttagattcccttggtgagcaaaggtagggttattggtgaggccagcaactgcctgctctggagcttcctcacagccagggatagagactgcagcacacaggcctggtccctcctgagccacttctgcccctcctcagatgacccagacatagcctgaagggaagggaggagatacaggtgtccctccaagttacagcttttccctgaaccaatcccacatcctggtccacagtcacacagcatgaaggcagtgtgagcatggagaaagagccactggaagctaaagatgcggctaggacctgactcctcccttgtaaaaagcaggtggaacacctgctgcagaaggaaggcagagggataccaagactaggaaggctgatgaggtcctgccctgctcagayaccctcagctgaatcctaaagcagcatgaaatgcagccagaaatcctttttaaagatgatttcctctttcaacatgtcagcataaggggaagggggagtctgatccttcctcagcttgggcacagttccttcttctgccaaaaaccatttggcagcaggccaacctgtccccaggagaaaggcgtgcttatgattcagttctcaaagctgccttctttgctaaatcatagcaacttttttaaaagttagtttctttaagctagaggcgaggcgagaacaacgagtgaagaaatgacctggtcttcttctctgtcttctagaagatgtgtcccaagctttccttgaggctgttgctgaggaaaagcctcatgtaaaaccctatttctctaagaccattcgcgatttagaagttgtggagggragtgctgctagatttgactgcaagattgaaggtaagttgtagctgtgcttctcttcaccatgaatagggtgtggctggatggtagagtccctaccatgcaccstgggcaagaagtcagttctgtgcagctggggacaatgaggaactgccaagctttgggggaaactgggtcagcaggagctgctcataaagggctatgccctgcactcccacctcctgaaggtgtgtccttcagtcacttccccagggggcacatttgaaatttcacctacttacatcagccactagacctaagtttagaaatggccttgcatggacttacctggctttggaacatgcttagtgaaatgagctttgcaaactgctgaaaagcatgtgacttgcccatatgaggccctcaaaggaaggctggcacaaaggcataggatgtggaatcggcaggctctgctactcgtccacaggctgtgtgaccttggatggtggtccaactcccctgagttacggtccctctgctgtaagatgatagctaagtcayggagtggctctggggattctgtgaggggacatatgtgagaagggggaaccttttagatcttgtaaagatgtcacagagcaaagggaaaagttgtgggactggcaggtacagagagagtgcatgcattgtgacttcagactgaggccagttgggagccaggcacccgggacaaagcactcagccggcaccatcttccccaggctgcttatctgcctgctgggaataatgcagccacagacctgtcagtggtcagagctcaagggaccttaaggggtcatggcatagcacctgagaaatgagcaaagttgatgacacaaagcgtttccattttcatatagattgcaaccgtctagaaagagaagggacaagataagacaggctctttgcttcaagtctgtgactttcacctgccaaccagggtggtgggttatcacccattttggtctgaccaaataaagcacagaagtttattaggcaactttcccgaggccgcatagcacagtacagcagtcaaaacaaactgtgcctcccactttctttgattctccagcaatgtgactagacaatgccttttgagtaaaataacccaaagttaggaatggaaaaaatagtttttcttctgcatctttatattatcaaagtgccttatcaatgcttcgcctaccatagtcattttcctttcctcactcaattaaaagaaagtggatgtgctgcctttgataatgtgaaaattctcggactggggattctgctgaaggctctggagccactgcttgcaattctcaccattaccattgcatttgggtcttctgaagtttcttttcctttttgaatgttttaaaataacataatgattatcattttgtacttaattttctctttgggattgtttcgtacttaattttctctttggaattgtttcattgatatttatgtaacttttgcctggggctctgatgagaaattaaagcatatggatgctgttttgataaaaacaaaattgaaacttttgcactgagggtgcagggcatgggagtggagggtactttatgaccagctcttcctgacccaattttcctcatggtctgggtgttcctaattacttcgaaaaaacaatttctaaaattattttgaaaaaacaacattgaaaagaacattagaattcttgatttcttatgtataatttttattctggttagggctcatattagcctgtttgcattgctataaaggaatacctgaggctggaaaatttataaagaaaagaagcttatttggcttggtgccagtatctgcatccagtgaggcctcaggatgcttttaatcatagcagaagcaggcatgtcacatggcaagtgagagagcgagagagaaggacgtgccacgttttaacaaccagatccgcatgaaatgacagagcaataactcacccattacctcgggaagggcaccaagacattcatgagggatcggcctccatgacccaaacacctcccaccaggccccacctccaacactggggatcacatttcaacatgagattcaaggggcacaaatatccaaaccgtatcagggctacaatttttttcctataaaaatacttcaccaacatttaagagaaagtcaggtggaatatattgtatatttttaaatgtatgtatatatatgactttaaaagcggggtacatgtatatactatgtacctgcaaacaaaatgcataatgttggtaatgcttctgtacatatatatgtacacatacacattaaatacatataatatatattttatatgcatgtgtattttattttttaatgctgaactttgcagagatatgactaatgcataaaggctcattggtgaggtccatttccaattgtccataggcaaattacctgctttggatcagactaagacaaatattgctttcttcttcttagcaatattatcagctcttttaaattatgttttatatagctgttattagctttattcagttataatttatatactataaaattcacctattttaaatgcacaattcaattatttttaatgaatttataccacaatccaattttagaacattttcatcactccaaaaagatcccttgttcccattttgttttgactcttatttttcatttaaattatttcacttaaactattatacaaaattgaaaatttaggctgggcatagtggctcacgcctgtaatcccaacactttggaaggccaaggcaggcagatcacttgagtccaggagatcaagaccagcctgggcaacatggtgaaaccctatctctacaaaaaatacgaaaattagctgggtgtggtggtgtgtacctgtagtctgagctatgcagtaggctgaggtggaaggatcacttgagcctggacattggaagttgcagtgacccgagatcatgctgctgcactcctgcctaggcaacatagtgagactctgtctcaaaaaaaaaaaaaagatagaaaattgtattttcggccgagcacaggtagctcacacctgtaatcccagcactttgggaggccaaggcaggcagattacctgaggtcaggagatacagaccagcctggtcaacatgctgaaaccctgtctctactaaaaatacaaaaattagccgggtgtcgtggcgtgcacctgtaatcccagctactcagaaggctgaggcacaagaatcacttgaaccaaggaggcggaggttacagtgagccaagatcacgctactgcactccagcctgggcgacagagtgagactctgtctcaaaaaaaaaaggaaaaagaaaattgtattttcaatctaagaaggtattcagatctaggtgtagagttggaattggagcagtatttcaggtagtactctatttttaatttttatttttttgccatgttggccaagctggtcttgaactcctgcccaccttggcctcccaaagtgctgggattacaggtatgagccaccatgcctagcctcaggtagtactctatgtctgtttaaagatgggtgggtgtggtggctcacacctgtaatcccagcactttgggaggtcaaggtcagaggatcacttgagcccaggagtttgagaccagcctgggcaacatagggagaccctgtctttacaaaaaaaaaactttttaaaaaattagccaggcatggtggcatgtacctatagctccagctacttgggaggctgagggaggaggatcacttgagcccaggaagttgaggctgcagtgagccatgttcatgccactgcactccagcctaggtgatagaatgagaccctgcccccctaccccccaaaaagtgaaaggtgtgatgtttaactgagcacggtcgctcatgcctatagtctcactactcaggaggctgagaagggaggatcgtttgagcccaggaatttgagcaacagtaagctacgatcatgccactacactccagcctaggcaacagagtgagactcatcactttaaaaaaataaaaaaactattaaataagttttttaataggtgggatgtggtgctagtccaacakgtgtgggaaatggaacaactttaaaatattctatttggggtttcagatattggtatttacaagacatgtccatattctaatgtagatatcaaaacagtcgataaaggccaacatcaaaattttctccttaaccaccttaatcaatagtggtagcttacaagttgcttgcatgagttgataagaaattttgaataacagttcctgcaacttgtgttctctccctgtgatgcaggatacccagaccccgaggttgtcyggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagcwcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccaytttattccaaagtacactgcagatgttcaaactctccatttctctttccccttccacctgccagttttgctgactctcaacttgtcatgagtgtaagcattaaggacattatgcttcttmgattctgaagacaggtccctgctcatggatgactctggcttccttaggaaaatatttttcttccaaaatcagtakgaaatctaaacttatcccctctttgcagatgtctagcagcttcagacatttggttaagaacccatgggaaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcactaaattttttctttataaagctttttgaaggtcataaacaaagaccataattgatgatagacctratacatttcctckgtgtgtgtgtgtaacattccaaatactttttttttcttttccactgtttgtaaggtgcaacaatttaatatttttaagggactttttaagagttccttawgaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgcyttcttggaattgtgttaatgttctcttggtttattatgccatcagaatggtaaatgagaamactacaactgtagtcagctcacaatttttaaataaaggataccacagtgcatgctgtttgttcartctttgcagacttctctttctttccatgctaccagttgtaaaggacacagctatatcctggaaatgaaaaacaaacactgtggtgcctagatgtgaagaactggcttatgtggttgtgttttgctatggaacagaatgatttaggaagttcttgtttatataggtagccgaatttacacatttagttcaaaatttctcttgagcatcagcttagtactatatcaatcattctagaaggatatcttatagagcaggtgtccccaacccccggtaagtagcctgttaggaaccaggtcacacataaggaggttagcagtgggcaagtgagcaaagcatcatctatatttacagccgatccccattgctcgcattaccgcctgagctctgcctcctgtcagatcagcggcagcatcaggttctctcaggaacgaactctattgtgaactgctcatgtgagggatctaggtttcacgctccttatgagaatctaacacctgatgatctgtcactgtctcccatcacccctagatgggacagtctagttgcaggaaaacaagctcagggcttccactgattctacattatgatgagttgtatacttattttatattataataaaatatattattacaatgtaataataatagaaataaaatgcacaatacatgtaatgtgcttgaataatcccaaaaccaccccctctcctggtccatggaaaaactgtcttccatgaaagtggtccctggtgccaaaaaggttagggaccactgttacagagtatcaggtcctcaagatgctaaaatctatatgacatttttaacatgtgacattatcatcatcatcatcatcatcatcactgatgatactatttaccagggcatggtttgaattggtgactttggtgcagttcattattggcagccaaatgctttatccataccttcatattgaagaatttgttatcaggaaactaccagtcctgctttacaggaagtctgttatcagatatcagatggcaagttccccatgtcttcagatgttcaaacaatattgtggatggtctagaaagagtttaagacatgctgttaaatgtagggctagataattctctgattctttgatgtagtctggaaagaaacaatccattgtccagttaataaatatttagtgttttcatttttaagacactcacaatccacaaatgtccctaacaatttattatttttaaagaaaatgactttttattccttgctagtgaaaaatgtacaatttatatgctgcactgagaaaaataacagatatactttcttccattcattttcatcccaaacatataaaaaataatccattgattgttccttgcattgcatatcttattaaaagatatttcctacatgcaactaataagacatgctgactgttgtcagctctaaatttatgtaaagattttttatttttgttaaaatgtttgaaatttgctttttgctccacacctcacctgtttttgataaatctgtgctaataagtacataggaggtaataaataattgagttgtgagaaacccaattctccatttttcaagaaaacacaagtagcactactctctttatcccttgggactccttcctgtaatttgaaagggggggctaatgttggtggcagttgttgctaaggatctctgcacagagttagggcttcactctcggcttcctggttagatggggccatgtgactagtcctagtcagtgagctgtgaccagaagtgatgtatgtaccctcgggaccagagcatttatgtgctggtacaagcctctccataatgacgggcaacacatgagatggtggctgctgcagccatctgggtctctagccaacccaaaatggggacataacacaagcaagaaataaacatttgttcttataaatcaccaagattttggggttctcagtggctgcaacataacctagactatcctgatacaggcttatcaccatgttctggatgtgtggtgaccaggatggtagccactactcacaagtggctatttaaatttaagttactttaaaaaataaaataaaaaattcagttcctcagttgtatgagttacatttcaaatgctcgacagtcacatgtacatcacttttcaaattatgtgaaattaaaactgaaaagcttgtgtgaaagtctagagagtatggtctatagtttcatcaattgtattggataatatagtctcgatactcaagtgttgttgttcttaattctttatttatattcaaatatagtttttcactttttaagacattttaaaggctgggtacagtggtacacacctgtagtcccagcactttgggaggccaaggcaggagaatcgcttgaggccagaagttcaagaccagcctgcacaacatagcaagaccccatctctatttctttaaaaaaaattaattaaaaaataaaaagacattttaaaagtaccagttctggccaggcgcggtggctcacgcctgtaatcccagcactttgggaggccaaggcaggcggatcacgaggtcaggagatcgagaccatcctggctaacacggtgaaaccccgtctctactaaaaatacaaaaaattagccgggcgtgatggcgggcgcctgtagtcccagctactcgggaggctgaggcaggagaatggcatgaacccgggagacagagcttgcagtgagcggatattgcgccactgcactccagcctgggcgacagagtgagactccatctcaaaaaaaaaaaaaagtaccagttctatgcttctgacctcaaaatctaaatagtcctgcaattcacaagcaactctcagattatttctgatatgagacaaccaacaaggccaacattctccaacgtctttggaatttgctacttgagatgggggatcaccagtggggactatgagatggatgcagaaagggagacagggctgctgaggcagaatttcctcaaccatgggtcaaaaggcagaggagccatcctgaggctacaatccttccaaactcagctgccttttatcagaactcccttcccactggaattcaaaacactcaggagatctaaagtgcttggggacaacattgaatttctaaccgctgctggctggagattttagcccataggccttacccgtgttccaaatgcttataccctgcaggaagcgcttcatgtcagagacttcagtcccccgagtctctgtttgaggcctgtggtaaattttcacaagatattttgtgactctcttagactagatttctttcggctggagataactaagggagaaggaggttacaaattaacctaagtcaatttggtcattcatatttattattaataacatctttaaggcaggtatcagtagcctccaatagttaagataagattgagctatggggcttctccacaaccacgcttcaggtggtatgtttcaaagatagtctcaggccaaacttgtcaaacacctattagccagcagccatacaaccgattctgcaagctccatgaagtcccagatatgcctctccagaaagcaccttgcatgttgtcactgaaggcaaatcctgcagtgtgcttgggtaggaggcagctaacctggttaatcagtggagtcagttcctcttggtgctatcctaggaaccaacttgtccaacttacccaccattttcattccctctgtaaaataagttactacctcttacctctacctcttactacagctgtgtagcttgtgcctcagtttccacagttataaaattagagttatagtagttcctcactcatggcttgatagaaagattaaacaagctctatgtgcctgaccttatggtacgccctcattctggcactcagagatgctaagatgtatcagaaacaatctctactctgaaagaacagattacatttctgcaggaaaaaaaaaaccccaaatatgtgaaaaagttatattcagtcagccctctgtatccatgcattccaaatctatggattcaatcaactggagatgaaaaatatttggtgggaggctaggtgtggtggctcgtgcttgtaatgctagcactttgggaggccgaggtgggcagatcacctgaggtcaggagttcaagaccagtctggccaatatggtgaaaccctgtctctactaaaatataaaaattagctgagcatgatggcaggtgcctgtaatcccagctactaaggaggctgagacaggagaattgcttgaaaccgggagacagtggttgcagtgagccgagatcacaccactgcactccagcctgggtggctgagcgagatgctgtccccaaaaaaaaaaaaaaatatatatatatatatatatatatatatatatatatatatatatatatataaataaactatatatgtaaaattatatataatatataaaatatatattatatataatatataaaatatatatactatatatcatatatattatattatatattatatataaaatatattattatatttatatattatatataaaatatatatataatataaaatatagtatataaaatgtaaaatatatatagtatataaaatataaaatatatatagtatataatataaaatatatagtatataatataaaatatatatagtatatataatataaaatgtatagtatatataatataaaatgtatagtatatataatataaaatatatagtatatataatataaaatgtatagtatatataatataaaatatatagtatatataatataaaatatatattatatattatatataatataaaattatatattataaaatatatattatatataatataaaatatatattataaaatatatattatatataatataaaatatatattatatatattatataatatataatatatatttgggggtggggagttccacaaaattccaaaaagcaaaacttgaatttgctgttcacctagtactacattgaatctatgtgaaagaagtgatgtgtaggcattgtattaggtattataagtaatctagagatgatttaaagcatacaggaaaatgtgcataggttacatgcaaatactacatatgccattttatataagggacttgagcaactgcagattttgttatctgtgggggtgtcctggaaccaataccccactaacaactgtactaaagatggaaggtattattttaagttctacccacctcccaaaaaaaaggatctttgaaactgaaagtgccatgcaattgtacaaaaaaacaattgctgtgagtttaggaaatgttacaaatctaaatctcgttctaaggaaaattttaacttccaatccctaaatattcccttcttaacagtcaaaggagaaaagctcatctgaccttatgaatattatttttctatcaagaggaaatttcccagagttagcttgacttaaactaattacactttaagttttatcctgacacatcccctaagttctaattgatatttgcaaaagctgacttacattgacttgtttctggctgcatattaaccacagaacaaatagggctctgaaggctgagtagatgtctttttcaaattgtctagaaagctaaaaactgagactcctgttttcagaagaatcaggagatgaaggaaatatcagcttaggaaataggaacctaccacagtagagagaaagtcaaacatgaattactcaagagaagcagtgattctctacccctcagaacttccattaaactgatagtaaagggataacaatgtttttaaaaaagatgtccccggtgtgtgatgttccccttcctgtgtccatgtgttctcattgttcagttcccatctgtgaaggtaacaacctgcacattgtgcacatgtaccctaaaacttaaagtataataataataaaataaaaaaaagagagatataaactcttcaaatataaagacaaatacaggtgatgatagatggaaa

SEQ ID NO: 17655 - DNA, 165749 bp, Homo sapiens
aagctttgctgttcattttactggatttggagggtctcacgatttctagcataaaacaccattttcaagagtgtgtaacttgtctatgtaaattctccctggcccacagcctggaatgcaaattctgtttctgagaatcactttgttttcaacaacatcaaaaagagaagggagtaggggggtgttggcggtaggtggggtgtgagtttgttttcacaataatagaaattccctgtattccaaatcagctgataaattttattgaattaggccagctgaatttttttcagatttctgaaaaaatcagatttggcctgatttacaggtatgatttcttgcatatgaggaatagcttaatgttttttttttttttttacaaaatgttttgaaaactgtcacaaataattcttccaaatgaaacaaactgaattttctcaactcccttgtatattaccatctcagtgtaggaaaattttaacaccttaaaaatgaaacctgacaatgacaaattaatacatataaccattagagtgctgtgacttaacctctgtagctactgtggtccatttttgatgtctggttatattatgacattataactatcaccaaaaaactttttgattactcgctttagaaaagtgtcctgagcagtgcactattcatctttctaataacatgaaagtgaaatagaagaaaagaaaaaaatacatgggccactggcaaatgcaggatgcagactatttgggatgttttatggaaacaggcatgactgcaaacacttggtttgcacttggtttgattcatacaacgatcgagaagtgtggatggtttctggaaagtgccttctaagctgaaaggtaatcaactgaaacatgtaatatgctcttacaaggttcttctagggaacaaaggtttcctttgatagtataagcatgctttgaatctgcatcatgagcccataggagctttgaagtccgtataaatacttgagggacagacctacttagttgcataggctattacaagagaaacaggaaaaatccatagttacttgctgtagttggaaggccctctgggtttccttcttccctatttattttaataatttctaagcgctgtcaagttatcagaaagcagaggggaaaaagttgtaaagtgaaaccttcttccctaattaaaaaagactgaaagactggcattctgaaacttttgagacctgtttcgttccctgtagtgtctaaaatattgtgaagtaatagaggcgggactttttatttgagttttaaaagatgaaatactttaattataacttctcaagtcattcatttgcacagttatttgcacagtaacattaactatatgctatcattaggcaaagtaattttgtcatagtgactataattattccaagtttcttctacaattttctcttcttccatcactactctactttctccccttggtgtatcccacataagcattcagggtatagtgagtttttttaattttaggacaattttctaaagcaagtgaatactttttgaaatctaaatcaataaccagtcaataaaggtcaggatggaaatgtatctatatctctaatatatataatatataaaatatttgtatgtggatatatatgggatatttatatatgtggatatatataaatggaaaatttatacctctgttaaaatatagtttgaatttgcttatatttttttattatgcagcaaaatggcaatttcatttggttcagccaaatacatgtatatgtatgcgtgatatacatgattacatatatatcatatatctatgtatgtatcacacaacacttatttgtacatgtcagtaaaaattaagatcacctgctagttatcagtagtagtacttcatagctcacgacatttttacatgacaaagtaacagagaatattattttagttcctcactgcaaatctcctatttgaatttcatactctttgttttctttgctgatagtatatatgagcagaatgaagatctctttaagtccccttatatagatacctgctatagagacactacagagagttcagtcttctttctaaagaacatggtctggtactggccatcaatcccacttagcagtgacactgctgcagactacttactgaacaccttgactattgtaggtgcctcaaacacgttgtcctcagttactagcatgcacacaaatctcttttcatcactgatccttgcattactgatagacaaagtgtagttttctgagaggttcaatctgtctttgtattctggtacatcgtcgtactgcacacttttctttgtagaggatctgaaggcaataaatactggggagccatcgggcttttcctaaaaattaaaataataatacatttaaacacaagcatattcagatgtttcaggattacattcaaaataacatttccttggccatattctaccaatatctatattttttgtctacgaagaataatttttatacaagtctcacgtaaatatttgattacagaaaatccttcataagagagaagccataatgagtaaaaatgaaagggtagagctctaggaatcagatttttttttcattgagaagatagaattattaactgttttgaaacttacatgggctgcatatgtttaatataaaataaaacataaataaatgcaaacaaaggtacaaaatgatgttcagataaccatcacggcaggtatacacttgagctgcaaatactggtttggatattttgggcaattatctttggaatattctttattttaatccacctattttaaatgtccacacctctaaccaaaactgatgtagctgacctttatacatggaatagtttaaccagtcttgatggagaaacagtatttacccttgtaaaataattatgtccattaaggaatgagtcagattaactaatacaacccatagttttgctgagtcataacaatgagctcaaaagtctttcatacaaaaacatcaccaaaataagatgtactctgcatacacaattatgccaagagcactgagacatataacgcatttcttcctctggtcccacaaaaattctctcacctaataagcaatttaatgtaaaatcaggggcagtccctcctttatgtaccctacaagacctttgagaaaattaaatgtgatatatgttatagtccatgacaaattttaggattctatggaggattcagttttaagaattaataatatcaattactaagttaatattggagtccaaaagttttatttgcttaaatatctgaatacatcaacaatattcttcttaactgttttaatcacaggtttacaacgcaaatcctcttcttaagtcattccttcattatgcaaagtatgttagaccactaccttattcatcatccccttattcaataaataatagttactaatttttgagcacttaactttatggcaggtgttttctttgggctttctttttttttttttttttttttttttgagacggagtctcgctctgtcgcccaggctggagtgcagtggcacaacttcggctcactgcaagctccgcctcccgggttcacgccattctcccgcctcaggctccagagtagctgggactacaggcacgcgccaccacgcctggctaatttttttgtatttttagtagagacggggtttcaccctgttagccaggatagtctcgatctcctgacctcgtgatccgcccgcctcggcctcccaaagtgctgggattacaggcgtgagccaccgtgcccggccttctttgggctttctatgcagtaattggttttaatattcataacagccttataagttaaacttaaatattagcctcatctacagactagaccatggaggttgagtttggttaagtaactttccaaggtcttggctgggaaatcttagcagagcaaaaatttgagcttagagcttggcctcattatggttacactgtaccactcttgatagccttcaatccctcttctgcaccaggcactatggcagataatggtgaggaggtgtcaggagtagggttgggaggagtgaatagggagctgtaatctccattcacagggagtttacaatatgatccaggagaaatcaggccatttcttctctatgtttacttcggctcatttttccaaaactttcctttgtcttttaggtggttacattaaattagagcattgcaaatgctctattttagcatttctgcaatcaagattgactttagagcatatagtgcctcaaatgtatctcagtttattgctgaagccttttgcttaactaaaaatttgaaaattgccattattgtttgatttctgcaaatcaagattgactttagagcatatagtgcctcaaatatatttcagtttattgctgaagacttttgctgaactaaaaatttgaaaattgccattattgtttgatttccagtgccactgtgccagttcagtttactgaactgtgttactccctgggtttactaactcccacatttcactaactgtgctgctccctgggtgaatgctactccctgggttatagttagaattttctatgatcatcaaagtttgccatcacctgactccatttgttttggcagcaaatttgattgaacaagtgcattgtgtggtagtctcccaggcacttggaattttgttggcactaatagactctgtcctcagaggccttaacttcacatttccacatttataggaaaccagaaatagttcaaagttacctcgagtgaactggatactaaatagaaggaggctacagagaaatgctgtgctgccttaccaccttcctttcctttcctttcatttcccactcacacgagcatagtatggttaggattctgcagcatcacagacacgagttcactttgttgaatgattactacacgacaagaactaggtaagtattttgatatcaatttcttcgggtactctgacaacaacactatgaggaagatatttttatctcattttatggatgaaaaaatagggattaattcctctgcccagaatctcacagtgagcacattgtggaacctgttgatttcagaacctatattttaaaagactgtgttaaaccaccccttgagtgcaagcttaagcacatttcttacagtgtgttctgcagaatgtttgttcttggagatatctgaggaaaaaagttgtgtggtcaaataaatctaagcaatgaatcaaactatgaccctcagacaattcttaatgcattttacatatgaaagactccgagaagtgatgcaataaactttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgcaataaactttttgtaaagtatttgaccatcaaattcttttcctttgcaaataccttttaacatttcaaggagctagggaaattttgatattgtgtccagggaaacatatctacttgaagcttgcagactgtcatgagtctcctgtggtccagcattgggaaattgtaccacacaaacactttgcattaatattgattaattaaattgagacattttattactcaaagttacatagccattccacatctccctaccaggatctctaccctccattttcagacccacttgtaccttcatacctgagaaaatttgattttactatctgcaagaaatatgggaaaaaatcaacaccgttaaatataaaaaagacctatagcatcaacacatttttaaggctaaatgccagaatcaagcttgtaatactgatgattaattccgaaagactgtctaaggctctatctactgatrtatcttgtctttgcaataaccacatcaagtagaacatgaacaaatgaagaaaggttgccatcctccactgaggtctgtcctataatccactgatttattctggaactctgcttttttctttgcctctaacacttaaggtggaatctttcagactaatacattctaagaactatgtgtttattggctttattttaaaatatcatttgttatgtaagataggaattatttttttgccatattccacacaattttaccttcctacatttgtactcacagtttaatattgcatttaggttaatttgaaattcacagttactcacagaaagaattttatttaaaagaacaagggcaattaaccaagtcccaggtaggtcacacttacatatttccatttgccaaacatgagattctgaggtacgtcaagtcggcaaggtatgataatkgtatctccatatgctgaatttacagtataccatccaaggcctttgggggraaaaaaaaaggaagaagagagaaagagagagagaacaaaattttaaatgctttcttgaaatgacaaataacttcaagatgcatgtcgatgaaggttgtcatctgctatagttttattttaaatggtatacaaaaggtatgagactagaatatattttccatttaaaaattaccacctttctatttagctactgaatgtttgaatccttgactatcacacaatcaaaatttgcagatctccaattttactagagaacaggtaagtggtgtattccaaaggaacatmgtggaatctgcagatgaattatcttctttactgtatttcatagaaataatttccaccatattttatagaaatgtgggactacacaaagactaacatgattaaaattctcaaaactagctttaactatatttgtgtttttcatttgaaaatattatcaaatttttcttctgtaaaattcaaaaaactattaaaaactgagaattaatacacataagaccacaactgaattttatttataaggggaaagtggcttattttgtagtagtataaattaaaatactaatttaattttgtataaaatattagcatagtaagaatttatagtatgaacatgcttcataaagtgctatttacaaagtgattatgtgaatttttggaagacaatataatttaaaccacaattttgtacatacagaaaactgcctcatcttatttaattctatattaagaaaaaatataaacaataaaaaattaaaatgtggaaagaagcaatttttgcatatgaatgaaaagcattattcaaatctggatatatttatgaaggttaaaaaaacccaggcatttaaattggttatagtacttgggaaacatttcaattttttaaccttagtttatttacaacaatctttaaaatttagaacttacacagctgaatrtctattaaggtgtatcataatcgggtatagagtgtgaaggggctactttaaacagtagagaaaaaaacaaatgatattttgtccaccaggtggtgctaaaatgcaaagcgacggcaatctgcaacacataaataaaaccatcttctgactttctgaagaaacaggactgggaggataccatctttcgactgttatctatcaatcaccatgtataccaaaatttcatttaaggttaagaattttgccccagtgaacagaaacataacaaagaacacacacttcatgtaaatatgcaacataacaactagttttcagcatttttaacattgttaagacagaataccaaatatgcaaagtgagaatgcattttcatttactacttgagacatgaggtttacttcaaattgcttatcatatgttcagtctcataataaaaatttatctctataattttaaaattgttttgtgttctctatactgcaattataatcccttttaacatcaaaccaagcataagactgtaaatgaagaaatttttttattcaactttgttaaaataaaaataaaggagctttagacaggtggctgcagacatgcagactaataacatttaggaaattgctttattgcacatgacattacttgttctctgtgatatttggctcctaaatgtggaatttctgctgtgtgtattaagtcttgttcatacacttcacaggtagaggtctgcaaagccaaggaaaccattttgtaatttcatattttgttttttcatcagcttataacaaggcacttgaatatgtaataattttgagaggatccatctctataccttaatttatgtcagggcatgcacctgtaattgtctcctattatttgaaatcataccttcctttggcaactaacagtgttttcatgattggccaaggagtgaaaacagtttacagagcttaggtaccaatgaagtgaatcctttgccaggtaaagggaaataagaaaattccttttccaagaatttaatgctttgccctttctcacagaccatttttcttttctcttctctatagaactttaatgtgctacatatacataatattttataatgagtcttaaagctctatgaatttcaaatacatagtgtattggcatgatgaaagcacaatcagaacagggaagagatcatgtatttttaagctttgtatctccagaaacaacgcctagcatctaatgggcacctactaaaatgactctggagttctttccattttggttatcaaactaacattttggaaaatcagagagcagttgacaacactggaattttgagaattctcatttctgccacatactctaaagccattcatatcttatcttggatgtgtagagaacttggattttgattttgggtggcaagctctgtcttgaggagaaacaaacagcaaacacattttataggaattcacagatggaatgacaagagagaacattttcccttccctttaaagagaaattaaagattgattacttgtgctccctaatttgcaaatgatatcatgaaatgtccctttcttcacttgtgatgaccgtaaagtaaaagttgtttattcaagtattggaaattcatgaatggtgtcttttaatgacagctccaaatccaaatccaaatcctcagccaggaaagaactttgaagagcaggacgaacacaaagaaataagataccacactagacagagggcagtaggtaaaaagccaacaattacagacataaggcctagggcagaatgagtggcagtaagttggatggcatgttagaagccataatcgtgcttattttagaatcaattttcaagtttgctataataatcaacttctctcttcttgtgagagtatactgactcccaagttcatctgacagaaggactgaaggcttgcatctgtgggagagctaacatctcgcgccccctagggataaagtcgctacaaagaccatggtgatttggtgataaattacgtcctaatttctagtgatatcttaatctttgagatgaagtgccagtgagacccaaagtacctgtcaactcgaatgattctgtttacatttttcatagaagaaacagctttttatctttgaattgccaagtctaaaaattgagtttagcttactagaattcccttgcaattttctccctgtaatatttgttagttaaattattcatggttttgtagcctagagattatcgggcactactggacatagagaatgcctgtgacatccttcctgaaagaggctaaatgtcaagtgtaaaccaatgtgggaatgtataagtgtgttctgtatgtgttatggctgtgtgtataagcacaggtcaaaagaaactttaaattggactagaaccttctgtattaaatgtgtttataaatttaagacattttatgacttattattactgttgctattaaaatgtcttaacatacaatacgatataaaatgtgtcatacttgagaagcagtgtgtaattatttaggcatttttaaataaaaggttattaaccaaaggtaaagaacaatagaattacaaaggttacatagaagtattaatggaaattcaatgcggtgagcacaggaaaagaaaaatctcttaaagaagtaattctgatatatagaatctcaggcaagtgacgataaaatataagctagttacagtaatatgttttgtatagaaaatgatttaaaagaggcactgaaaacagactctggtaatgttttgaagttaggtaaacattttatttctaattgaaataataaaaatgtaattttggccattttggtgacaaatgcttttttccataaaactaactgccaaattcagaggaatcattctctttgcattcctgacatatagacatttgaattgaggtagattaaaattcagaatctgctaccacatttcaagcagaagaacatcaaataatacagaaaatagaatgagaattagacagtctattttcacatgctgtaatttagcctggttaattattatttattgaaccaatacattaatagcatcatcatccgtaaaagaagttttgagctctagctctgctaagtgtcataaaagggttaactgcaactacaatggactcagaacttataagaactaaatgccggtttcacaaaaattttacagagacttatttgaacaaatgaactgtccctgaggaggcagatagaaatgagaagtttatccttagaaattactttcatatttttttactaattttgacagacatgctaatgctcctatttgtttcactaatgaattaggatatgtacaactctaaagaaaatgcaaatattttgtaacactagtttatagcggtgtttctcaacctggtcactattggaccaaataagtctttatcgtgagagtgctttgctgtgtatattacaggatgtttagcagtagccttgcctctacccattagatgacagcaccactcttcccccagttatgacagccaaaaagtctccaggcatgacaaatacccattgggaggcaaaattgcccaccaaaccttatgcaaatcagaatcacttgtttaaaccttcagccattggtttctcacatgtgattaaactgggtttccaataaaggaatttttggaaaaatagaatcttagcataggactaaataatcagtgaacacaagctaagggatagaagcagaatgatacatgatagtatctggttattatcaaatttgtttgccacacagaaacatattaaatcacaatgagggattaattcctgacttcaggaagtggattcccaatctttttacaaaaatgacaaagactgataaaatatcatagttctactgatagagtgaaaaaggtatttttttcaaacctgagattttatgattcaatcacatggagttatcttatctctcagcttctcccatactttattgtataaacaagagtttaagattctcatcaaggtcatgaggtatataaagtaagttctctgtgtgtgcatttgtgcatgtgtgtgtgtgtgagatacaaagggctataactgccaagtaatttggaagggatgctgagttagagaagttacctgatgaaatctaatgtcattttgtgaaatagaaagaagggctttttctcgtttctttttctttgttaattttccttcaacaaatgggggtagttagaggccaatttgggtctgctgcatctgaagtagggatatgtttattcaaaattcattttctgcattgcctttctcaagtgttatacattataatgtagatataattgagtgaggcctacaaataagataaatagtaattattccttcctcctccccccaccacttgccactgtggaataatcttcagagggaaaatgcccatgttactaaattataaactactagtagtacccaggattatgttttaagataggtactctttattttacttccaagtttgatataatttaatgctctaaatatttatctttttattaaacaataagccaatataataatccatattatgtcatagaaaagaattacacaaacaataaagttttaaaaatacactatcgatatttacattgctgtgcagaaaattaccttcttaatttaccttagcctgatwgtttgttattctacaagcatgaaatgatctatggggctggatacgtcacagtttctcccaattagtttaggctttaccccatctctacctaattttatggttccttggccccatctactctgttcagattcctatgtttcctttaaggcctatctcaaaaatcatcgaatcattcaatcatgcatcaaatatttattggacacctgctacagggcaagttttaggtgtgctttgtgaagaaaatgtataagtaaaatacagaggccttttccttaagaaacaagatgaaatcagtgtgaggttttgggttggtaaaccaaatgctgtgggactgtatagaaaggaatcccagcaatgagattgaggatattggtaaaagcttcttggaggaaatttcatttgacctcatcactgaattgaggtttctatagatgggaagataggaactacctcaatagcacagtgcatgagaagcactgagtgacgcttggttttctctctttgggcaaactcaatttttattataacaatttctacagagtagatctttgatcttcataaggaacatgtcctaagactggcagttttcccaaattcataagcgcacataaaatttctctaataaaatgcaataaaatgttagatctctattttctctttactttcagcatcaacactagcatttggattccttttggggccatttttaaattataagcaaaaatcttatttagaaatgatcaaaaagcaacagaattgactgaagttgtgaaaccttatttttattttttgagttgcctcatgaattttaaatcagaatatatgcagattctactgcactcattagcatttcttaacttgagatccaggaatgaactttaaggcatctactatactattctttgaaattttagggaatacagctacagggtagtgagaggggagcactgtggtgatttgagattagtgttcccccaaaattgtcccctcttaaaattgtccccccaaaagctatttttgctttaaaaacattttaatggaatataatatagatggaaaaaagtacacagatctagacttacatttgaaatgtcactaaaagcactgggctttagggtttccttggcaatgatcctcacattcttttttctgagcaggagactgagattccacatacttgtccacaatgaaacccctgtgttaccaagtcatcattcctaaatgatgagtatttttggccaggctatggggtctatgccaacatgctaagtaaggcacaggcccttaagtggtgataaacttaaataaaaaacatttaaaaatacttcatgctctgtatgcgtgggaagggggtgctttgggggggataggcagaaagaatacaatgaaccaaaaaaatctagattttgtgtgtaaaaagaacaatcgcctctattttgttttaaagtagattttcatagtaaggaggactaaacaggagaaatgtttaagtatgtttttctttatactatatattttgctcaaaaacatgtatgtaattaataatttgtgttaactgaagttccgaaagttgactatttcctactattatacttctaattaggatttgaggctgagtccttaaggtgctcatataagtagagtccttcactcagataattagtcaatacaataaaaataactagcaaagtatgattttccttctgctcccctctcccctgattcattttctcaatttaattcttgctaaagaactaaattttcttcaatttagtctagattctgatcctgttgacttcatttgggaactagcttaactggagatgtagaaacttatatttgaaatattagttatattaattcaggctaagtaatgcaaaggacagatgaatatatttagattctattgctctgtacattttctgagcatgaaaatctaagtttaactatttcagagtatcagttctacttaaatggagaaaaattacactttcctgtgcattttaccacataagttgtattgaaattatgaatacaattcacctattttagcaagaagaagagtgtactgcattcgtaaaaacattatcaacagaaaggcaggcataatgcttcccaaaggatcttaattgaatcatctgaagtaatggaaaatttggagtttagaatgaagtctgtcttcagaaagaactcacagttattgtgacattattaaatttgttttctgcaaatagtttaatgtcatgacaacaaaaagatctcttgatttgagaaaatcaaagctatctttgataacactaccaaactccaaaaccaaaagtttctaatgctttaatatccctcaaaatgctttagaaaaaatatatcacaaagacttttagccaataagatcatcattgttttcacagaaagcatctgttaataatagcttacatgaactgtattgctttagcttttaaagtaatattcaatagtattagaattacagacttagaaaatgctgtgttataattgaggtagtgaattaccagggataaaaaagtggattattagggctactaaatgagcagagtagtagatttctgcttctgaattggttgagtgatctagtccrgtatgctagcttctggtatattccacattaagtatctaacctcatactgaaaaatgtttatatcagttgaaatacctttttgctcttttcttcacatgaatcacaattagcattgcctatgtctcctgaggatatagatttgtacaatcaaacatggtaagtagtaaaggttaaaaagctatttaatagatttttccacatatttggtgcagcttgctggctgatttccgagacttagatttgtgtaaattccatgcttttaattgacagctccctggaggggttgcaatataagttaaggtcataggaagaatattacggctttctatggcattttgtcctttctttaagaactgaagtcagcttactataagatctagttttctagctttgaggagaaaggagagatggaatgtttgtccaagataaatttttgaaggagactaaaagcacaggaaagaggaaattaaaaataaaacaaatagtcacatacacttgggaaatcagtataatctgctatctgaagataaaatcatctttctgccttaagagatggtgtgtcacctcaaggactgagtgagaatggagagtcatgctcattgtagcttgcccacaatggtagcccagtggggtaactctggaatgcatgaacttagagagtcatactgacatctattaatattttaacaataacttttcatgtgttccatttttcctgacagtcattcttcttaattgaagagtgggaggaaagatgggaaaaagaacaagataatttaggaaggcaatgagtagagatgagaaatataggaagctgtattgaaaggtagttttatcatttctaagggtatgaaatctgcatctgaaggtgcctcccgttttgaaattttccagtactcccaaagattttaactctttgaaaacttcattttatatcccagaggccaaatgtagttttttaatgtcttatatttattctgcaatttaggaaatggttaaatgcaccgcccagaagaatttttggaagactagctatcacaaacaaggtggtaaaacataaacaaaaacactggataaggaaaacaagttcttacagcaggtcaatggcacctgtagactgattacayaggaactcgaacatgaggacagtgttactaaaccctgacatgaacccctcttctgggaatgtgcctgctctcagatggtttcccacacttggtaatatttgcattctgtctcacttgtctctgcttctcctcttcacatccttagtaaaacattattaaataagtggttcatcacttttgtttattatttagggaaaaaagtctctgtgaagtctagtggacatgaaaatgttcctcatagatctccaactgctgggaacataacttacccaactgccacattctgtctattaccagatttgtgctaaggttacacttttaccagctgttcccagctaataattgaatgcaacaagtatactaagacaggcaagtttcttggttacaagagactcctatgagggctgattatagctcacggataccccgattccctgatgaaccttccttagactgcatgacagtctagaacgcttccacccaaccttcatatcctctccctttcacttgggaccatctttactctgcggtatgcttattctccacaccgaccacccccatcttcttcctcattttttcttgcataggtgtttttcctaatacattctttgtatgttaaatccattttgacatctgcttttcagaggatcctaacatctggaggaaattaggcagatcataaccgtattgacccactgacattagtagactatgaaattccagaaaataaagatttcagtactgatgtgatgaaaaaatcccaccccaatttagtaaggggttagttaaattaaaaataaaaaatatacaaaaaatgagtttaacattgattaaagacttaaatgtaagacaaaccttaaagcttttagaagaatgcataggggaaaagctctttgacattggacttggcaataatttttttggataagacaccaaaagcacaggcaacaaaattaaaatacrcaggtaagactatattaaactaaaaagcttctacacagcagaggaaacaaccagcaaaataaaaagtcagcctatgaatagggagaaaatatttgcaaaccatatacctgataaagggttgatatccaaaatatgtaaggaattcataaaacttagtagtaaacaaaacaaaacccacagagaagcagataaaaaaaacaggcacatgacctgaataggcatttttccaaagaagacatataattagccaatagatatatgaaaaggtactcaacatcactcatcattagggaaattaaatcaaaatcacaatgacatatcatctcatgcctgttaagatggttcttattgaaaaaacaagagataccaagtattgrtgaggatgtagagaaaaggaaatccttgtacgctcttggtggcaatgtaaattggtacagcaattatgaaaaacggtgtgaagrttcctcaaaaagttaaaatagaactaccagataatccagcaatcccacttctgggtatatgcctaaaagaaaggaatcaatactgagatgcctgtactcccctgttcactgcagcattattcacaatagccaagatatggacacaaccaaagtgtctatttatggatgaaaggataaataaattgtctatatagatacaaacacaataaaatattactcagcctcaacaaaggagaccctgccatttgtgacaacacagaggaacctggagaacattatgctaattgaaataagccaaagaaagacaaatgctacataatcatacttatatgtggaatctagaaaaggcaaatacacagaaacagagagtggatggtgattaccaggggtgggaagatgtcagaagtggggagatgttggtcaaaggctacaaagttacaactgtataggacacacaactagaaatgtaaagtacagcatgatgactgtggttaataatagtgtactgtatagyagaaattttctaagagagtggatttcaggtactctcatcacacacaaaaaatgataactatgtgaggagagtgatatgttgatttgcttaactgtagtcatcatttcacaaggcatatgtatatcaaaacctcatgttgtatagattaaatatatacaataaaagattaaatagacctagaaatacattaaagcaattggtaataatactgaatgtttttatggtgttttatagtttgcaacattcttttatatacattgtacatttttgcatttgggcttcacaaaagtcctgtatgataagcaaagaaacctgtatgatgaacaaatattattatccttcattttaccaataggaaactgttctccctgcaaagtcaagagaataagccaatatcacgaagccagtatgtgatggagatagagctcaaaatgaattctcagctcaagtccaattctcatcactattagatatacaaaaaatgattccatgtccttatttcattttatattgtggataattcaagaatattgttttggaaagtattaaaatgcttttcatatttagacaaatattttaaaaaacatataggttagaaggactagaaagaaaatgaactaacacattttatcacttctttctcaatgggatgctatgtagcaatttggcacttgctcccaggaaatacaagtcctgtccgtggcagctgttctaattttcaaaataaaatagaaaatcatgaatattcaagaagataggcmtctttcagatcaggaaccagaagtctaatgaggctttttaatgtaggtggggcactcaggttacaggcagaggagccctatatgcatttctaacaccaaaaacggcaggggtagcacagtagacctccaataaaaacgtactgaatgactaaaatggcaaggttgagattaaagtctttctaacttaaagacctgtgtctttcctctctgtcaaaaacacttttcacaattaacgacttttcaaatgagttgcaagtttatgtccacacaaaaacctgaacaagaatgtttatacaagctttacttataacttctaaaacttggacaagatgtccttcrayagatgaatgaaaaaattgtggtaatccagacaatgaaatattatttagcaataaaaagaaatgagccagcaagccatgaaaaaaacacgaagggacctgaaatgcatactgcgaagtaaaagaagccagtctgaaaaggctaaatactgtatgattccaactatatgccattctggaaaaggcaaaactatggagatagtaaagagaccagtggttgccagggtctcaagggagggaggaaagaatgaatagacggagaacaggacatttttagggcagtgaaattattctgatatgataatgaataaacattattaagtgtttgtcgaaacccataaaatgtacaacacaacaggaaaatctaatgtaagctagggactatagtcaataataatgtatcaacatcggctcaccaattgcaacaaatgtaccacactaatgcaaagatgttaataataggggaaactaggggcaagggggtggggaggcagggaattgcgggcctatataggagctctttactttccactcaaattttyccataaactaagaacagataaaaatagtctattaattaaaaacaagtgatacacacaatttcttcagcctatgcaatatattctacatttagacagtctcatctaaattccactggtatagggagagggaaggacacaaacatcttcaagggcaaagctttggcatccattagcagaggtgattccagtctaggcagctgaatccccaggcagatttcagcaggtgctgactttccaacagcaccaaaacctctgatgaacaagagtgtcttgagtagaggcttagcaattgctgttttatgattatgtttttcacatattcccaatcccactgaggtgctaatacatttggttcatctttccattttaaaagagacaatggctttgataatttgttcatggttactgcttagggagataatgacactcaaaattcccctaactgaatattataatattacgtctttggctctgctatttttaacagcttttaaagacaatagtgtcatttgggtttaaaaaaaagttcactgttcctactcattaaaggaatactaggttataaagacgagctgtaagagtcctagcagggcttcagattatatcatgtatttagtttatgaatctcattytgttatgaatctataactgaaacaactcccaatgcttcccccaggaagtaattaattggaaaccaaacaaacaaaccacatggaaaagactgaaatactttgtattactgtctgaaaatccaatggtaattttcaagttcattcccacctgagtcctacaaaaatatgctataagtgtgtgttcttcagctacaattctacctctctgtgtatttacaacagctaataagaacaccacccctagaatcaatttaaaacattttctttatgttttgtgaattgcaggaagcctcaacatgcaaatataactattagtacatgtttaattaacaggcatatattacatacttcttaggtaaagagtatcattttagagagtttgttatgtagaaatccataaatttgtgtttctaattttaaaaacagggagctgttcaacaaagaaaatttccaatacaaaatcttatttaacagtcaccaaggtaaacacataagatcaataaaaatcgctgatcatacttcaacacaattatacttcagaaagataaagttatggaaattttctatttgttctaaagcctttgtagctatgagaatatttataatgatttctgtgggaaagccaataaaatcttttgaaaatgaaaaaaattaaatatatctgaagaatagtgtaggttatatctttatctaatattgttgatataatccaaagactgtaaaagatatatgctaaacatctgattagaatttaataagttatttattactgatctgtgccaaacagtcytcaatattttttctaagaatgtttttctgtgaaaatatttttatttttaaaaataaaatttccttaatctaaaaggctctgattcgtattaattcagataaattggacataaagctattgattggctaaaatgtccagatactatactcctgctgggcatatgatatgatttggatttgtgttcctgcacaaatctcatgtctaattataatccccaatgctggaagaggggcctggtaggaggtgactggattatgggcgtggatttcccccttgttgttctcaagatagtgccttctcataagagctggtggtttaaaagcctgtggcagcttcctcatcactctcttcctccttctctggccatgtaagatgtccctggttcctcttcaccttccgccacgattgcaagtttcctgaggcctcctcagctgtgttccctgtacagctggtggaactgagtcaattaaacctcttttctttataaattactcagtctcgggtagttctttatagcaatgagaggacggtctaatacaacatatacatataaataagctacctcttccaaggagataaaaatctagaagacagaaatgaaacataattagcagcagagtgtagcaattaaggcattgtttctggcctcagacctggtaaggatgaatccagctctgctactaataagctaggtgacttctagtgagttacttagccaatatgcactaatgtttcccagctgtaaaattgaggacaatgatagtgatatggaagggaagtgctgggtagggaagagcgtggtccctttaaatgatacagaagggggaagggaagagctgggtagagggggacgtggtccctggctagggctccacccccaggcctgtgtccccacacctaggtgaagacaggcatttttgttttcctgcccaaatgttgcatttcccaagaccaccctggcctgccatgcccccatcctgggcctacaaaaaccctgagaccctagcaggcagagacacacaggtggtcgtctggaggagcagcacatcggcggggggaaggtggggggaacaaacgagcagctggacgtcaagaggtatgtattgacaggcaccagcaggccggcaggccgtgggcttgcagaaacagacgcggagttggcgggggcagctgaaggagaggctaggccgctgagtggccagactccaggagaaaaccttcccacttcatcctccttctggcttcccccatctgctgagagctacctccactaaataaaagcttgcactcattctccaagcccatacgtgatctgattcttccggtacaccaaggcaagaacccgagatacagaaagccctctgtccttgtgacaacgtagaaggtctaattaagctggttaacacaagccgcctatagacggcgaaactaaaagagcacaagacactgcgatagggtcggagctccataacctgccccataacctgcccgtctgtgtgctccctagaggtttgagcagtggggcactgaagaagcgagccactctccctgtcgcatgccctgtgagggggacaagggaactttcccccttttaatagtatcatgctcatagtgttatcatgaatatactaaattaataagtataagttgctttaaaaaagtgcttttcatacaacgagtgctgaaagttattatgtctctttggcttttatttattggaataatggagattatatgccaaatgttgcaggagcagaggagggattgatgaataggctggagaaggctttgcctggaatggacatttatactgaatcatcacagataagaatttcttcaagtggaaagaaggatgaaggaaactccttgcaagagaaaggctggagcaagggtataatcatgttcagccagtrtggctgaggtttaggggctgtaggaggtgatggaaggaaaggcacctgggaaagaagcaatggggtgatactttgaaagccttaaataatagcttaaacwatttggactttattctgtaaagaatgtggagtcaacaaaaggatttttggttcattttaaggatggcagtgaagtggtcagatttttgctattgaaaattatggcagcagtatgaaggcaaactagctggagaagggactcggggaaggtaatcgtgttaaagtgtttaggttatgtactcatagtgaaatagggcagtgggaatgaaaaagaggcacagtgaaaaggagacaggagacatttctaaagtagaatcgatatgagcctcagtcagtttgctgcatttttcaactacaaagttcacatttcccaacataactaagtacacagctcacatgaaaaacagctaataccaagtctctgtagaagcatatcatacactatgtgtgaaatcacacactcactaggcaaataggaaagctgtctttttgtgttagctctttggaaaagcttgagactaaataagtagaagagtccaaagcaaatattaactctggtggtgttaggtgcttggatttctaaacgcaaattgttaatgcaaaatgcattttggctttaacacacgcgagccctttttgccacacactataaactacagaaagagaaaaacccaaagctggaacttaaactctcctaaagaaatactgttgtttgttttcttaagctttgtgcttaccaatttgagattggaaaaagtaaatgcaaaaataaaatgttaataacaagttctgtaatactgtgctttttaatcagtactaatttttctttttaagagaagtttctgaatttatttgggaatccagaagtctttctgaaaacactgatgagtagatcaaggacctcatgtaaagctctgatacaaagtacaaagccaattctaggtgatagtgtgaccaaagatagttgccaaagactatggctgttaattttggttactagtgaatttcagttttgacttgacatacaatgctttccctgcacagggaggcagtggaaaatatcatttatatgtctttcaaatacctctttcaaaagttattggtaactgagagatagcagtctctgatgttcctgtctttctttcccagctgtacaaaagggtaattgagcaaactgtgccytgctctgctgggaagtcaatccatccgtctaacctgcagctgcctggctgatggcctttctcctattcaccattcatttgcttttctgtactctcctcaaatgccccggctctgggaaatgatttccaaaagcatggcctcaagccctgaagaacatggactctgataaccacccaggtcttcattcttacaatgctgtctgccactaatgttaggtagtagatgataagaattttttaaaaaaaattctacataaaatatctgttttataactcatacttgaaagaacactagtgtaaagagactagagaaaacaagtttcttgtttcatcttaacctcattgtgaccttgctttcttgggcttcagtttatttatgcataatatgatataagacaaggcttaaatattctaggattcagattctccaatatgagaaaaagcatacagttaattttcagttggaatttctagccctattacttttatgcctggactggcaaaaagatagtatgtcagatttcttattttcatcttataatttaatttgctgttggagttttcaatgaatattttagtaacttgacattgaacaaactttgattttggtttctaactctatatcaattgataagtgttttcaactgtaacttgagtttgctttagattggttgccactatcacttaagaattattaaacatttttattgcattgcctcagcatgtaatatgttttaagtattggcaggcactatgctttatatctttccaatactactctcataataagcttgtgagcttagaagccatgctgcatgcaggaaattctgattcaggcatagtactgtttcatttaaatagggaacaaaatgaattaatattattcatcttaattactaccattatggataagaaaaataaactacatttcaaaattaaagtaatattttatgtattcaagatcactcagatattattttctaggtatttgaaatctagattcttataccttatagatttttatttttaaattattttagatggagaatatttggaacatctggagcatcttgcatactcttctgatgtcaaataaaattacatgtcaaaataccattatatagtgcttaagatttcactttccagttacactatctgttaaaccaaatattattcagaatgtaaataaacatctccttgataactgttatttctataagcacatactatgctataattcagtgagactttcaggaattactgaactgtttcaaccgacttgccaatatactaaacagccccaccccaaacagtattttgaaattcctgtgctttgtttacaatgatttatcttttctctcactattcctgtcagttgtcagtcactctcgctaatgataacagcccgcatttgtgcagcacctcagagccttcgaagcactcgcccatttattgctcccttctgtgattgtctcatagtccctttccagtttgccactaacatgccaggcctttgaaaacaacataatcaaactttaaaagagattcaatgtaaagagtaaacagtctctgtgagaggggcccaaggagtttccttgtgaataaagtttggttcatggacatcagcatttattttgactgctcaaaacctgggtgtttcctgcagagctgggctctgaatggttgaggttggcagataagaagactccagctgtaggaaatatttctgttattgcccttttataaggaaatgtttagtgattccaagatgtacatttgaaatgataagtgaccttagagataatttattgcagtcactcatcctgtaactaaagaagctaaggaccagagaatttaaagtgttgaagatagaaccgagttaaggaaatgactcttgtgactcttmatccaatattgtttttatgaacaccacatcatgtatttgttctaaatagtcttggtattttaaagatactgaatttttgtaagtttggcatggtgatatgaaatggagataatatatttcaagtgcattactataacatgcaatggagtatgtaatagaaaattaactttcgtatattaaattttaaatattgtatcagcattttctccatagttgctgaagttggaaaggaaatattttaaaagagagatcttttaatgtcatctaaacacccaccacaaacagagcttgcatcgtaaaaatacagaatcctaagaaaaaaagaaagaaaagggaaaaaagaagagatggtgagtgaaagaagctaggaaggagatgagaaaagaggaaggaagaagaaggcaggcaggcttacaggaaaagttcatcattctttgtgtattaatatgaagaaagtatggtaattttttgtgagtttttgtattgtgaaataatgtggaaactgtggtggtaaatcaagtgtaacacttaagaaataatttgggagacattaactgatatgagctctaaacaaaacctccagtgaggatcctgtgtagtctgtgaacaaagccaatctactgcacactgaccttctacaaagaggctctgaaaacaaagtggttgttaggtgaggtaaattgaaataagaaaagatagcagatattacattaaaggctcccgtatttattaagggtacggcaattctaaaatctaattgtgaaatgcagttctccctgaggattcctacagctaattggaacaggtgagagagaatgtagaagaaagaggtagccatatttgtacttagatagttttgggtaagctgtctgttctgtctagaaatcacatcagctttccagcagagtaccatgagaaaatgcttttggttctgtttgccatccctgctaatgtttaccctacttaatcatttgcatttaaacttgatagaccaattacatcaaacagctacctctcygccccagcagattttaatcaacaaacagaaattaatttgtatgtagaaagacagacatgaactgatttatagaatacagttttaaggcaaaaaatatttcttttctttagcaagataagattaaaggactcttctgtacatgactggaaatgaaagccatgttaaagttacatgatatttttggcctggaatttagaaagaattagtaaaacaaactttattacyaggcctattttccaaactggtaatattatagtatgaaagagtcacataatttcttccttttttgctacaatttaacattctagtttgatcttttgctttaaatggtaattcacttaagttttggtctcctctcacctaaagtcacttgctcttaaggaatataaaacatatgtatatttaaaattattttctagttcttagatattaaagatatagggttgccactccacagggctttgaaaaattctactttgcttgggtttttacagtgattaaagtattatttctctttagtaggtacattttaatcactgaacttagaagatatctagtgatattgtactattgtaatttgttgtcattcatttgcctaaagaaaggtgagataagttatatcctttgtattgctgaaaaaatacatcattttgaacatatatcaatacaataagcaaaactctgaaatacattaatatttatataacttcttcaagaattttctcacactgttttagcagttcgtgatggaactaaatctattagaaaaaatactaaaggcattgtacaatatctcatattgcattcttgtatcccataagacaatgggaatttagcaaggagtcrggatcatcttaattgttaaactaaagttttcatttgaatttctgttttattaatggatcaccatgtgcccctgaaggtttttatattggaatgttttactagattccttaacagccatttgcctctcttggatagtggagctccaagcacaaaactttgaagtgttataaaaagcagaacactcctggaatctttacaaatggaacaagactaataccttatgcctacatgatatcaaggcaggtaaaattatattatactaataaagagaaagatgattaaaacacacacacacacacacacacacatttggcaggctaacagacaaaacatggtggtgtcaaggataccaaactcaagacaaatgtcattattcttctctatgtagtgttgagacctgggtcctgaatttcttagcacattattcacacatttactttttagaaaacttcccacttatgctgacattttacattgtgttttgtgtgaccagaaactacagaatacagaagcagaatactataaagagtggaggaaaaaacccagcaatttgaaactcaaacgtcctggttttgaaccctgacaccagacttcctagccatatgactttgaatatatttaaccactacacctccctacttcacaaactgtaaagcagggacaatcacacttatctttcagcattaagtcgataatgaatgtacgatatcagtaacctggaacatggtgggtgcttcacaaaggatagtccaatttcccccytttttttttttttttgaggcagagtctcgctctgtcgcccaggcttgagtgcagtggtgtgatcttggctcactgcaagctccgcctcccaggttcacaccattatcctgcctcagcctcccgagtagctgggactacaggtgcctgccaccacgcccggctaattttttgtatttttagtagagacatggtttcaccgtgttagccaggatggtctcgatctcccgacctcgtgatccgcccgcctcggcctcccaaagtgctaggattacaggcgtgagcgacctcacccaggcccccaatttcccctttcaaacagtaagagccaaaaagttttgatgggcaacatatgggttcagtgactatatcttctaaatgcaaacttgggatataatcttccacgtatgaatgcacttaccatgacagcaggacaaaatatttgaaactatgaatgtcaccacgaaaccatgatgggcatttattatgccatgaggaatgtagacatcaggagactatccaagctcatttatttttaaagaaatttgatttgctaacaacccatgctgtttcacttaaaaaaaataataagcaaggctaactagtgcacaatacacatccagtaaggcattttctctgaagaaattacatgcattatataattcatgttattgtgaattgtagtgttggccaattaggaaatttatacaaatatgaaggcaaaagaacttaaagttccttatcatcataaatggctggggaagtcttctctttcttctctatttcctcatcctatatagtatttaaagaaaaattatttcttgtcttcagtatattctgtgaccttttaaaaatcctattttcctagtaaaatgattcatagctttttaaagaaactaagaagaaaacattcttacggttttgggggtttaggtgagaatacactttatatgaattcttttccttaagggtaccataaactttctattctgcattgattagattcaaaaatagagtaaagacgttttttctttacctgctaagaatagttagaatgaggtaatagggtgaaagaagagatggaaacgtccatttaattctttmcatatttgaggactaattttattacacttcttcattgctctttttcgtctcttttctgtacgttccaccacacacacacacacgcatgcacacacacacacacacacacacacacmcctcaattggactatcagaatatctaactgcaccaatgcaccaagcagaatgagaagtaatttcttcaggatggaactcttctattaataaaaaatcacctcacaatttactttaagataatcttatctacctcagtcactctgttctgttaatgtgcctaacaccaagaatgtcaaaagaccttgcagagaaccagtgaatgagagggggcatgctgagtgacttctggggtgactggtacgacaagtccagcaaaagcgaagacaatgagggagatacaaaataggcatttcctcttcagtgactgaggaggacagaacgcttttgtaacagcctgtttagtgttagcattcaaagtattaactttccttcctctttccctccatccttatcccatttttctctttttctttgcacactacaaaataagaagcaaagctctctgtaacttcttgtaacagagttgacttttctggggaaatgactcttctgaatggctttaagaccacaatataaaatattattatataacaaagatatattaagcatttgggttctatataaactaaaagatttggctataaaattattcgcctaatttgaaaatgtaagatatattcctctatgtgaatataagtatttaattataggaaactacaatgtattggggaacttgcgtattgttatgctctgcaatgtttcacatatgaaaaaggccttttcggctcatatttattttctcatacgtcccttaagttttctgatagcagaaaaaagtgagtattttaaaaatccacatacttccgaaaacagctaaactgaagctatcagcatttttgctaagcacttgaaacttatagtgaatggaactattcgggctttgagaacagccaattgttgaaagttaagaaaaaacaagagagggaaagcagaactagtttagttttcttttggaaaacatccatgtgcattatttaactgagacctattctacaatactgtgatttttaattcccttaacttttcttttactttttaggtagaaccatcaacctgttcttctttaatcattaatttgcagccataggtagtaaatggcactttgatcttgtttgctaattttagacataaacggattctgagtgcgtgctgtgtaaaatgtattattccaccgtgctttgcatactttaagtacaacctcaggttcttcatataaaaataagttcttatttatgttgctgttatctattttaaaacttgttgtctcactatttcattgcctgagtttaaatatgtcatttttttgaaccagggctctatctttcacagattctctttctgtctatacccatcttcatgttttgttttgtttttttttgtccctttgtggaacaaaacaaatttcaccctgttcattcttctagtgctcatcacactaaaaggtcctgctggtactgcagtttttatcaaaaagtttcctacttatagagaatctgagatatcagcagcccccaagtggtttcaagggctttcagcaccaaagaggaaaacaaggagctaaattactttctggatgctccagatttctgatgtggaatgtggtatcatatgcagtgccaaagagtccacatagctttcacaagctcgtcaccacagatgacacagattaagtggtgttattttggtaaggagtttataaaatgttcaaagcttccgggcaaaaagatctctctcagtctgtatgagcaaagagaaagttaggctttagtgcaccaagaggacaggaggtgtctgggagttgcgataagaataagattaagataaatgggggcatcataagagtaaagagaaaacagtggtccaggtgcagtggttcatgcctataatcccagcactttggaaagctgaggcagaaagatcacttgaggccaggaattcaagaccagcctaggcaacatggcaagattccatctctacaaaaaaacgaaaagattagccaggtgtggtggtgggtgcctgtgttcccagttagtcaggacgctgaggtggggggatcacttgagcccaggagttcaaagctgtcgtaggctatgatcgtgacgttacattccagcctgggcaacagaacaagacccattccctagaaaaaaaagaaggaaggaaggaaggaaagaagggagggagggaaggagggaaagagagaaacaaaatgagagagaaagaaggaaagaaagcaagaaagaattgttgtctgacaaaatcagcaggatgtctttcttaagagggagcaactttgttttccttcttaggtgaatgagttcctgcttaggccgaaaaaagagaagaaaggaagaaagggaaaagaagaaggaaggaaggaaggaaggaaggaaagaaggaaggcaggccctttataaaacaaaagattcattgttatattctacaatataacaggttagtgatgtcacattttatttttcccttataaaataccaggaaatacctctgattaaaagaaggttgaaaactgatgactttatactgaacatattggattaaagaaaaatagaaaattgatgactttagaaagaaaaggaggactaattttacacaaagtatataatagctttttcccccccattgggcccatatgtctcacagagatttcctcattgacccttcttttcagcatgcagttagtaaagaaaaattagtttcattctacggtagaggaaatgaaaacaagaaactcttaaattgttttgagatatacgttttctaataattttaaggacatcatctttatccaaccaaagcagtcctggggtcgtatgctggctttactatttacaagtgatgagcttgaaaagctacttaaaatatcctaaaccttaataataatggggataataatggcccttatttcttagagttgttgtgaggccaaaaataagctaatataaagtacttagcagagagcctggtacatcagaaattttcattgctgttgtaacaaattaccacaaacacagtggtttacacaatacaaatttattgtcatatagttcctggagatcagaagtctgacatagggctcactgggctaaaatcaaggtgtcagcagattgttactttctggaggctctatgggagaatccaatttcttaccttttccattttccagaagctgcatgtgttccttgtcctgctttctgcctttttttttcaaaaccagccacactgtatctacgtcttcctcactgcggccaggaagtggctctgttttaaggcctcatgtaattaggttgagcccgactggataatccatgataatctcctcatctcaatgcccttaaccttaatcacatcataaagtcattttgccatgtaaattaacatatttcaggttctggggaacagaatctggacatctttggggagatcattattctgcttaccagagcctggcacatcagaatgtgcttaataaatgtgattattattattatcaccatcattactattttattgacataagcatggtcatacccctatagattcttataacttagttattatttagggaccgagcctctgaaaatttctttgatgagaactgagagaccaaattatgtgaaatgatttgcaaaaggctatccaagcagttaattctgattttgtataattcatagcttctgatacaacacagtgctttcctcatactacagtgctgagaacagaactataaaatgtacacctaatatttacatataagttgaaatttaatttgtatcaaacctaaaaaatatctaaagtacttaatttgcagaactgagaaaatgaaaaaaatcaaaacaataatttttctactttacatataaatgctcttaaaaattcattaggtagaatgcttataatggctaaactatattaaagtcaagttggaattaagttttgaaaaagtgaaatttagaggacaaatgtcatatttctatgtttctttttcttttctttccccttttttgtttctacagttctgaatgaatgtacatgttcagtaggaaaaattaataccccaaaaatagaacaacatttttcatttctaatttatgatagcattacattgctaatgtattattacatttttgtcttygaggagtttccatattagttcaaatgagctacccaccaaaattatttgacatatgttgggttatagtctatccatataccctgctagatggaaataagcacagactaatgatatcttgcaaataaaatttaaatagtcagagaaatcactcctaatcattacattttttggcaattatgcattctgtctttttactttggcaccccatgggaagaggtttcttcattaacaaaggaattggtagtatctgaccaaaaatctgttcagaaattaatttagctatttgaaatttacataggtgatatttctggtttagatgtgatatggtttcactgtatccccaaccagttctcatcttgaattgtagttaccataatctccatgtgttatgggagggacccggtgggaagtaattgaatcatgggggcggttacctccatactgctgttcttgtgatagtgagtgagttctcatgaggtccgatgcttttataaggagcttcccccttttctcagctcttattcttctcgctgccaccatgtgaagaaggacatgtttgcttccccttctgccatgattgtaagttccctgaggcctccccagccatactgaactgtgagtccattaaacctctttcctttataaattatccagtcttgggtatgtcttcatagaagagtgaaaatggactaatacagaaaattggtaccgggtagtggggcgctgctgtaaagatgccgaaacatgtgaaagtgactttggaactggataacaggcagaagctggaaccatttggggggttcagaagaagacaggaagatgtgggaaagtttggaacttactagagacttgttgaatagctttgaccaaaatgatgatagtgatatggacaatgaagtccaggcctagtggtctcaaatagagatgaggaacttgttgggaactggagctaaggtgactcttgttatgctttagcaaagagactggtggcattttgcccctgccctagagatctgtggaaatttgaacttgagagagatgatttaggttatctggcaggagaaatttctaaccagcaaagtgttcaagaggtgacttgggtgttgtgaaaagcattgttttatgtattcacaaagatatgatttggaaatggaacttatgtttaaaacagaagcaaagcataaaagtttgaaaaatttgcagcctgatgatgcgatagaaaaggaaaacccattttctgaggagaaattcatgccagctgtagaaatttgcctaagtaatgaagagccaaatgttaattgccaagacaatgggaaaaatgtctccatggcatgtcagagaccttcgcgtcagccaatctcatcataggcccagagacctaggaggaaaaaatggtttcatgggttggtcccagggtcttgctgttttgtgcagcctttggacttggtgtcctgaatctcatccactccagccatggctgaagggagccaaggtacagctcaggctgtggctttagagggtgcaaggtgcaagccttggaagcttacatgtggtgttcagcctgcaggtgcacagaagtcaagacgtgaggtttgggaacctctgcctagatttcagaggatatatggaaatgcctggatgtccaggcagaagttcactgcaagggtggggccttcatggagaacctctgcgagggcagtgcagaagggaaatgtggagttggaactccacacagagttcccattggggcactgtgagaagagggccaccatcttgcagccctcagaattgtagatccatccacagcttgcactgtgtgccgagaaaagctgctcaatgccagcccatgaaagcagttaggagggggccataccctgcaaagccacaggggaagggttgcccaaggttatgggaacctaccttttggatcagcatgacctagatgtgagacatggagtcaaaggagataattttggagctttaagatttgactaccttgctggagtttgtacttgcatggggcaagagaatgttcagaaaccatatcctaaatcctaatctataacatgctttcttcccaactatgcctcccaaacagcacacaaacaacacacatgcacagacacacacacatacatacacagtgcttcaaatgtgaacagaaaatatacaaaaaataaagactcatagaacacaagtgtgtacttaagaaagaaagaacaatacttttacttctattttcaaaagtactacaggctaagaggattcggcggtacaaaggaaatctgaacagatatctttatttatacaccagtttctttccttaacggttaaagctattttattcagcacagtcacttgacgtcactcttctagtacaaggcatcaactgaatgcttgtgaaagggtaggaatggaagacacttcaaacagttggtatttagaaaatgtgagataataaaaacttgtctgcaatgcctcaataaggaagacacttgcaacctagaaactctcaacaaagaaaaacttctgcaagagaggccacttgcagcctaagacataatacatttttttagcctcacttctccaaacttcttagttactttgctaggtaaacaaaatatcttaaaatgtacattggaatcagatctgaatggtaggaactaacagcagcagcactaattctactttctaaagtgttagtggcatgactggaatgtgaaaaataacacaggtgaaaatcagtaaatggtgatagagatgaacaggttcaagtaatatgtaacaaagaatatccagatcaattttatatttttaacaggaatatattttttttctctatgtcaggayagtgttcagagaatgtagcttccatttagtacaataaaatatattgaattatgcctaaaggcagcataaaaatgtgtatttacactggtacctctgctatgtatttttccctggatgatataatgtcctggatgaaaaagatttcaaaatacctaaaatatacccatttaattatataattatattaacaaaacatgctttgacattttagatgacaatttttctaaaaggcattgaatgctccactgatttatccatcaaacttgataatatgttgaatataatctatcctatttttgatgatatgtgatcataactattgtcctgtatttaagagaatgaatcagctcatacaaaactagttctggataactatcattgtcaacatggccaaaagtctgacttttgactgaacaattatggtatacataaatttgcttttttcactgtaagccattggaatataatatatacttggatatgaaagcaaagtggtacttattgatataaaattggagcttgttagaaataaaaatctyggcaccgcaccctctaagacctactgaatccgaattttgataatatttgcacatgatttgtatccacattaaatttgagatgcattgattttgagcagaacactctccaacagaaaactcttcagggatgaacttccattactaccatctgtgaaatcagggttttatgttcttggatctcaacttttccctttaatactcttcagtccaccttcatggacgcctttgttgtataacatactcttaaccaaaattttatctttgtgataaactctcatgctttaaacaagtttgtaacagataaatggatccattattcaacttggtttagtatcatgaatcataagttcctaaatccttaaggaacattataaatcatccaggttcaatctaatcttgcattttgcagaagagaatacgggagtccaacaaggtgaatcgacccgtttaccacatcaatcaagcattaacatcctgtactctatcttaatcacaggtctacatattcattcattccctccttccttccctccttcctcccctccctccttctccctcccttcccttctttccttcccttctttcctttccttccccttcccttccccttcccttccccttccttccatcctttcttccttccttcctaccttccttcctgtctctcttttactttgttttctgttgaaattcatgaattcactcttttcccacacattagtgtaaaagctgtttaatagatttattcttctttagattcctctaaaatgtctttatccaaatttgtagtaatgttcccatttatttgtacctcacagttccacctttgctactgtacctgtatctaaattaaagctttattagtttttaatggagctctcctggtctccatttctgcctggattggcctttatattcaggctggtggcatcctgttcaagctctttgaccactgatggctgtcttagtctgtttgttaggctgggtaatttataaagaaaagaggtttatttggctcacagttctgcaggctgtataagaaacatggacccagcatctgcatctggtgagggcctcaagctgcttccattcacagcagaaagggaaggggagccagtgtgtgcagagatcacatggtgagacaggaaaacaagggttgggaaaagtgccaggctcttttaaacaagcagttctcccaggacctaacaaaagtaaaaagtcactcacagcccccaatccccagagagggtattaatctattgatgaaaaatctacccccatgacccaaacacctcccattgggtcccacttccgacattggagatcatatttcaaaatgagatttggaggactgaaaaatccaaactgtaacagtagctcaatctaggaactctcatgcaagccccttggtcattgttggctcaatctgggaactcttcttaaaccagcaacctagcctttctctagtaaataattagctctcctgagctggttttgttttctcgctgaaagtctttgtagtctcacttctggggttagaacaaaaaactcagttttaccttctaccctctctgaccctatacttactcttaagaggtactaatgttagccatgacaaagtcataattgctaggagaatataatttctggtgaaagaaaaagaacttgataactcttctgtttctagtcctcctattttgacatctcctacaactcttagattacttgtccattttcattttttttctctattcctccagtgtagctgatagaacctgggggcagaaacacttcattttcttcttataaacctgtgacataagctagggagaaggaaacatggagttggctccacaaatttgattttagtcttggccttatgttagatgtacactccatctattagatggaagttctgtgcagctagccaagggcaggaatcacagaaagatttaagagtagactataattggtaataaaattattaatttacctggaatctcccttgggcataactctctataaggatctgggagatggatgtagatgggagaatagaatgggacggatccttgttatccaaaatgacaacagaccccagaatttttttcatggttagtttttttaaaaaatagttactccaactcaaaaatttccaactcttgcatcttaactggtttcaccaaataaaaacttgtctttttatagagcttgtagataaatctcttgccaaactaggcaaaactcctcttccttcactagtaacccattttgaatcttagcctagcaaagcgtctaaataaataaataaataaataaataaataaataaataaataaataaatgtcttatgctctgtgcagagagatagccgaagaataattcactgctgaaaataatcatttaaatgcaagtatttattttcaaaacataattcatccatttaaagttggaccttatgctaaccaatttgaaaactactgttgaaagataaatggaaactatttcttgaatcaagttttccatctatatttttatgaatatatttggattggttaactataagaagctgactttcctatatgtcccctatctartgaattaatttaactgtctgtatatgtattctgttctgtggtaaattacatagtaaaaaaccagtgtaattataatggatgcatgcttgctaaaatttataagttgaaaatgtcaaatgatataaaacacattctcttctttttaaaaacaaaagctaattccttctaatatggactgtattgtacaatttgttctcctcctttaagaaaaattactgagttacagttaagtacaatataaagataaaatttaagttcgttgaatgcccatttggaaggtagaaaatatatcaagccttataaactggtacaatagtcttattcagagagcagcaatttatgtgaaaattcagtaagtgctacaacacctcaaatagctgagtacagtaggcatccattatgtatgaaagcatttttaaaacatcaagctgcactttagaagtatctttcactatattaggctcttcattcaataatttggactggtgtctctcccagtaggactatcactaatgacactgcccagtgggatgccattttatgaagcatggaaggatcaatgctttcatctgaaaacattaaatttaaaaaggttcaaggttactataaataggctaacccttttaatgatttagttaatagttacagaaacaactgtttaatccaaaaagtttcataccaataactttctatgaagaaatctgatcttgctgttattttggcagttggtaaaccaccaagaggagcaagtacttgcttaactctgattgtaagaactattctttttggtaaattgatgtaatttgtgtccatttctacagcagagtcaaatcttaactttgcaggccattattttcattcatataaatttgtgcttttactaaattgaccttacaagctgttgaattaacatatatcattattcagtgattaaatcaaatactaggcagaaaaatatgaaacagtcatttttgaggtaaaaatgatcacttacaggcaatatcatattgcttaatctaaaaccgaagtatgtaaatatataatttcattaacataatgattttcatacaataacacagatgataatagtaataaatatttactatgtgtatatttattaaataaatgaataaatgatagttgatcaaacgtttccacttattattatagacctaatgcttaaattgaacatttctgggttaaaatgtactggttagatatatttttttgcattctaggaaccaaattcatattttttggttatgcagtggactctttctctctgtcacacacatgtggatgtgcgcgcacacacacacacacacacaatgtagttctgtctggaatctcaaaaataaactagattatctactagctttctttcaggactataataagatttcttccaaatgtatatcaatgctgtactcagagaaaaacaagggcatttttttgagcaggagcagtttgtatgtgggtgttgatgccagccatttggacaaaacatccacaagcatcttttcatgatgcattaaggatgcaagatttggtattaccagactatgcctacttttatttctattcccttatgtaaagcatagtgtagtttgttttcataattcgagatttgatagataaaaattgaacaatgaataaaaggttattctattttaatttttgaacaaatatttatggaacctatctgaatattttagaatgttttcaagatttgtattatttcctatcccccaccaaaaaaaaagaattcttccagactttaattttgtctatgggctcagtgaaaagtatttgctttcctaaggtatgagcatgtactggttcactaacttcccarttgtttttctggctgagaagagcttttmttytggtggcacatgtccatgacagctgtttattccacatgtttccattgaaagcatattaacctgagcaaatggggataattatcacagtgtaaaaatgcctttggatgttaatgattcctcttctgtcgtctcctttgattggcctgaccctcgtattactatgtattaatatccttagatcttcatggtaccaaggacattccaaaagtcatccacattgactttggctcagaaagcttgagttttggtaaatatttttcaattaggtgtgtagaaatcaatcaatagactatttcctcccatgaccatatgtattaatattgactagtaataatttgattcactgacctttcagtcatctgaaattaaattattgagatttaaacatttttttctttaaaatcctgggtatggcagcatgccatttagatgtagctggtgaaagggaatatcacagatatccggatcayagatattcttgatttgatttcccagtttatataaataaatatatatatataactaaaattatatataaaaagtatatgtaacaaaagtaattcatccagtagagcaaaaatggtagtagttactttgtaactttcctagttgtactatttcagtatttccttacatggctgattttcttatatataatatgtatttgacatacaatggctatatttgtctacttttgttaggaaattgcttctgaccaagaacgctttcctttatacctctaatactgtatgtaatatattaatgttaggcgacagctttctgatcattttatcaaatatcttcatttttacaaataaagaaaaaacatgagaaggagacaataaaagacttgtctaagaacaggtaagttgttaaaaagtacttgtcacttaattgggttttgtataatcccaggcacgttaagctctggtattctatacgtagcaaactataaatctgataaaaattgttcattattaggtgtagttcatctcatcccttttcaccccaatgcaacttctgtttacatgtgttctataacacacattccttgtttgatctccatggtatcttgatctcctgcatgatccttctctttctctgactgcagttgtttagattataccaaccacatccttttttagagggatcttttaaggactgcatatccagctttggcaacactcctatgatctagccccacatttgcaattgctcacaaatctttttcacctggatgtttcacagacattttacaggcacaaacagaactaattgttttcttatttttcttaccctatcttccataagcttctccgtacattttctttaggtcactaatttgaccatctatacaagcaacaaaattgggcacttgggagtcaccctgggtttcgctactactctcagccacccacatctaatcaatcacaaagttctcctaatatctttcttttactgatatctggtatctgtcctcccaccctttcctctctttaccacagctcactttaatgcctaacacatagtaggcactctgcaaatatttattgatgaataaataggacagaaatgagtaaacgatgactaagatatagcttctcccctcatttactttattgtaataaatgaagagagacaaagaaataatacatgatgcctgctatcttccagcagtaggcatatatgagaggtaaatttccccaagttggaagtcaaagaaatctttctgaaaaatgaaagcctaggcaaaatctaaattcatttactcatttataatctagttggttttctactaatccccttagattgagaatcaggggggaaattggctggggacaaagggaaatttagttgtttctatgaaaaccagtctggcttcccttctcctcaggtagccatgactacttacatgttcttgggtatgatttttttctaaagcacctcagattgctgtcttgtaaaattagtgactcacagagaaagacgactccacaaattctgaaatttgtgatttcaatcacaaatcctgaaacaattaactagcaaattacattgctttttaatataacatttatagaacaacataattctaatggatgttgtgttttaatataaagtataggctgaataaatacactttatcaaaagctataggataagcttcaatcttacccttcttgtgtggtgtgttccagttctggcctggtctcagacatgtggtatcattcaaaatgaacagaattgtctggtggtttttatataatttatttgttctgaaatggacaaactatactaaaataatgagagtaaaaataataattcaaattttcctaatatattctctggaaacaaaaaaagctcttacttgagatttttgaaatttttcttttaaaatatgaattaagggccaggaatggtggttcacacctgttatctcagcagttggagtccaagttatgcagatcacatgaggccaagaatgtgagaccagcctgggcaacatggtgaaacactatatctacaaaaaatatcaaaattagccagcgtgatggcacacacctgtagtcccagctacttgagagactgaggtaggaggatagcttgaacccaggagacagaggttgcagtgaccaaagatcgtgccactgcattctagcgtgggcgacagagtgagactgtctcaaaaaacataaaataaaataaaatacgaattaatattagtggaaaatgatcagttttcaaataatatttcttggctcttttgttcatttgttttccattaaactttctttttagggttaattagtctacggctacgaaatctgttaaataatacttttgttgactctcaaattacctgatataattcagtaaatagtgaaaaagcgaataaatgtaattctcattttgaaattaaacatataaactatttatctttaatgaattggccaaatagctcaaataacacctttatgattttataaggaaaaaattaggaaatacctaagtaacagataaagaaaaaacataactttaaaaaaaattagacttatttcttttcctccaaaaaagaaaacttctgattcctaactctgtcttaattcacataatgtaatatatggagaaattcaaccaacaaaatctcctcggtttggttcctttttgtaaggatatcatttaaaactgtatttatggacttgttgtagaattagtcttcttataaaagataagaaaaacttactgatttaaaatgacataccatctttaatcttcattttacttatttttaagtccttcaatacctaatgttacatttttaacttggtgacccataatcagcactacatatgttctatgcttcaaaacagaagtttaaaaaataagccatcaattccatcagtgaaaaatgaaattgcagttgttttccagtataggaagacaaataacattaagctgtgagtaatcaaagtctcccctggttctgcttgcaatcagtgagtaagatttaaaagttgattatagtctatagttacggactcagtttttggtttgggaaaacaaaatatttgtatgtgtcttatataggagccaaatctagtggcatttgctttattagccccattaagcaatctgaccccaccaattttttccttaactttctgggtaaaagatacatttcacttttcaccctaaggctgctgatggttcctatttttgtaaacagtgctagtaaaaaaacaaaaccaaacaaaaaccttcttatatcccaaggttgtgctacttttagcctctctgggggtcaacagatagggcaatgagaggagttatgcactgtcacagccggaacagaatctcatcaatcagacaacaggatttcactctctggtgccttctttccactagagtggaaacaaaggaaagaatcccctagaaagcaattctgctgaattactttataagatcaggaaaacaaacaatagtacttatatctctagtaagcatttcccaacatggataaattgttctcagaaaatactttttatgtgaaattttacataaattttacagggagttcaaagtaatagcaaataacagcttaaaaaaactaaagtctagctttctgctatggatggggaagacataagttctcaccccaagatctgttttgctacatgttagcctagcatgtccctacaacaattccagatgactgccatggtgaagccatgctttggagggacttgcatctgagcactatgattttctgttgagtcaaaggtgcagaattctgtttcattctcaaaccacctcttagaaaatatttcagacttcacaatattaacacaccacactcagaaacatacacacctgacacacaaacactccagcaacaagagctttaaaaaacaccagctagagcagcaatttatttatttatttatttatttatttatttatttattgagacaacatcttgctctgctgcccaggctctggagtgcaatggcgtgatctcggcttactgcaccctctgcctcctggggtcaagcaattctcctgccttagcctcccgagtagctgggattataggcacgtgccaccacgcatggctaatttttgtatttttagtacagactgggtttcaccatgttggccaggttggtctcaaactccagacctcaggtaatccaaataaatttgaggacaatgaatgaataaacttttaaattattcttatttcaactgtgtgttttttggggggcatcattaatttgtttgttaacagattatgccaaaatgtgtatattcagattgtttggatggaaattaaggaatgtaaagatgctataaataaaggctaacctattttgatttgtgctttgtgtgtagggagtggtagactggtcacaaataaattgaattcccatagtataacgtatggttcaaagctttgcagacataaacagtatgtgtaattggattttaagggactgataaacaccatgtaagttcatagggaatggctatttaattcaaaatctcaacagctaattttccaaaaaatcatgaaactgacaagcagatgcgaatgaactggcaagttgcatgaaggcatgcaggcagaataaatagtatatgatggtcattataaagaatgttaacaagctaaagcagacttcatatgcaatgtttgtatacatataatttttgtcaagtggtctaaaagcatgtctgaagctcgttgtctctctttctagaaaataatgtgaaaagccagaaattcatatgttccatttgctttctgctgtgctccaagcattttcatgtcattaaaatattagcaatttaaatattgtattttatgtatgatattttagtagttattttgatgatatttaggaaggtttcttaaactcatcaactaaaaagtaaactatctccattcaccatgctgacttttgttagtaccagttttagatagttatactttctgaccttatcctgtagtatatatttgcctcattttggtaaggtttttctattaataacatgaatgactagaagagaaaattaccataagtcataaatattgcatacacacaaactacaagaaatgttttctaattttgtttttaccaaacataatgaaaattttgaagtcagatagaatatgaattttatttaaagaaaagtttcctgtgatcttactgtgaaaatacttattattttagatacacttctatcaagctctattatctcgtttcctaaatctgttatagactagacacaatacattctttttaaaaacctgtaaatgttcagtgactggcttgatgatacaccaataaaataggagggtgataagtggcactaggaaagttatacatgttaattctagaacttaaaaaccaaatcaatctgaggttatttattataagctcagagaactctaaatcatcattcatgcctcccgtaaaatatttatttccaaaaaaatcacaatcttgagatttcttctccaaaaccttttctttttattatctctttaagtattataaatgtatacaaagtggctaaaatatatttgcagagtttagtttttacctttagtaatgactagaaaagctcttattgtactgatcctctcacagataactataacacatgaaaaaatttaagaaacaactgctcaaaagcactgaaatataaccagtggaagattctattatagggttgtcaattcttgggagaagagaatggcactggtgagtttctgtgtgtgtttgcgtatgtgtatggactgcactgggagtcatggagataactaaaatcactgttaaaaaatcttgactttctgacttgagaggggctgcctcagctactagaaattttgtaagggggaatcctggagaggagagaactatagaggcaatgcataaaattctgtaaataaactctccccaaatttctgtctgaacctcaaatcatatatgcatgaacagactccaagaagcctgtagaagattaaaagaacataacaaaaatttaagctgctgcacaagaacagcagccttgaatctaacttaattggctgttacaacaaatacacaaaattcaacactcttgagatgaatttaacagaatcccaagaagtggtaacataacattgaaaatgtcaaggatacgataaaaaattactagatagtagaagaaacagagaaatatgagcaattttcaggggaaaaaatcaagggagaatgatccaaagatgacacagatgttagaattagctcacactattttaaaatatttaccatgctagtctcatgatatcaagggaaaaaatggcttataatgaattaatacagaagatatattactgagaaatggaaattataataaaggaaacaaatggaagtctatgagtaaaatttaaaatatctaatactgtatatttgaacttaatagcagaataaaatgactgaagaatcagtaaacttcaagagagataaaacatattacatataaaaagtggaaaaaacattaaaaaaatcagtgcttcaggaagctgagcattgataccaaaagttgtaatataaatgtcttcaatgcaagaatgagagtagagagagaatgaggcagaagaaataatggccaacatttcccccaatgtggtgaaagacacaaatttacaggtttaagaagttcagtaaatcccaagcagtttaagtagaacaaagccaaacttaggcacagcatagtcaaacttctaaaaaacaaagacagaaaatattaaaatgggcaagagaaaattgacctattacatagaagagaataatcagaaacaattgaggcaagaagacaataaatcaacatctttaaagcactgaaagaaaaatatcaatccagctagaattatgtattcaacaaaaaatattttacagaatgaaagcaaaataaagatatgtacagatagacctatattactagaaatgctaaagttagttcttcaaactgaagggaattaataccaaatgagctcaaaacttctgaaaaaaatgaagagcattagaaaaggtaaatatgtgggtaaatataaaagggaattttccttttcaatttttctaaaatacatatacatttgtattagttcattttcatgctgctgataaagacatacctgaaactggaaagaaaaagaggtttaattggacttaacagttccacatggctggggaggcctcagaatcatggtgggaggcaaaaggcacttcttacacggtagtggcaagaggaaaaatgaggaagaagcaaaagcagaaacccctgataaacccatcagatcttgtgagacttattaactatcacgaggatagcatggtaaagactagcccccatgattcaattacctccccctgactccctcccacaacacatggaaattctgggagatacaactggagttgagatttgggtggggacacagccaaaccatatcaacatttgaaacattttagacatggtacttaaaatgggaagaaattgtatatgtctttggagactaaacgaaagaacaaaggtgaacaaatgttttctaggtttctggcttgagcaaccaaaggtggatatgccacttactgagatggcatatttttgctcaaattgagctgctacaggatttttttttgttgtttgttttattcattgtatttattttcgtacagggataatccttaactggcagttgaataaatatactaactggaaccagtaaagtatactaactggaaccagtaaagagatggcgaagatggaaaagacagaagtctgtgaaagaagatggggtacttattgggatataataaatttaggcaaaaactatgagacattctgaggagaaatttaggtttggacatgagtgaagtgttttgatttagaggtatatatttgagcattattaacacagacataacaatggtagtcatggttgtgaatggaaacatttagaggaagaagagagctggtacagaaacatatgccggaggctcaaggaattccagcattggaagtgtaggtagatgagtgagcagcaaaggaaacccaggattaggaaagaaaccagtattgtgccctgtgttggatgacaggaacaaggtgtttcaaagaagaaatcatcaatagcttggaatgcaccagagaaggcatgaaaatgaaaactcagaaatcccattggattagaaatacaggccattgttggtcttaggaggaatcattttcgtggagggctgaaacttgaaatagaattagaccctcaggagaaaggtatgcatagaaaatgaggatgtggggacataacagcagttatagatagctatttacaaaaagtttgggtgtaaaagaggaaggaagaagaaggtgatagaagagttggggaaggtaaagttatggaaatctattttttatcttaaatgggacatttaagagcatgatgggggccaggatccagttcagagggaaagggtgtacacaagcgtgtaaagttcctgagaaactgggagaagctatgacagatatgagctaccagttttaaaaactagtccaatagtcagaaacaacattaaaaaagtgtttttccttaaacttattcaaataatcaaatgttttgctgagcatgaaatttataaagtagatacatttgatgctaaaaaaattttactaccaaattatgtgttcgtgatgaagtcttctgtgtttaaaacttatgcgccaattaacaaaaagttacagatatattttctctactcagtaaagaccattttaaagggaagtgataacatagccagcaaattagtttcaagcaagtacacaactgaagcagatgaacagaatgcatattgcaatttactgttttatttttctagatttacctgagtgatttctcctcagagcaaccagaatattttttaaatctcatttaaattttgctagcatataaactaaattcatatggaggatattatatagagttatctgtaccattttaaaatgcattcattgaggaaactataaacttaaaaccttctacattaatagactatgcttgacagttgaaattcaaaatccaggcttcaaaacaacccccttagcctattgacaatgtaagcaaatatcttcaaggagaaaagcaggttagaaaaagccttgccaggttttcagccactgcagggactaaatgggtgatgctggctatatattcgaactgtatgatgagatgaacccaccagccacatctcaaccacatagttgttagataattaaatttttttttgctcaaattgagctgctacaggatgattttttttgttgtttgttttattcattttttttttacacagggataatctttaattggcagttgaataaatatactaactggaaccagtaaagcattttatatgtgacaaaaaaacaacaactagtaagccaatagtagtttaaagacagtaattcttataaataaattataataagtaaactattaaacatttaaatttaaaattatagtatgttcattgtcaatgatctcaactttcttcattttcaaagtagtagatgkatctcacttactttcatacgtaaaaaaaagagattgcccttgaatgtaaaatgataataaagcttcttttctttctcgctctctctctctctctttttttttcgcaagaaaaggcttaagcctgaatatttccatttgtcagtaaagrcagagcttttttagcaaattagaccaataatgaatgaagttacataaggttacggtaaatctcttaagtagtaacctcatgttctgggacaatttaatcagactgaacatcctctcatgcaaccagaaaaaatatattctcataaaatttttcatataaaacctcaatctagtctaagaattactttatggaagaagtcagaccatatacacaaacacacaaagttgcttcatgcataacacagagaggattgacatgcacagtgcatatcaacagttctattcagtgcctgattacatctttaattcaaaattatgggagggcaagtaacagaacagcatcaaaattcttgtaacaaagtctacataatctatttgatgttgttggaaaaacagcatatgctttgggtaattgctaaaacctcaaaggatactttcccaattactgagaatgaaaccaaatgctacaaaatttagctactacctgtggtagtgatagacccacaggcactgatggaaccacaggtacatattcataatgatggagttggtaattatgtagtggttgacccttaaaagcatggctcaaccttggcagtaatcttttgaataattagatgtgacagacacaagaaggcagccaccttaactttaaaaaaaaaaacaaaacaaaactgtctggctctgccttattatcagcagctcacattgtctagtggcttaattgacctaaatacctttctaggacttcagtgggttagagtggtgtagaagatggaatgtgccatgaaatcctgtggatgggagccctatacacacactccttagtcataatgtgctttgagagaaactctaagcatataacaaaggaattcactagagccagactgcagggtttctgagctgtggtgtgtgttaatctgaggtttatggtcatgcacattgtatgaaacctgtcataatacttgagtaattcttatccagctatgtttaccagtttgtatttaagcctagggtatgcagatagctggatttatagaggtttgggtttgctaagtaagaaaagtggaagataaaaaggacaagagagttatagtttgtaaggatctaactataataaaagaccatgggatacaggctggagaaggaggaagtaagawcatgctggtagaagggagttggatgttaaaaagcaggtattttcttgtaacatcaagactttttgaagtaaggtaattaaagtaagctagacatatatgttgttgtggtccaaaaatgggctgtttgaacccatgattgaactgcaaattaaaactcttatttggttaaacatgcttgaactccacttctggctctactatatgaatatatatatattttttacattacaatatttgggtacactttatttttatatgggttagcattctgctatatttcatttcattagttttgagaaactaaaaacaatgggaaatcaagggtaatcagtaggtgatttgagggaaatttccaaccaacatgtgagtcttgcagtatatatttttgtattaaaagagaatagttattaaaaaattactatgggcccaccttattagcattattatcttatatacacacagcaccactaatcatttttatacattattccgttgaatcatgctaattatattttgagttaaatatttttatctttgtccttattttgcagataagaaagttgaggaatcttgagaagatcagacagtagttggtggcaataaaataccactgtacttgagaatgtgtgttctagctctcactacttgaaatataacctttggtaaattactcagtgttttgattttcagacatctcaatccgtacaagaatgttccttgcctggaacaagaaagtgcctgaaaatgatcttttcatgtttacaatcctatttgctcctcagtttctagacccataaaacaggtatattgtcacattgtttttctttgttctagacagaataagaggaaatgagttacatacacttaagttgatacaacaattaagagggtgctagctgctggtgtcctgcttcacagcagaaatgataaccttaggattatcaaggcaacttgtcttcctattaattccaaaggggtatgtgatgtcatgtcaagccctaaaagacttaaactttagaatttaaagctttcccagtctgtcttcttccataaaaggaagcaattagggaaatgaattcttctcaggtattagtgatttctatgtatattgcctttcccaaccagaaaagttcaaataaagaaattaattcataaaggaatgagcatcagtagcactgcctaaaaaaacaaacaaacaaagaaacaaacaaaaaaactaggcctacatgagggtgataatctattcagccacaagaaagaaggaaatcctgtcatttgcagccacatggatgaacctggaagacactgcgttcagtgaaataagccaggcacagaaaaacaaatactgcacaatgtcactgataygtagaatctagaaaagttgatcttacagaaatagacggtagaatggtggttaccagaggctggggtagtcattgggagagaaggttgggaagatgctggtcaaagaatacatacttatagttaggaggaatgacttcaagagatctgttgtacagcatggggactagcgttaataatgacatactgtattcttgaaaaatgctaagagagtggatgtataagggtttgggccataaaaatgataactatgtgaggtaacacatttgttaattagctagatttaaccatttcacaatgcatatatacttcaaaacatcatgtacatgataaatacatatgattttatgtcaatttaaaataaataaatttgaaaaaaaccaaaaagtygtttttcatgattaatccaataatatcattaaaaacacaaaatgaattattttcttattacttcgcagctgatcagctccagcaccaattttgtgagctatctcaccataacagacgtcaccccagaacataactaatctaaaatgaagtcgtatttacgtggaagctctccacaccatcaaatttgtcttgctaaacttgaccccttttacctggacccattttccatttgtgcacttttttgtgggataataatcaggatttttacaaccaagaagttcttagaaaatgacatttttccatcccataaatttccttttcctatgtttactttttctttttcttttaacagtttgaccagactggatttaaattccggcttccaaaaaagaactatttagttactgaacaataaaaaattttattccccacactttcaacttcgatctgttccacactataaaatcttccaagtgacattcaaattaaatgacgataaaccartaagttgacctacatgtataagaataaatggctttcctattgttttctttctcctttcctcagtctcattcctttttggcagttgaagttgagtgtaaggacaggaaattagcataaaaataaatgtaacctttcacagagcagcttggaggtttaaaaaagtataccctaacaaatagtgcaatgctttggaaatgggatgatctgactcattaaatttcctcatgaatttaaagtaaaccagggaggaaaacatttttaaaatttcattccttattaaaaatcttttgaaaatgattgagaatccccttcttggcttattaagtataatctatggaagggaatgaacatatttgatgagttaaattgtgcaactcagaatcatcattataaatatcaattattattttacacttataggttgtcttaggagttagaactgattatttctaatcttcagaaaatgccacagaaggttctcttgtgaataaatcctgtttatcgctctctttttctctttctttcaaatctgagtgttacaaaatgctgatgaatgatagttaatcctacttataataactttataccaactttttaggtacagaccattttcagttattaagaggtcaattattttaattataatttaacccctaaacacttgtttcctaacttctatgaacatggtttcttatcctattaattaagccattgcttgacaccaatatattcagtatttactgtggcacaaaagaataatttaccatatgtgtttttttttgagttatcaagtaaatgcataaactctttctcatcttggccttcatacttgattgcagccttctgagactttaggtagcaattgaaaaatgcatgcctttcaatttaagtaaaaattgtagacagacgttaaacccataattacacccataatttgctgaatagttaccaggtatcaaccatgctaatatgtgtgtgtgtgtgtgtgtgtgtgtgtgtgtatgtatataacatatcatacacacacatatatgtatatgtgtgtatataaatgtgtgtgtatggtatggtatgttactattatatattatattaatataaaatataccatacatacatgcataatattgtattattaatattgataatgcccctatgaggtaagaatgattatttctgtgtttatagatttgaaaactggggctctgagaggtgaagtaagccagggaatttaagttccaatatgagatgatgattgcactgtcagctagaacagtaagaaaaagattcctttacgactacaattgggtcctaaatgtttgataaactgggataatatgaaataaatttgagggatattaaaaggacatattccagaaggtgataacagcagttaaaaagtttggagtggagttctgctttcagagttccaaatagaccaacttccctacagatacaaattctaagctacaaattgtggaataaatatgtatatatagtacattttgtacaaacatttagttatttatttggtcctcagacaamatcctgtaaaaacaagaaactcacccaaactcacctagggccattcattttctaggttttgacttttaatttttttctackttctgtttacttttggtctgtctccaytgccttcaatttatataaataatgttcatggtgtcactggtttaaaagaaatagagtttggaaccaccatagcacctggaaagcgaggagaagaaatactgaaaaagagagaattggagggagaagaaggacaagtgctgtgtgtaaactctacctaatatctagcagaactctgaactgtgcagtacagactcttaaaatactaaggctaaaacatctgaatagaaatttcaactgctgcctaccgcagtggtcacaaagtattgaattgattgccttattaaacagacaagtatcaacaacaaaaaacccgcaatacttgttgggggaatataacagaatccaaagtctctacaataattcacaatatccagtgtatgatacagaattgatacacatatgaagaagcaggacaatgctcacatataatgaccaatcaaaagaaactgtaaacaggtaatgaccaaccagttcaaaagaactggttcttttgaaacccaaatgcttgaattattatgcatggattttaaagcatctaactatgctcaaacataagcattcatgctcaagattaataaataaatagcacatgaaatcagaaaaataaaaatcaaataaagttctagtgcagaaaaatacaatacttaactaaaaggttgcaggggacttacagcatttgttcaaataaacatgaatgcatatagacacgctacttcacattttaaatacaaacacaccacaaaactgaactgaactggacattatctttrtgtactcttggtcattgcatatggacctgcgcagccttggtagtaaggaattctttttcagaaagggaacagaaatggcaaagtacattataccagcaaccttacatgtactgccaaccagggacatgaaaccaccatcttcttcatgacatatgtgtgagctgattttcctgcagtgctgacaggctaacaaaatgatgcatattctatattcttttaygacaaattaatattattgaatggatgctagtcaagactataaatacagtctgatgattaaaagaagagtttactatttatcacttgggaagaatgtggaccatcaaagccatgccatcagatctcagccttactattgaagcaaccaatgaaccaatgattgattaaccaaactttttactaatttatttttattaagtggcaattaacaaggtggctttattacatattgtataattatttatcttggttcgtagtagtgccagagaaagagaacggcaaagccragagtttggtaacagattgtctcattatttcttgactaatttgcaggtacatgtttagtctgaatcagacgctcccctatkgctacactcaaaatttgttcttccacattagcacatgatattataattatgattttattgccttcatcccacaccttgcctaaacttcttgagagttgatataaattaccacttctttttcatggggcaaaaatcaaccacattgaagggattcctcaaatctgattcccattttcagttgtcaacaaaactgaaatactgaacatgagaaatgaaaaatgaggaaagaagttttataagtgcttgaaggcagtagtggtaaaaatgtatagtattacatgagccacagtgctattttgcaaaatgagatacctcattttaattgtttttaagtgtaattttaactatgtacactgaagatacaaaataagtttcagggtttgaaaatcatcagaaattaaagtcagtaagaaccaacatgaaaatgtagaaaccacaccctaatcacttctgataattttaaggtatctccaaacctcattgaagatcctataatatttttctaattaagtactcgtcccaaaagtttaggagtcaaataaactaagaatgtcatcttctaagtaagattataatatgagaagttaacatctcattaggagtatttaaaaaggagcgccgtatagtcaacatttccctgtgtgcctctcacattctccatgagtgaggctctttaaggctaataatgttcaataccagcaatccacgcagagacatttctaggttaaagaagatcaatccattaatcctgtactagataaaaatatcatcctttgtgtaattccatgttcacgaaataactatttaatttgtaggctgacattctgaaggaatccacccacaagtgcaccaaactcttactagataaacatttctgttctcaatagaaatgatgaaaaagaaactaatatttacttagcacatagtatattccagagaggtttctaggcacttttcatactagcctatgtaattctcaccagagtcctgaatatgtattatactcattttagaaatgggaaaaataaatttaaagagattaaattacatctccaaagttacacagctattaaatggtaaagttgagaattaaactccattctacacagttgcaaagtcccttctctttctcttctacctgcaaattgataaaatgccattttgctctataaatcagtttctgacagccttacttaatgtaagtcatttctgcagagtctgctcaccctgtgtgagactgataaaatcaaaagcctaacttgttcaagctgttgaaactagacactgagtctccttgtgaaaaaaaaatccaacatccaggcttctagcattagaagctaaaagtcaaatatctgcttgctcatttgaactggatatagatagaatcaattcaggtcatttgtcactaattaatatgtgctgaaacaatgttctaaacattcagggtttataaccttttaattctgcatgtctcagggataccagagtacagtcacctcttgattaagttagatggacaagttaacctttgggccacatcctggcacatgaaaaagaatgattttgataactaatgaagcttggaagagaagatttaaaaaaaaattccagaaagaacaaattgatataagaaaagcacttaaacacttcttgtacaaggaacagaatcttctgaacatatgcagctttaataaatcagtaatcgttaaataaaaatgtgaagatcgcacaatgttaaagaatgcttttgcctgatctcttgtccctgattgctgaaatggctgctatttgcacttaagcatgtagtgacactggcttattcatccacgctctcttggagaacattcaagatgcacagaaagacacttactaggtggagcaagcactgaaaattgggggaatctagacccacaaggacaggagctcctccaaattgttgagcagttaagaagacataatcatggagcagggataataagtcatcatgatctttgagctagcacttaagggccaagaaataaatggtacaataaattttaaaaaatagatatttttaaaatagaaactgtgtataaggactgctttcaataaaagatgaatgcaaaattaatgttttatggagtagatgacaatttagaaaccagcatcactgttagtgatgtcattgtagagctgcttctagggcaacaactgtctttttcttgctgtatcattccttgtgtttaaagtcagaatctatttacctctggcaatgcacagcggtctagacttctggtcagatttaatctgaaatatagatacttttgtgaaggatgaaaaactgtaaaaatttcaaattttttgaaagaagattttattaacaaatacatactaatgtttatctacaataccagtaggtgtagaaacttaaaaaaaccagtaggaggagaagtaaaacatttcctaaacttgctgaggattatcaaccttgatagattcaagtaaacaagttaattatttaaagctggaaagagaactgaagtatgagctagagagggctactttcagattttctgctaaaactggtaacaaactagtccaatcaacatataatcagtgagcagaaatgtcttatgcatagtaaatgccattccttcaatccttactattatctctttttctctacatatttttactagggctctaattatcattccacagctgatcttctgctgaacccatcttgcccatgactaacattgactaaatcatgtcttctgattcttctgaacctactccttaacagctcagaattttctgaaaaaggtcatgtaacagtgttgactgacaccactacgaatttatgtttgcacatcgtgttaccttcaattcagaaaagatgtttttactctttcaaaatcacatcgttgctactcctgcttttgaatcttttagctctttcttgccacagatctttttccttgagctcatgaacaatatacacaagccttttctattttgacaacactttccttgcctcttctaacttctaagtgatactattttttctcatttatttcattatcacaatatctaagtatataccatattatttcatttatatgaaattcagacaaagccaatttatgatgataaaaatggaagcactggttttctatgcgctgggtacaggggagattgactggaaagagattgggtgacgaagatgttctatctgttgactagcttgttggttacaccgttgaatgcatctgtcaaaatctgttaaatcctaccactaagatctttatgtaaattatatttttaaaatattcttcaaggatggcatgcatactaatatttcctctgccaaactgttgtcttatacattcatctcttgtcaactaattccaccataatattatctgcagttaattttgcaaagacagagtcctcacattaaaatgctgttaatcaacagatccagtcttctgggaaggattactccttgctaaaacttttctgtttttatgataaaatatagttttctatatggtagaaaacatactacattatttcaagagcccccaatgcaataaaaagttgttatttgtcctaatatgcttataattatgaaggagaaaatataaaggaaaaactaggctcctgactcaaacacacttacaatctctttgtggactgagattgtcctgccttgagtaactaagagtcacctgtacgtctttgttaaatagaaaatatttcttttaaagttttcattttaccccccataactaaactctttgtatatagaaattttatctgtttgggaaccaggattatgcacaatataaaaatattaacctattaatattttaaaaatttgatccattatattccatttcatagtcaaaaattccttgaaatagaagcttttagtaaaagttttaattaaaaaaatcttaattttaccaatactatctaataatatagtcggacaagacaaaaaatgcatttgactagctaagttatgattgtcccctgtcccatgcactatttagtcctctggaggttgacagattggttctttgagagcagcagttatttcatagtcactaaatgtgaaataacaagttgcatatttcattagcttattttaatcttgcttgtggtgaacaaaatatctgtgcaatataaaaaccttctttaggaaagatgcaagttttataaattgtcaatcacccatataaagtaatctgcagttcctaggaaattgcattccttctattgactaagggacttcagggaaaatactactgtaacaaaacaaaatctcccagatttccaaatagctttattatgtctctgaatccacagcctcactaccctacagttaaattttataacacattcactgggaaaaatgtagtagacatctgtgttacctccaaaagtcgacaaaagatcatttaaagtaactgccaattttaacctttcaaaagaattagtctagccttatgatgcaggtggtatccattgaataatcctctttttctcaaatcaccccaaattcccaattcttgtaaattgcaaagcaaaaatttaacaagaaagttttattgttcaccaaaatgccttaagaaagtatgttaaatttctcactgtagaaaattctgtctctaaagttatgtaacttaaaggtagctataacttttgacttcttagtctatagactaaagtttactggacacagaaatagacaaattaggaaatacatttgcgaagataaaaattccatcagagcaggctgtaaaatgtatgcaagagcatcaacatgaaagagaaaaccatcttaatggctgctagctgagataatgttgtgctgatgcagtagaaataggactgagggaggtgaaatattactgaaatttcaatactggaatggtcctttgggttataccttttctaatcaaaattattaagtgaatattgatttgtatcccttttcgtgattgcagtatggatttgtggaaggtgcacaggaaaataaggttaaaatgtattgtatttgttatgtagtacgtcagctatgaaagactagcttttaaaaataatatccaagatacagatttaagatggtcatgctgacactttatttttcttatgatatggatctgatctctctcaaggtaaatttagagagtgcatagctaatattccgtatgtcttggaaaactacctggataagaagactgtgagaaacagatggaaaggttaggccagcaacatagtatgttttgaacagaatgtcactatgcaatgaaagctttgtaagtacatatatcgtattcagtcacctagcctttaactaatctctttggcatggctttcaactgcttgatgatgttttaaaagtaatattgagtttgaaacatcaacttagatgttttattaactttctgttctataatttactttgctatgggcaatgaacacttgaataaagtttttcttcccagtattaactcatattcattggttaacagtgtaattatttttaaacgcataactttgtacactgtcaaatatgggtcctttgatacataatgtacttcaattgtaaaccagactgtcatattttaaaaagagcataaaggcatttgctgaaactagaaatccaatttttaaaaaattatttatacatgtatattatttctttatacaatgaaatgctacataaaatatataawcaaagatttggggtggcacacatcagtttcaccctcctcaaaatatttgttctttttctcttttctattctctccaaatccacatgccaccttatcaaagggcataagagccaaggaacaaagtataataatattacttacattgattttaatacttgtccctatgataagtactcattcaatggctgttgaatgaaatgtgttcattagctgatcaaattgctattttagtttggctacccatttctaaatttttattagctttagataaacaagatattgtttaatactcatttgcttctagaaatattggcacaactatttgctcttgatatagtaygtccatattcaaaattttattttttactatatttccccaggattatgaaaattctcaaataatttccctgccttctagaataattaaagtgtatctagtgtgaatgtttatgtaaaaaagctggagctgacctgtttctctatgtgggaaagcatgtatacagcattaacatatactgtaccttacaccctagacaagtgtttggcacacagtaggtgctcaataaatatttgcttaattaattaatatttctatgtatccctgttttatccaagatcaaataggaggtggtagaacatggaagataaaacaataaaccaggagttaggagaaatggttctagttctttctttgtttccactaagaataagctactcactgtcttccctaagcatcatctctatttctcccttgtttattgccaatgatagccaatcattcctcaagtttcaggcaaagccccacttcttcacataattttggttaaacctcaaccaacattgatctctccctttccagaatacttacaagtttatccattgacacttaattttatttaatttgacttccagttatgtaatggcttagaccactcttcaatttcttaacatgttacgtgtcttttactcccaataagactttaattcagaggtctcaaactagtatcctgtggggctgaatttgccttatatatgtgttttatttggacatcataaaatttcaatttttagttagttgcagatattcatgtgacattggacgaacaaaaatatagttttccagtttctcttggaaaaacaccaaatttggtcacactggcctgcattcttctttggcagtaatcaaccagagcttaatagctactgacccttttgtccagccacatattcctatcagcccccatcctggttttgctttatgtatgtatgttctctgtctggaacatgtgagatatgtgagattttaacccctgtattatacttcatagtaatacattcaccccaacgcacaccacacacatgcagacacacatacacacacacacacacaccatatttacttgaaatctctaaaaagtcctgaagcttctatctatatatctcttaggcatttcatattcaagatgtttaaattgaaaacatatatctaaattgtcaatttatcattttatttcctatatatcagtaaagtagtaatcaatgaaaagaaatgtgaaaactaatcctcctttaattcttatcttcaccaatggcatgttgggtaattaaaaattgaaaagccattttcacttatttttctacatctctgtacccaaatatttcccaagttctgtcaaatttactggcagagaraagagttatgatgggagaaggggtattcatttccttctctgtgtttcttttgcctctgccctcagaatcttcacttgaagaaagtgtacccttctctctgtgagttcttgtccttgaaattaagagaatcccaccaggaaaccatttgactttgactccagattccaaacaccagagtcaatttacagtcaatagtgaaagagttgttttagagtgtaaattcactttcttaaagcctatgaaatagcactttgaaacctttacaatgatctaagagacaattggtgaaatgttttggcaccatcaagtctggcatgcagccctcaagacaagcagcatttcaacctatatcctgagttgactttctctattagaagcactgcatgtgagagaaacaggaaatctgtgcagcacttttaaagcaatgcggtgaattataaattaatgagggtttagtatgggaagggaataacatctgcagaagagtggatttcataacgacaaaagggaaaaaaggtttcccttaataaaacataacctttctgcatgcacaatcaattctcaattagtcataccagagagactatccaccacatactgtcaaaactgcctcactttgactgcttccttccccaaacacagttctgattctgcttcctctcacctagatgcttcttgaattaatgtttccagcaattttttctatacttttttgtcatcaaaaaatccaatttatttttttatttctatggtacttctactgcattatacagctttcccttccacagcctgctgtcccatctctatgcaagtctaattagtctattagagtgggtaagaaaccagaagagagcgggaactaagaggagaaatgatttccctaggaagttttgtaattccttctttaaatgtctttattaatcacacagcaatgatgtcatcattttagaagttcaaacaaactacaaggaaatttgttggagtactttcaattcaattcagtaattatggattgagtacttactacatgctaagcatttttctaggtatcacatgagtaataactccctgatcttcaagggcttacaatctaatcagaagggaaggtagaaggcaattttgcaaataaacatgacatacaatagggcttggaccatggtagtgccatcaatttattgcccaccgaaagcaggcaggtgataactcagtaatttcttcagtagacattaactgaacatgtactatttgtcatggacacaagatgaacaagataatacccctgtcttcccaatctattagaaaaaataatgcaaggacacaaaaagttacaaacaccatgattaaacttatcatgcaagtattgaaaacatggctatttgagcaccaaaacaaagtctctatctctgcctaaggatgggaagaagtgacaagaagtctttacagaggagatgagtcttaaaaggacaagagggaagaatatttcatgcggaagcaccagaatatgcaaacaattggaaatatgagagaatattctgcattctggaggagttcatacttctggataataaatgtactcatagactatgagtgggggaaagctgggagttgaagcaagggagacaatcttggaaagatttcgcatgtgttgttaagcatccaacacaatgcatgacacataacaaaaatttgtgtgaataactgagtgagaaaagaatttggcttttattccaaggttgttaggtatttatagaaagatttgcatttatgaaaggtatccaaaagatgagtgtaaaggttggattagaagggtaatgacagagagaccaaatagggtatttctgcaatatgccatgtaagatgacataagcccccaaataaagagacagctaaaaaacaggagcagagctatttcagaagcgaaatgctgtagcttgttgagtaactggatgtggagtggtagaagagctctcaaggcagaaaagcaggtttaatatccaccttaaccatctcatactcatcagaatgtattcagttaggtctacatgaggtacatcatatttttacttagataattttaaaataagcttaaatatctagtttactaatctaacttacactacacatggaaatttttgagtatgtaagtatttggagagttgtaagaagtgatagctaatagcttaatcaaggaaagagacaatatcaaagacaaaacatccaattagagcagcctttatttctggcatgattaaagccattttacatttctctgcatgctggagtaggatctcctttggcccaggtacaggtgcatgcctgcgtaccttacaaaagtcaatgtcatacccagttccattgacaggaaagtaaattgctccatatttaaagaagcaacatagaatcactgttctcaagatacattaaagtaacttcaaattcatcattgcttaacacatatcaaatatttggttgaaataataatttcctacagttgtataatgatttgcaatatatctaacctgctaaaatatatctctgaatgaagtgaggcccctagttgcaggtgttaagttgcactgtgttagttcaactataaagctggtttttttttttttcccctgaagtgtgtgtacagtaggaaaagctataaaaatagctctaagaaactagttttttagatttataatgagcatgtttattaggaggagctccattggaaagctccattgaggagctttcaacactatggaggagaaaggtaactaaacattcaggatacggatgagggatttttgaacagtgttttcaaaaagagttagccaggtggagagtggtggaaggacattccaggtaaaacagagaacatgtgggaagctgtggagaccctgggaagttttgctcagtgtsagaaatggttctgattcttctgcacctttgaacacaaacaactgcagcccatttgacatctccctgttttgggggcttgctagtcatgtgtgccttcttccagcatatgggcagcagttcacaacatgtactttgtgtactaatatcgtccccagcttcgtcttattcattctacttaattcatcagtgtcctgatttcttcgttttcttaacatttaaaaaaaaatttttttttttaacttttaggttcaggggtacaagtgcaggtttgttacacaggtaaacttgtgtcctggaggtgtgttatacagattatttcatcccccagggattaagcctagtacccattagttattttccctgctctccctcctcccaccctcctccttctaataggcccagagtgttcccctctataagtccatgtgttctcatcatttagctcccacttataagtgagaacatgcagtatttggttaaatgctcatcaatgacagactggataaagaaaatgtagtacatatacaccatggaataccatgcagccacagaaaagaamaagatcatatcctttgcagggacaggaatggagctggaggccattattcttggcaaactgacacagaaaaaaatcttttaagatgtattttaaggaatattaagtcctttagcataaggcagagcataaataaataactctaatggagggtggaggactcacagtagtagtaccatgaattacaacataaatgcctgaaaagagcctaggacagcatctgtgtgtaattaatagtcatgatgatcactcctaagtcactaagaaacagtttaaactttgcatgtgctacataaaaacgtacattaatttaaaatcttctgatcatttttaaatggttaattttgaacttacaaaccttcagataaagagaaaacttgcctaactagagggtttttttttcttttttacctgaagactatggcttcattatacgcagaagctcttatgcatttgtcttagaaacagccattttacaaaatactccagcatgcagagaaatgtaaaatggctttaatcatgccattttgggcttataacatagccaaaaacatctatctatgaactctactgtactaatattaagaaaacatcacccttctgtacttgaatgagtttgggttgaatgttacatccacatgttaaacgataaagaggagtccaaggtaactctatgtagttgcttataagttttagtcaagcttgaataaagaattatcacacaaactatgaatttttttctgggaatacatagaaaaacagcaggaaaggaagctttgttcctaatataacattgaaatcatttttaagggctcaattttgtgattaacttattagtgtcaatttacattttgtcattgacaatttgtaacttttgaagccattctgatgcaggacagtggagcttagtccgcaactgttcttggctttgtccagcagagaattcaaggacaagctggtggtagggtagaagaaaacagttgtatcgaggcagcagtgttaacagctctggcagtgttacaactcttgtgactgctcctgcagagagcagggctaccccataggcagtgtgctgagagtagcagttcagggcaggtctgcaatcacatttacacctacttttttgtttgtttgttttgttttgttttgttttgtttcagatggagttcgctctgtcgcccaggctagagtccattggcgcgatctcggctcactgcaaccttcgcctcccaggctcgagcgattctcatgcttcagcctcccgagtagctgggattacaggcctgggctggctaattttgtgtttttagtagagatgggtttccccatgtttgccagcctgttctccaactcctggcctcaagtgatctgcctgccttggccttccaaagtgctaggattacaggtgtgaagcctggcctacttactttaatacagatcaaggggtgatttaggtagaaatttcccggaaaagggtagtaacttctgggtcatcgggttattgcctggaaaggcggtggtcgctcgcaggtgctgccattgcaatggtaaactgacakggcacactagtgagcatgtcttcaggaaagctacttccgcccagtccttgtcttagtcctcaattttgtctggtatctgagctccacctccagagwtgagtcctgcctcctaacacagttccatctgtacttttatgtttgttattcgtgtgtaccatttctaccttacctgtttatattttgaacttattatctctaataaaagttttcttttctcttttttttttttttttgagacggtgtcgcactctgtcgcccaggctggagtgcagtggcgcattctcggctcactgcaagctccgcctcccgggttcacaccattctcctgcctcagcctcctgagtagctgggaccacaggcgcccgccaccacgcccggctaatttttttgtatttttagtagagacggggtttcaccgtgttagccaggatggtctggatctcttgacctcgtgatccgcccgcctcggcctcccaaagagctgggattacagacttgagccaccgtgcccggccaaatgttttcttatacaaatcataacttggtaaaatctcactatacatataaccaagcttataaataacattttagaataagtattatcaaagacaggtgtttgccttaacctcttccagtaattcaacaagagtttcttcacataagccattcagttaataaattttagtgagcatttaggccgggtgcagtggctcacgcctgtaatcccagcactttgggaggccgaggccagcatatcacttgaggtcaagagtttgagaccagcctggtcaacctggtgaaactccgtctctactaaaaatacacacacacacacaaatcagctgggcgctgtggtgtggtgcttgtagtcccagctacttgggaggctgaggcacgacaatcacttgaaaccggaaggtagaggttgcagtgatcggagatcgcgccactgcactccagcctggggacagagcgagactccatctcaaaaaaaaaaaaaaaaaaaaaaaaaaaaaaaaattaatgagcatctactatgtgccaatactgttctaggtgctattgagaaataaacaatgttgaagaacttatttgtaacctctgtttctaattagataggactggaacacacaggcagaccgactcagggtcaacttcctaaaactgtgatctactcagtctcccctgtctaaaaatgaagttaatatagaggaaagcatgcggggagatggggagagataatattctgattacatattcagtacccagatccagccatgtctaaggccatctgtacacttgtacttcctagtacttcatgccaagaaattatctttttgcttaaaatagtttgtttactcttggttgccactaaatgagacctacctaataatcttttggataattttgtgcaattcgtcactgtggatatgaataaattaagaagagtatcatttggtaacagtattaattgacaacaaaagcaaaacacttgtcaaaaagctgctagagttttcagaattatatttttaaaaattataaatattattttatctcccttttaatagaataggtgtgctctcttgagcaagtaatttaatctcccagggcctcaattttctcatctgtgtaattggaaaaatgatagcacataggatgatttgaacacaaaattgaataaaataataaacatatagaatttraagctgtatcctgaggacacaattttagtttgtgtatctctcaagatacaaaatcactgtgcaaaaatcataaggattcatttacaccaacaagagacgagcggagagccaaatcatgaatgaactcccattcacaatctctacaaagagaacaaaatacctaggaatacagctaacatgggatgtgaaggatctcttcaaggagaactacaaaccactgctcaaggaaataagagaggatgcaaacaaacagaaaatcattccatcctcatggataggaagaatcagtatcatgaaaatggccactgcccaaagtaatttatagattcagtgctattcccatcaaactaccattgacattcttcacagaattagaaaaaactattttaaatttcatatggaatcaaaaaagaccccatatagccaagacaatcctaaacaaaaagaacaaagctggaggcatcactctacctgacttcaaactatactacaaggctccagtaaccaaaacaggatggtactggtaacaccacagacattgggaccaatgcagcagaatggagaccttagaaataacaccacacatctacaaccatctaatcttcaacaagcctgacaaaaacaagcaatggggaaaggatctcctattggataaatggtgctgggaaaaccggctagccatatgcagaaaactgaaactggaacccttccttataccttatacagaaatcaactcaagatggattaaagacttaaatgtaaaacccaaaattataataaccctggaagaaaacctaggcaataccattcaggatgtaggcataggcaaagacttcatgacaaaaatgctaaaagtaattgcaacaaaagccaaaattgacaaatgggatctaattaaactaaagagcttctgcacagcaaaagaaactatcatcagagtgaacaggcaacctacagaatgggagaacatttttgaaatctacccacctgacaaaggtctaatatccagaatctgcaaggaacttaaacaaatttacaagaaaaaacaaacaaccccatcaaaaagcgggcaaagggtatgaacagacacttctcaaaagaagacatttatgcagccaacaaacatatgaaaaaaagctcatcatcacttgtcattagagaaatgcaaatcaaaaccacagtgagataccatcttacaccagtcagaatggcaattattaaagtcaggaaacagtggatattggtgaggctgtggagaaacaggaatgcttttatactgttggtgggaatgtaaactagttcagccattgtggaagacagtatggcaattcctcaaggatctagaaccagaaatttcatttgacccagcaatcccattactgggtatatacccaaaggaatataaatcattctcttataaagacacatgcacaagtatgtttactgcagcgctatttacaatcataaagacacaaaaccaacacaaatgcccatcaatagatagactggataatgaaaatatggcacatatacatcatggaagactatccagccataaaaaggaatgagattatgtcctttgcagggacatggatgaagctggaagccatcatcctcaggaaagtaacacaggaacagaaaaccaaatactgcatgttcgactctcactcataagtgggagttgaacaatgagaacacatggacacagagaggggaaaaacacatactagggcctgttgggaggtgggagtgaggggaggaacttagaggacgggtcaataagtgcagcaaaccaccatggcacatgtatacctatgtaacaaacctgcacattctgcacatgtatccttttttttggaagaaaaaaaaaacaaaaaatgaaaaaaaattatttcactaagatactggaagggagaaatcttgcttaagaaactgtgaaggtaaaattgagaatatgagtaaagccacaaaccagaggcagataatacaacttgcggtgcagacccaaatcaaggactaccctgagataagccaatgaaaaagtcaggacaagagtgatgggagtgtatatggggtgaatttgggacttggggaaggtggcaaaccaacgcagtgtcctaaaagcttttaaattatgctgttcaaatctcaaatatccttgccaatatkgttttatacttgatctgccaataaccaagaaagctgtattaaaatagtgaaggatttattaatgcctcttcatagatcaaaccagttttgtttatatattttgaagctgtactattcagtaaataaagttttcaattgttatgttcctaacaaattgaacctcttagcattatttaktgactctctttatcttttttaatgcttttattttccctcaaagtctgttttgttttgtagacctgctttctttttgttaatattttcctgacatattctttctaggcttgacattcaaacttttcatgttcttgtgttttatttaattagtctcttgtagaaatgacatagctggagtttgtttctatgcggtctgagggtctttgtgctttaacaggacagcttattccattttccttctttctctttcttgctttcttttctttttttcttatctcttcatctttatccctccctcctttcctccctctctcccttccttcatttccttcctttccttctttccttcctttccttcctttcttcttgcttccttgctttatttttctttcaagatggggtcttgatatattgtccaggctggtcttgaactccttagctacagcaatcctcccaccttagccttccaagtagctgaaattacagggttgcaccaccatgctcagatttttttttcctttattttgtttacttctttggatttatttccactctcttatttctatttatcctttctattcattctgcctttcctgttttacactcacccttcctacctcctttgggtgtactttttctcttccccatcctaattctccctctacatgtttggaattgattaattaaaactctacgtcattcttctgaacgaagtttaaatagtattttttttctccaaatataccttgacctcaggatgccttaaatctgatctcccacccttctaaatttacatactacttttgtccattctaggctctttgcccccaacagacattggatattatcattatttagtgaattatatgttttcttcgttttctctacaaatttaccaaaatacatattcaccatctatccttgcacactccatctattctgtctgagacatatagaaaaaaagaatttaaagttgtgcatggcaaattaaaagtactcaagtatatgacaaatattactattattatcattagttttctcaaagagacttatggcacccatacaattaaagaaacaacaccttatggtttgatatgtattttgctttggaagttatttaaggtaacagatgattgattcaaagtgtattaaatccctctgagaatgctaaggagtgtgtgtatgtgaggtagtgggtgaaaatgaaagttggcctaggacattgagaaggtaaaggaggtggtatgagatttgtgctgcaacttctatcaaaacgtccctgctctggagagcaaagggagtaatgctgaggaattatccggagtatcagacaatagtaagagaaamggaagaaaagagaagtagaagagagatatttcaagcttaaatgaaacagatgaggaaagaactcaacccatgatttaagtcttggggtatctcaaccatttcttgaaatctactctatactatgtacatagcaccttcaaactggtaagttttcatggaactattattagaactattattaataacattatggaagaaacagtgcccagaaagtagtaaacatacagcacactttttgattcaaagacacatatgaatgtgtatctattgtgcttcctttgttagtaagagatgcaatatagaacacaatagacgagtttgagtttaattagcaggacattttaaatccatcatttagaaaacgaggataaaacaatctatttaatgaaagtagtatactgctgttgaagtgtataaactgtgccaccattctcttggtggttttccccctctatttctcattagtttcaactcattaacattttctgacaaatgtaaatcctataaagctgattggtttgattaacctaataaagaaaaaaagccagccacttatcaaccttcacttgacattgacataaagtctttacgtggcacagttcctggattttgtcatttgaaatgggacgagggattgctaataggatgaatagggtggtagtgcaacagattaattaagcagctctcaggaatgatattgaaaggtaactgattaattgaacattgaagccatctaatcaaatagtgaaacaataaatatgtttcttcagagataaattatgcattcattagcatattcatttatacagttgagttaactctttgtgtgcttttcgttttgcctagttggaaatatccacctgctatagattctctttctcttctttctaaaaatgcctggagaacgtgcctgtatttcttcaagatttgaataacttacttattaaatatgcaagctttttgttcacaaaactgtgaaaaaattcactaaatcaatgctttgtcatcttatacaacctkcagccaagcagaccatacaatagcactgaagataaatcagtaagatactattttatgctgaacccagagtttaataagaacatacagttgtagaatcattaatgccaaggatccatcaatatattcatatgtaaatatgcaaacatgccttttaccatgtagaaacatgtttgttttttttccatgtgagccttcagagaagatggtcacttcacagctatgaagttttagtaaaataaagagtggatctgaaatctcagggcatctggggaagataaattcaaagagcctaaaagcagttcatttatactcaagctgtttcccttttgcctaaactgaagccctgcccccattgttgacacccgggcagaatccagttgccacagctgtgcagctcaatgaatagcaagattctgttccctgtgcctgtggatgctcatcatcaaaagatgtctgtcaccctcttgtccataggcgagttccctgccagactggaggagcatagcttcatgggggaagggcacgaaatctcagagataagaaacattgccttgtcagcatctgaaccctggcagcttctagtcctagtgcagagtcctgactgaattcctgtgtcagtgactttcttacagaaatttaagctcttcctaaggcaaagctctccaggagagaagtcctgttaatacttctactgccacagatgtcatgtggaaaattggatggagccatggttactcattgctctaggttggaattggctaaaaaggcagtatcatgtatagaggcaagatgttacagagctgttggctgaaaaaagattcgaaagattactggagtgttttttttttttaatggagactacaaaatgcaaggacattctttttaggtcaaacaaatttaattattttcttttagcttaaagttttagcttaaatgaatatcagatcagttactacagtaggtttagtgactgatattctttagggttttataaaaggtggaaatgtggtaaaaatctatacatgaaaattgctttaaattgaaaagacaaagaagacctctaaatcaggaccaaaatgatttcaggacttctctgaaataattacagttcaggttcagatgaactttaagtagctaatgtgtcttatttttataaaacagggtttccacaccattagaaatcataatcccaactgattttttgttgttgttggtagtgaaatcatatatcaaggtttcatgttaaacacatccaattgcagaaatctagagatctatatgaaaacaatacaatcagattaactaaacctctagtatcttgcttkttatatttttggcctactcttgagaacattagaaagaaaaataggtatagccttttattttctttatgtgtttattgataataatgtcrtgagcctcattccactgccagcattatttgataacaaaagcaaagcacttgtcaaaaatacgctacagtttcagaattatatttacaaaggtataaacacaaacttatcttcccgcacctttttaatttgagacagtttcttgctctgtcacccaggctggagcgcagtggcatgattatggctcactgcagctcgatctccctggcttaagcaatcctcctgcctcagtctccggagtagctgggtggtagcaccccagatgcatgccaccaggcctggctaaatttttaatttgtatttcttggtagagatggcatgtccctatgttgcctaggctggtctcaagctcctgggctcaagccatccacttgccttggcctctcaaagtgctgagattacaggtgagaaccacagtatctgtcttagcttcctcttaacaggacaggtagtgatttacctttaaaaatacaatctctaaaattctgaaatttactcctgcactaaaagtactactctttttcatcttgtcgtcttagctcaacattctaatttttttttagtatttaggatacattgattttaattttttactctttaagtttaaaggagtaacatatatatatcacatttctctttgcattttcagaaaccttagtataacaagattaccatttttgaaattttgtttttaagagacacataataataaatatatttatggggtatatagtgtgatgttgtgatacatgtatacattgtgcgaaaatcagatcagggcatttagcatatccataacttcgcacatttatcatttttttttgtggcgagaacattcaaaatcctcttttccagctatttaaaatatacaatactgttaaccattgtcattctactgtgcaatagaacaccagaacctattcttcctatctaactgtgactttgtacctgctgactcagtttctccccatccttcctcttgtacacgttccagatctgggagccactattctgctctttagttctatgagatcaactcctgtagattctacaggtaagtgagataataaggaaggcctttgtctttctttgtcttgcttatttcacctatcataatgtcctcaagtgtcatccatgttgccacaaatgacatgatttcatgcttttttagggctcagtagtactccattakgtgtgtgtgtgtgtgtgtgtgtgtgtgtgtgtgtacaccaaatttcctttatccattcatccattggtagatacttaggttgaatccatatcatggctattatgaatagagcttcaataaacatgagagtgcagctatctcttcaacataccaacctaattttctttggatttatactccatagtgcaactgctggattttatggttgttccatttttaattttttgaggaacctacatactgttttccataatagctaatactaattacatttccaccagtgtataagaattccctttccccacatctgccagcatttgttattttttgtctttgtgataacagtcattctaatcagagtgaggtgatatctcattgtggttttgatttgcttttccctgattattagtgataatgagcattttttcatatacccattgccatttgtttatcttcttttgagaaatatctactcaggtgttttgcatatttttaaattggattaattgggtttttgctattgagttgagttcctgatatattctgtatattacctcttgtcagatgcatagttttcaaatattttctcccattctgtaagttctattttcactctttagagtgtttcctttggtgtacaggagcatttacattagatgtaattccattttgctatttttgctcttcttgcttgtgcttttgtggtcttatccaaaaaaatccttgcccagaccaatgtcatgaagcatttctcctaggtttccttccagtagttttatcatttcagatcttacatttcagcctttaatcaattttgaattgattttgtacatggtgagagatagaggtctagcttcattcttctgcaggtgactatctagttttcccagcaccaattattgaaagactgtcctttcttcacgtgtatacttggcacctttgttgaaaataagttggctataagtgcatgaatttatttatatcttctctattctgttctgttggcctgtgtgtctgttttaatgccagtaccatgctgttttagttactattagctttgtagtgtattttgaaatcaggtggtgtgatgcctccagatctgttctttttgctcaagattgctttgctatttggggtgttttgtggttccatatgaattttagagtatttttttctatttctgtgaagaatttcattgatattttgatagggattgaatggaatctgtagattgttttgaatagtatggacattttaacaatattaagggttctaattcatgagcacaaaatatctttccatttatttgtgtcttcttcagtttttttatcaatgtttttcagtgttttagtgtattgatctctcagtgtagtaatctttcacctccttggttaaactcatccataagatttttttgttagttattgtaaatcggattattttcttgataattacttgttcatgtattaactaacatttactgtatctgaatattcagaaattgaatagtaggacagcttgattaattttatttcttcaatattaacttctccaatattttcttgttgctatttgagctcattataaatagcattatgattatatcgtatagactaagataaatgaagttcacttaaataatttgttttatatatcatacgtcagataaactgttgattgtctcctggatgtatttggaatgtatgagtcattaaacatacaggcaaatttgtttctagggatgctttcaattctcaaaagaaaagtcactgttcagatttgttaagacaatccaagttggtgtcattatttattatcatataaaactgcattagtgattatttaactaattgactgcttttctttaaaaaagatagaaatagggagatgaagagcatgaatactctttaaagttttacacaaactaaaatagtattattaagcattttggttctaattgtgaagataatcaccttgcaaactaccctgattcagaagtcatggtattttaagttatatttttcatctttgaaacaaattttaggatgtattttgaggtcctttcaaagtgattttatattatgttggtgatatggtttggctctgtgtccccaaccaaatctcaytgcaaattgtaatccccataatccccatgtgtagagggagggaccaagtgggcrgtgattgtatcatgggggtggtttctcccatgctgttcttgtgataatgagagagttgtcatgacatctggtggttttataaggcagttttccttgctcttgcttgttatctctctcctgccaccatgtaagatgtgcgtcttccctttccaccatggttgtaagtttcctgaggcctccccagccatgtggaactgtgagtccattaaatctcttcccttgataaattacccagtcttgggtatttctttatagcagtgtgagaacagagtgtaatacagttggtcaatattcttgcttactaacagaaaatgaattgcaataccagtgtaaaaggaaacataaccacctccattttgaatatattataaaaagaggcatttcttgctctatgatggacataccatgcatttttttaaagagccctttaagaaattagaggtggttactgttatttgaaaggtataacacaagttcagcacttatactgtgctataaaattaccctagaatttctttatcatataagaaacattattaaaacttcagtctatgtttttttggcattgtgacagcagtcctctaaaattgggtgtggattgaatgaaagtaggcattatagaaacatttgattcatctctctaataatgtaaaagtaagagagttttgaattcagttcaaagaatgaaagctataactggcctgatttaaaattattcatgtcagcaagtttatatgcagaaccatttgaaacctgcctgtgcctttttaagtggaaatgaaatttasttctacatttgtccattgtttaataagatgtgcctacatgtatatgttttattataatttaaaagaaaccattttaaattagatatatattttactggtttaagagtccattattttagaaaaactccagttatactttttattaatgaattcttaaattctattgtatatctcttattattattcaatgtcttttagatacctatggttttattcattggttctcaatatttttttcagcttttggaaagctcgcgtgcataatatacttcagtcagacacactgcgccttgcagagtatggttttcaacacaatggaaatgaatagaacagggaggagacatatcaggatctggagaaagctggggagttaggaatgcagttagaaaaaatatataatttagcccctgggaatataggcatgtcttcttgagagaattagtgattgaatggataatgtttccatttcattttccaagtaatacacataacatgttaatggtgtacttgatctcttataaagggtgcacccaaaatagaaacaaaatcttggctgggcgaggtagctyatggctgtaatccccaggctttgggaggccaagataggtggatcatttgagggtagcagtttgagactagcctggacaatatagcaagatccccatctctatacacaaaaaattaaattagccaggcatggtgacctgtagtccaagctactcagggggctcaagtgggaggatccctttagcccaggagttcaaggctgcagtgagctatactcactatacttcaccatgcgcaacagaaggagaccttatcttaaaaagtatatgtatttaaagttgaaggaatcagttttattaaatgtaatttctttctttctttttttttttgagacggaatctcgctctgtcacccaaactggagtgcagtggtgcgatctcggctcactgcaagctccgcctcccgggttcacatcattctcctgcctcagcctcccgagtagctgggactacaggtgcccgccaccacgcccgsctaattttttgtgtttttagtagagatggggtttcaccatgttagccaggatggtatcgatctcctgacctcgtgatccacccgcctcagcctcccacagtgctgggattacaggcgtgagccaccgcgcctggccgaatttactcattttttatgagtaactctcgctctttttaaaaatctttttttctctcaaatatttgatatttttctcacttatcctaagaaacaaactgaaaatgtattttaaatattcacttaaagtaaaataaatatgtataaaaatttacttggctaacatcctgtaatgcgttaatatattttgaaaataatagttcattttacttgagcccatattatgtttaaaaggtaacagggccctaaatgtgtcctgatacctcaaacctgagggagaaaaaagaagtataaaggcccaagatagattggttctagtctcattctaatgtaataatctccacttaataatataaaatctcatccaacctcaaacccagcattgacacatctccaactgtttactcttcccaataaattcacaaatgtatatagaaagaaataatatgtagtggtgtgcattaaatacctttggttattttttaaaactaatgttagactattttttaaatctgaaaatagattctaaatgctatttgaaagggatagctgcaatgatctatgtgcaaaggcaacactcttggaatgaatatattgccactcagggtaactctttgaaaaaatgcagcatccacttagatatttaagtggagttgaaattcttaagataccaatcttgtcaactaattcttttatcgtcatttctaagtattgagaagaaatgttaagctcttatttataaaacttataaacaggattggagtccattacagaggaaaagaatgttttatagaagcttagatgatgtgtggaaaaacagacattggaaggtgaattatgaagggtatggaatactatttcacttattgattacaggatttataagaagtaagttgggaaggatgcacagtcaaggtcagttgcacctgtaaatataagttcayacattactgatgatttacagctccatatgtttcctactaaaaatccatgaagactttttctttcaattgattaaaagcaaaggaaagttgacaagggaactaatgagctatacataatgaataaggtggcaatgttctcatctagtcaattttcctttttataaaactgggagcagaaacttgatttaatgcattgccatagacactgaaccagtaacttaagccatggtagcaactattctgttcagaccatttagttaacatagttaaataaactgtgcaaacatgaaaaactgaatcaattacctgattcagaactaaaaaaaaaaagaaaatgtaaacccacaagaaaagttatatattaagaactttcatatttccttttcttcttgtttggtcacgaagtgccattggcctttggcaaatactctgttaataaccgagtgattatgattgatgggtagaaccaagacataaagtcagatcttaatttacattagctcaggcattcttggatggaggttctaactcctagaaataccctaggtgaaactaaaaatcagttgaagtttcttttcagtgctttttctctgctctagcttcacctttctgtcctgtttccatgccttcattcctttccccaagcagattcaccaagaccctaagtgccaggactaccagagtaactcacatcagtccttcaatgcctgaaaaatatatcctggggcagaagatcagagatagcctaaacagaaaagaaatttgtttggttatcccatgaggtaattaatgattaagtgttaatctacttaagtttcctgactgacttgcttttaaaagggaggtgttaacataaaggcatcttgattagtgacaagaggtggtggactgctaacagattccccagggcatgtgggcgataagaggtcagtaattcagcaaatctttaatgactgccagcactacactggctttttttaaaaaggaagtttcccatttgctgggccttagctgagtcctgaatcagagacaaagaggagatactctctaattactgcctttgagaagttataacttggaggtttttctccaagtccatcctcccttcttcaacttcatcacaacctcaaaatttaagcaaaataagacaagcctgaaaaggccctttgtgctattctaagacgggcagtagataatcaatgaatattttgcttattgacattagaattgtgcaaccaatgctttctttgttatctcttctcaagtgccacctcctaggaggagagttcccttcctggttcatgttctcttgacttcctttcgcctcatttgacttagatgctatgcctttgtatttctatagccaaacttccccaaggtgctttctctagttatgacttggttttttcctggtcccctcaaaagctttagcctgatcacgttaattttcattgattagtagagttccttgtaaatactaagtgggctttaaatattgttgaatggatggcgtgtgagatttttccttttataaagtgttttctgacagaattcatttataacatttactaaccttactttttatgatattcacagaatagaaaagaaaatatctctataagcacacttttcctcttatgttatagccaaatatcaacaacagtaacaacaatgacaacaacaaatagaacagtgtctgcatcacagggattttgcactccaagaaatgactatactttttgccctgaccttcagcctggaagactccttcagaaatataaataggccacagaagttaactccctctgccttgagattgaattcattctgctctctgaatacgtgtatcctgatctcagtgcacatgacattttagatttcagatcaacacttgcttcaattttccaattcagaatggtagaacttcaaaatttcatattgagccccgattattcacatacccaattcccataatataaggtacttactttccaaaagatcataagcttatttcaaaattagaccatttctttatctgtagcctagtaactgtaatttgtggagtacttaccatatagcaggagtattccatatgactttctatatatgaaaaataagaaacyaacataggaggttttttttttccatgcttattggttaaaaaacaaaaacaaaaactgaggcatatgtcaattgcacaaaccattcaaataatgactgctctgggattctagtccactctgtgtcatcactactatggaactttgcactcagtataggtctataacttaaacaattaaatagaatttcttctgagacctggttacacttcccactctcaattaatgattctaaagttctttggatcctgactagtgagaaatacaaatcctgtatcattaatcctaactctctaactcattaccctagctactagcaactaggaagccatagtttctgcttccaattttgattactcactgtctaaggccccccagccatcttgctctggcaggaagagcaaatgctttcacctattttgcaactgtcattaccatcctgatttcatataccttcgtctgtagtattataacattatttctgcttcttccttcctcccttctttcttccttccctctctccctccttgcttcctccttccttccttccttcatttatttattttaaacaagatctcactctgtggcccagggtagagtgcagtgcacaatcctaactcactgcagtctcaaactcctgggctcaagagatcctcagcttcccaaagtgcagggattacaggtgtgagccaccacatctgggctgtgtctctatacaatatctgtagcaacatgattgcttcatcacagagacaagtatttgacatttttgtcattagtcaacatttgccagtgacacttgtaaaattcaagtattgagaattacaagaaaataataaaacctatatacctaataaaatgtttgcataataattagataattcattatcatataattttggtatctattctatggtgaaacattttcttttaacatttatcgattaaatcctccctagtagatactgaataaatacattattgaattatagagatttttcatgtttttctgagactttttaaaagcttaactaacattttaaaaataaaattatgtgtgtcccttatgtataaagataagtaagtaaaatgccaaggagtccgaattatgaataatagattatgtcagcaatatgggggaattatgtaaaaagcaaacatgttaagtatagtataaagttgtataatatagtacaaacatatagtgtagactatatactagatcagtatatagtctgtgaaaaattaaggattctccatcatacccagtagcagaagatcaataattggactatcaagctcatactttaaggaagatcacattctttttaaaggacatgacagatatgactaaaggtttagaaagcaaaggctattagtgggcagcagagggaaaattcttgctttcaagtttattttacatcataggagtgattgtttagagacttatttatttacaaataaactttgagtttaggctacaccatttcctttaaaatataaatgtggcctaaatttaagattgataaaaatatacattttcctactataaaatatgagagtttaggaatctcttcttatttatagctataaaataaattgcttctaatttgtatagaatagtttaagtatggtattttgaatacatttaaaattttaaaaggagttttacactattgtaataaattttggggtagatttcaaaagaaaaattttccacgttagattattttctttttcttcctttggaggaaaaaaaatgtacaatcagaggaagaagctattatcctagaaagatgatatatgtattaggacagcagtctcttaaatattatagctaattggatttccctaccatctatgtaccaaagggttcatgtaatatagttgaattaatcagaatatctttatgcattcagcttgtcttccttattaattattgtggatgaaatgtcctaatgttttagtctcatttttgccatgaagtcctattattgtcatagaaacatatagtatttcagaaattgggaaaggcttataaaaaaacagctaaagatttctccaaaaggtataggaaaaataatcaaagcaaataattacttataatagatgatatcggtttaaaaatatataattacatttttagatatttctgttataggcaacaatcagttgtaagtaaaataaaaaaactttagcaactttgagctcctcaaaattacagaggatgaaagtgagaaattaaccaagcaaatccagtcttagacctaatatttgaatccaaataattcccacatgatgaagtgttttacaccaatatttttgccagaggtcaacatatacactgtctctcccaccagattaagagttacataaggacacaagaattttttgtctgttttgttcacatctgtattctcagtgtacaggacacatggtaacacttcaaatacagttgttgaaagaatggtccttccctttctgactctctttttcttcctctttgacttttgtttgtagtggatatctattgcttgtgataacctagcagtcattcacccttctgggaatagcaccctgactgtcattgcatcatcactcctccccagtactcagtttatgcagttcaggaaagttgacttcattccccactccaaccctgaccagctcaagagatgtgcacatgcttaatttggccagaagaaagagtccatcttattgaatcataagattgatttagatggacatgtgagctacactaaactaagaagactcagttgaagaacttttgctagaactattaatttaaaaaaattaaatacaggctcatgcctgtaatcccagcactttgggaggctgaggcgggtagatcacgaggtcaggagatcaagaccatcctggctaatayggtgaaaccccatctctactaaaaatacaaaaaattagccgggtgtggtggcaggcacctatagtcccagctactcgggaggctgaggcaggagaatggcagagcttgtggtgagccaagatcgcaccactgcactccagcctgggcgacacagtgagactccgtctcaaaaataaataaataaataaaataaaataaactgtttacactgaagttgttgaatggatggattttaatccctgccatcctaaaatacactggcaacaagttgtccaaatgaagtcaagacaagggaaaaccaaactaatatggtttggctctgtgtccccatccaaatctcatcttgtagcttccataattcccatgtgttgtgggaaggacctggtgggagatgattgaatcatgggggcaggtctttcctgtgctggttcttgtgacagtgaatgggtctcatgagatctgatggttttaaaaacgggagtttctcagcacaagctctctctttgcctgccgccatccatgtaagatgtgacttgctccttcttgccttccaccatgattgtgagacttgcccagctatgtagaactgttaagtccattaaacctctttttcgggaggctgaggcaggagaatggcgtgaacccgggaggcggagcttgcagtgagccgagatcgcgccactgcactccagcctgggcgacagagcgagactccgtctcaaaaaaaaacaaacaaacaaacaaaaaaaaacctctttttcttcccaggtttgggtatgtctttatcaacagcataaaaatggactaatacacaagtgaagcaatggtaagatgtgcattttggcatcatataggctctggattctaggcctgcagccagtcctaccccattatttctaagttttatgtgacccaataaatttcatttttatgtaatctagtttgagatagcatcttattacttgctactaaaagaattataacaaatgaatcttccaataccattttatcaattacttatggccctataaagagtaaaaatgaatagcactgtgctgacattgagtcatatgatagcaatggaaagaaaatagtgacagtcataatgtgctctcagaaacgtccagcagggtttgtgtcctccttttatttactcaggaaagtactcggatttaaattcagaagcagtaagagtggattttattttactgttaacagctctaggagacacgttttttgttgtatgacttgtcactggttgcttcagcactgctgactataggtatgacatcagttataattaatcttatatttttgtcagtagtaaacaaccataagcatggtttagaaacagataaaaaaatacatattttagaaagtgatcatgtattaaatcatatagaagcctaaaatgacctgaggagtcattaacctgtatgcccttgttttacagttgaagaaagttaaggaattgcctgatgccatatcattgattagtagcataggcaaagactataatatagcaagccaaacaatgattttacttattttcatacaacagtttctctccagaggcttgctcttaaatcacatatataaggattttaaaatattaagtttaggatgcgtttcacatgaagaaactggttgacagtttacatatacatgtataatcactgggagaaatggcaagaaatttcattaggtgctcaactaaataagacctcatttaaacaatgatttcacgagcaccttcaaaattccaatataaacttacccatgagttaagaaataaactgcttcatttctagagaattaactgtctttaagtcagtgaaacataatttatctaatgttactttagtgtcctgacaatttaatttatccctacttaccagtaagaacaggtctatgaattactttagtaattgcccaagaggataaaaaggccaatgtagaatacatttatgtatattaatatataagatttttagtgaaaaactcaaaatcggaggaaaaataatctcatatttttgaagtaaggacaagccattttaaattaaaatctaatttaaaagaaacagatgttagcaaagctaagttttaagtgcaagcatatttcatcctaatttaccatgggctacagaaaactgagataattagtcaggatgaaatcttatgtatttgaaatttcccccaatattatactttgttttcctgcatgttttctcgctccaatattaatcataaaatattttatagtcaaactaaatgatcacagaatgtgacaaataaagagtgctttgaagttcttggatgaaaagctctgtgttagcacaacacattattagttccataaataccaaataatttaaaagggaaagtcacttcatatggagaatagacaatattttaaagttgttatgaatcatgaaattcttaatgtcaaggatacctttgtcttatattttctgaccagtcttataattaagccctttcctatatcccccttagtgggacaatgaaataagtgatgttttgggggatggacatcagaatacaaaaaaacaactgcattgatcttaattactcagttttcttcctggcaacagacccaggaggactgtttttgcagtgggatagactttaattggtagattcaatccctctgactagttcatcagatatccattacaaaatttaaatgcactgtctataatccagtgttcagtatatcagcttgtctgagagtgtgcatatatttcttaaggtgatagaaagccctttcctatatcccccttggtgggacaatgaaataagtgatgttttgggggatggacatcagaatacaaaaaaaaactgcattgatcttaattactcagtcttcttcctggcaacagacccaggaggactatttttgcagtgggacagactttaattggtagattcaatccctctgactagttcatcagatatccattacaaaatttaaatgcactgtctataatccagtgttcagtgtatcagcttgtttgagagtgtgcatatatttcttaaggtgatagaagcaaggtcaagctactccttctctttagtcccatccgaaagaagtaaaggaagaatttagtgacttggacatcactggttttcaaatattctatgcaatatagtgttcaggatcttgtagtgaaacactttttgcctgaactaccagaatgttccactaagccaaggcaagttctgactggaaaacgcatactgaacatccatttatcaattaggcctgtttctcctttattaaatttggcttcaggatttgggcacctaraatggtgaaaagcatctggcaatagcagaaaaattaaactaagaacagttcttagaaatccttgtagcctgattattatagccataagcaagagttttcattgtctctgaaaggaggaacaagtggtatttatgctaaagtttaatgtttgcaatcctgattgctttcctatatggccacttcttaaagtcttctgaacaaagttctccagcttaatatacctgaaaatctttttagtgttgatattagtttggaaaattggttatatgaagctggttaatacatgctcctgttacgtttcacagaatatgattagaacaagagtgtatataaatccttgtaataacatactggtttgtgccagtcatttgttttgctgaaactctgcaggacaatttcctttctagtatgcattttgcattctattatgcaaaagaaaactattggagtggagtactaagtaagtaaatgtaaaagtgtacatcttggaaggcaggagtaaggagttagtaaggagtttgttatgtgtgaagcgctgtgctaagtttgacattttatgtaacacttaattctcattaaaacccatatgaggcaggcagattacttcctttttacagatgaggaaaccgaggatcagagagattaaaaaaacaaaaaccttttaaaccaattttacaaaagagaaaatcggaatatctacctagagcttcctggaggatctgaagctcacatctttttcaaaacaaaatgctacctcaaacataagcagttttctatgggaagtgtaatagaaactgcttcttccaggattgtatttagaacttgagatatgaacattsaagtttatgtttaattacatttcatacattattttcaaatgttttaagaaaaaggggacttatttcagatgattttatttgaatttttctacagaaaaaaataggatttgatatgcatgaattcttaaagcttaatttaaacaaaccctaaaacgaaaaatttgcaagttgtatattttgcaattgtcaataactctatttgaaagagcatttccatggagacctcattataagtaagagtttatgctttactgaatattctctaagaatagagtattcatatgtctaattctgtcataaatgtatatggaagagatttataggcttagcttattctttcgttttttcagacctgttcattattacagctcaagttttgctgcatgaaatcttcattcatattggaaacatactctgttaaaaagcatttgttcagtaagatttcattataatctaaaatgagtgcagaattgaaaagtaaattactatcatacttttaaatgatttggtcctcagtttgggaagaacggcttctgaaatatgacatagttaatgataatgctgcacttccactcactgtcataattcataacaaaaacagggtgaaaactgatttcaaaaataataaacacacacccatgagagcttagactcgttcctttgtatagttaatgcatggtagattgattggtttaatggtctctattctttaccctttcctgtagacactatatttgccatgtgactttgcagtttctggcaccacggagttacagtctatttccccacttcttgaacttgggctcaccttatgctgtcctttggccactgtaaggatagcaaatgggatacaagcagaaagcacttacacattttgcttacttgcctttgctcatcgctatgasaacaagctcaggctgtcctgcttcatgatgagaggcaaccatggaccagagctgagttgctccacttatgtcatctgaggcattactagctccagatgactccccctgtgaccactccacctctgccatatacacatatgagtgagccctgcccaagtcagccaaacttaacccagatcagcttaccctgatagattcatgagctaaatacattttcattgttgtctgctgctgagtttcatggttgtatacaatgccacattactgtggcaatatctaaattatataccatgtctcctcttttttttttttttgtttcgaaggatataagtggggatttgcaattagggatcgagtacctcttaatagaatatactttctatttttaaattaaaaaatggcccatgagcatatttttaagtttaggttcacactaaattaccattaacgtctactatgtttctggcattgtgctaggaacttccaaccataagtagttcaaaagataatgtctgaaactatttgagcaacaaaatagagtagtaatggactataattcatagtataaaataatatccatattcatgagtccatactgataggatgattaaatacattttaaaatggaagataatagataagtctctcatgcagagcataaatccaaacaatttaagtaaatgctccacactcaaaagggtggaggataaatattcactccttggaaaagcagcttctggaacatgaggtgtgagctttgcatagtgacttccttctaaagaccacaaaatgaaaaaagggaagaagcgtaacttcatagtggagaaatacggcaacaccaacttagccaggggatcaaggacagtagtaaatcatgttaacagtaagtacccttgatttaatgtgatgagaatgccattttgcctctgttgttttcctcccaaaacccaatgactgttatcccaatattatcataagaaaaatgtcagacaatttcaaataaaaagacattctagtaaatacctgaccaatacccctcaaaactgtcaaaattatttttaaaaatgtaaagtttcaacaactgtgacagccaagaacttagagacacgatgactaaacataaagtggtatgtaaatgtcacagaaaaaggacattaggtaaaaactaaaaaagaaaactgaataaagtatgaattttagttgataataatatatcaatattatctcaattgtgataaatgtactataaatatgatattaatatagaagaaagtgggtataaagtataaggaaactctgtactagttttacaacttttctatacatttaaaaatattccaaaattaaatttctatttaaaaatatagtgtccatgaaaatgtgttgatatattgtgtgtttattaaaattatcatacattgctctactgcatagatttaaaattgtgcaggactggttataaacaacctttttgtttatgtattattaatttgtttgtttaactttcattactgagtaaggctctcttgaactttcaagcatagctttaaaaagttcaaaaatttataattttccaagcattacaatatagaaatgaattttaacatattgctaatttaatgtagatcaataataaaacagtactatctcatttttaaacataagttttgtaggtgaaaataattcattttaattctaaaatgcatttaaatgaatagttgcatactattttaatgtaattttgaaaataaaatgcaagttacataatcaattggtgttcattacattttctaaaattattgttaaatatcacttcttgtcacattttctctggagaagattaaaggtagggtcacagggataccagctgtttaaatactctttttgtttatagtgctagcttaataaataaccaatttgtttaacaattataacctttattcagctgaaaagctttcatggagatcccctagatgtggaacatcattttttaaataccaggtcattacctttaataatttgatactataaatgttcaagctagttcatatgcctgtgacttaaaaaatcaaaatatccaatgggctttggtaagcaggtctaaaagataaaggaagcaggtgtagaagacatttaataaaacatgcttctcatttttattccttttctgtttggtttcttgggaatctctgtttgacagtgaactccagtgtatttgctttgggcagatgcttttattctgagtctactgatgtggcaaccaaaagaaggatgacagaaagtaaagttgaaacctaatattaagttttaaaagcaaaatagattttttgcagatggaatttgagtttaaaaaattttaaatggtggcttaataattattatctaaacaggcatgatatgaaggcatagattattgattctgaccataggttttataatgaatcacattgtttgatttttttcctgtaaaaaagaatatcaagaaaaattcattgactgtgtttcttttgtgcccaatatgatggttttatcaaaggttaatggagaattgtaagatactaaggcataaagattaaggattcattttttcttttttaaagggcttattcataccaattccaggctagtagcaccacattgtttttcttgcatgtcctcacaaccacatttttcagttttaatatagttttcaatttatttacttcagtagtattgatctaactttgctttggataatggttcacacaacaactaccatgtttctataggagaggcaaatagtgaacttattgagagatacataaatacagtgttcttgaattaccttttgaaagtgacaattctgaaatacttaccagaggtcaggactgtaatgtctatctttgcactttgctcaatatctagtttcctcattcatgaaattggcacaaaattaaataatagtattgtactcatttctagtatttataatatatccattatatatttaaaaaatacggagtactcaatctcttccagggccagaaaaaaagaaatattatgatatattagaaagatgaacttttagaaaaatcttttcaaattagtggtttagggctrtaagggtgaaaattaaagttgaaagatagaaagaaaattgttgatgtgcatgattttctttttaggctttattgtttccagtctgtttaaacttatgaggatcactgttctgtaagaaggatattttaamcctggaaaacatttaggtcaaaacatctaaacttctaattctaaaattgcatgataatatttactcagtcatggggtatttacacaggatatgagagtagtgtggtcccaacaacacatagcaactcccagcctttgcagagattcaaatatttagttcagatatttcgtgattacaaatgaagaattaaaaaataaattaaacattttttttctttttcaaaatttttgtgtgagtaggagccaaatatatattacctcaatccagcttattatttcctattttatttaaaaaagtataataggttttctccaaccttgaaatgatttttctggaaactttctctgtgtatcatttaaaggtgttttccaatggtaagaactttgtgcatatagtggttaggttttcagaagagcctatggaagccaaagaagaatattaaaaagcacaggtgagttaggttatgctgggtgtatctaaaaatcggagaaactctatgaaccctccccgccccaaagacacccaaactctacctacaatttcacagagtaaaaaacattgtacagcttatttagggactattggaagctcaggggttaagagcccttgtcctaggcaaggtgtcagatgaggggagggggtgggtagatgaagaacacagtggatactgaaagagactagagcttcctgtcttcagattcctctctcttttcctccccctttaaatgctagcttcagcccatggtgatgaagcagtggggacagggggccagaagtggcagccatggaagttttaaggcaatctatgagtttgcctttcactgccaactcttctttcctttctctgcttttcagctgttcttcttcccttcttctctacctctttattacagaggaacaaaagcaacagtagaggtaggggcaactgcagcttgtcaggtaaagaaggagcacaggcaatgagagtcctttcctaaaagggtgagagagattaccttgcctctcattctgttctcctagttccctggcctccctctctatatatactctcttcttcctgtgttttctttctctccattttcaccctgggcatgggatttctaagaaccgaagatacttctttgaaaagggtaagcagtggtgacaataaggaaaagatttcctttttttccccttccttccccactccttaaaaatcccttctcytaggacagaacagtcccacttggcttgaggaagacagatgaatttccatgtctccccagaaggatcattgtatataaagtacaagactgcctatattttgttaagttgtgcttttatttaatcaataataaaaaaaattgaaaataagtttaaaaattgtttcctatgattcctttttgttgtttttttgggaggtgggggcaatcatagccatacttatgtccaaaggaacaatataaatattgttaagtactgttaagtattcctagttgcataggaagttaacaatctaatttgcataaatggaaagcaagttcgttgcttttcctcatgtcagaatactgaggggcttctttgtgaaaaacacttgtagagatatttgtcaacgagtacaaatctacagtaagataggagggataaggtctggtagtctattgcacagcaggatgactactatgatatataatacaataatgtattccatattttaaaatagctagaagagacttttttaatattctcatcataaagaaactataaatgttaaagtcatggctatgttaattaccctgatttgatcattacaaaatttatacatttatcaaaacatcacattttgccataaatatggtacataccataaatatgtacaattgttatatgtacattttaaagaatataataatgttttatttccaagatattattaaaagaacctaggtaccaacaaccttaaaaatacaattaatatagaaatgtgattcttttgatttgacactaggtaaaaagatcatttaatttaaccttctaattttaccagttagaacactaaggcccagagagcttagatgacttgtcctaggtcactcagcaagttaaagtcactaaatatagtttgaaaaataccctgactctcactcaaattaagtgtccaattcacaactttaacatgtgaaacatagactagacaaaatgggaaaaataaagcttagttttgctgtgacctaaagctagcatttccttctactgaagggataggtctcccatgaaaactaagaatatacatgaaatcatgtaagcatctccatttgaaagagcgcctgttcgctctttaagagaggaacaaatcaccaaccacatagccagttaggtaaagattattgcacaagttttgaaaaaatattttgcccttttaatgatcatgtgattgataccccaactctacagaatctactccactttaaagtaaaaaaaaaaaaaaattaaaaatatgccagtgaaaatccctagtagcagccgtattaatatttttgctacatacatattagtgrctatttaatttatgcctacttgttataaggttctgcatggtacatttaaaacataagcttacagttaatcagaagctaattaaaaactttccactataattttctgtgcatgctttcatctgtagttttacaggagtaattatatgatttttacagtgcaatctatttaatttttgtgataaattattttttaaatcattgctggagaatgaaaatcgtttctccgggatcagaagtgtgtagcaaaggcaaaaagcataagacatctccaatgcccaatgcaggagtctcctttgaaagactgagaggttccactctggacaatgaggaaattttgcctcccctgccctgctcaagcctaggtatataacatacacacaggcgcacacacagagcaaatagaaccaatgtgtcatcaaacatatgaggcacagcataacctcaagtaaataaaataatttttcatagagactcacacttatgctaaaagaactataaaagaattcaataataatgaagtacaaaacaagatttcgaaggttctgaattttacaactgataactctgttgttaagacaacctgaggcatctttgagccctattctcctcatctgtagaatgagaatcaaaatagctaaatggcactcataggttggaggcagtatagtgaaattgagagtaaggaccttcatgcaaaacaccccagagttcaagttctagttctaccacttactgcatggtgctaaacacaagggcagacacatagcatgtattccattttgatttatttactaggtgaaggaggccaatctctcaagtcagaaagtaaggtactctttccccttattcacctattatagtctatcaacrtatcatttgtttcttataaatatctatggttttctggacatggttttattaaccgacaccattttagtctggctgtgtgacctcacacctagattcctacaaaatcatcctcacttgtcttgctaatcttgtccccttccaaacagatttatcttttcctgccatcttaagacatacctaaatataatcaatgtcttcaaatgtcaacctcagcaaattcctattataatgcctgtcttttcagattgtctttaaactggccatccaactattcaacattacctacccacaactctaaaatcaagaggggtaaattctcagtagaccaccatgaaacattctgatttcaacaccaatatgcttatgctcacaatatttattttgcctgaaatgtcctgtcatcaatgtaatggaaagaacatgattttgaaattcggactattctaagagttcatctgaattctggaatttcttagacgtataatttaggatagcatggctccttgcaaaatgagaataataataattacccaacaggcttattgtgaggattaaatgagaatacagtaattaatagtatstaggatttgataccataacatggctcaggcttcattttattctttacatatgtttttatgtatttgatacccacaaaaaccctacaaagtagatacaatttctcagacacaaggaaattacaaaatggagagctgaagtaaattcctaataaataatatctggcttctaacctgacaattttaaccactaaaaaaccccacatatctagaatagtgtacatggcacatgtaccaaaaatgttagtgaatgaatgagtaatctgaaatgttaatgaaaatatacattaaaaacatactagttagatgtcccccaaactattcaaataagggtagcttatttaattcaagacagaatagtcatcatgaatctaagttactgactatatgattaggctcttttctctagctgtgtttctcttctgtaaaatgtgtgtgaactttcaactacaagctcaagagtttgttaaagtggtgattgctttgaactttaaatactgagttccttatgttatagaatgagaaaacatcaatttgtagaataaaatgacagatrtgtgtgtataaatttctagcgaaatatttgcaagtgttgcrttacaaactcaaagaatttaatactcatctaaaagaaatcttggtcattaaagaaacaaacagagtcctggaggagaattaggcagaaacacattgaacagaatttcaggaagacctgattatatgatgttttcttttttttttttttccctgaaagaacagatgttaaaaaaaaatgcctagtagctatgattaactattacccaaagttaaagaattattcaatattaaatttctaggataactgattaagcctaatgttaagtcattggccctgtttgttctgcgccaaaagaatctgtactcaaatgagacgccatagacatgataacagtcatttgtcacaatatttattgttttcataagccctgaaaaagtgcatcagatatttttattgaatagtgggagggagaggatttctcaaagaaccaaggatattatagtagtgaactaaagacattataatataatgtttataataaattattgcaataaaactcttactctaaagactttgattcaccatctacattacaggaatgcatctcttataaaaaatttctatttcatcttgctctttcaaacaatgtacttgtgaccagctgtttctttcactgctaacaatgggaacttacattagaagattccagtaaaattatatgacataactatacattatgttgtaaaatgggatagctactgtattttcaaggccgaactagtacaactgatagttatgagtgtaatcatttctgaaaagcatgttcagttgttcaactatgtcattccccagagtaatgactacactttccttctgtccattaatgcttttcctcactcaaacattttgtatcccactgactcttcaggaagaggttggagaataagttcatctggcataatttcattattatcagtggcttgaacacaagttgttagaaaaagctgttctatcttattattattgaatgttctgctccgtaatacaacaaagaaatccaatactgtaccataatgacaacatttagcatgttgcacacattaaatgattacaacagcgccataaattaaggaaaggcactattttctccatttatctttgtggtctggaagagtacacttttttgcccaaggctataaaatatctcaggggcaatgcaaaaaatcagaaactttaattggcaattggcatacaaaaagtgcattagttcagataaaaatccaggagtaaaaaaaaatttctgcctgaatgcattaccagtaccactggaaataatgttggaatcattagttgttttaaagtacttttatccagtcattatatgaaaaagacatgtgcacaggtatgtttatagcagcacaattcacaattacaaggatatggaaccaccctaagtgcctatcgacccatgaatggataaaggaaatgtggtatatatataccatggaatattactcacccacagaaagcaacgtaaaaatgtttttactagcaacttggaagaagccagaggccattattctaaatgaagtcactcaggaatggaaactcaaatactgtatgttctcacttataagtgggagctaagctgtgagtatgcaaaagcatacagagtgatataatggaccctgaagactccaagtgggaaaattgggagtgggttgtgggataaaaaactacatattgggtacaataaacactacttggctgactggttcactaaaatctcagaattcacctatgtaactcacccatgtaaaaaaaagaaaacttgtaccccaaaagatattgaagttaaaaaaaaaattaaaaacctcaagaaaagtattttcatcttaaagaggctaaaattgttcaacactgagaccccagaagtggaacaaaatgttttaatctcatcaaagttttgactcaagaatgaacaaaattcttttagaaattttcttaactacagtgcttcttcttgagagatccactttgaatgccatggattggtcacagctgtggaacctaggatttctatgggtgacaagtcttaatccacatttcagggtagttcttttctatcagaaccatttccttcttaagcctttatcagaatagaacaggctgaggaaaagactagatataattaaaagtaatctatttgtcttctttttttaaaaatagagaattctttaaattaccaattttgttggcatttataataaatgtttattatgaattgaatatgtggtcattgaaatttggtattatcagtgttacgttcatcacaaagaattaaattgctatggaccacaaaagaaccatagcacaaacacaattctccttttctatcaaggctgcaatttatctcctcatttctatatgtttccctcttatatttaattcaatcagacagacaattggtggtgattattaactgtgtaaatggaaccacttgctcattctctctgaacctatttgttcatctctacaaaaaaattaacaactcttacctgagagggttattactactattaaaaaagtagtataaggaaaacatctaactcctaaaaacagtgctttaagtactgcctgaggaataaaaagaaatatttactatagatcattttctcacaggttaccaatgcttaaaaaaagttgccccggagttaactttttaccaatccatcattgatttccttgcttaaaatacaaccaaactgtgtctaagcccttgaatactcttcctcagagattacaaatctccctctttttactttcctctcttcagtaaatataccttctgcacctccaccaagatatgttgttcactcatttttgttcccatagcaatatctccattataaccctcaatctctgtgcattataattaggtgtaaatatgcctgtcatctgtgctactctgtgaaacaaagaaaagttggttcttatttgtctctagatctttagaagctggtagctgcctggaacatggtagactttctctaaatggtggctgaactgactggaccaggagtggcattaataaatgtcctgtgagctaaggaagacattatgacaaaagttattctttgataggacacataatttccaaaattcagtaatataattccaaataatctcatctagcaaagcaattcattcagcttcattttctaattagcatattttggctgaagtttagatgcagcatttcttcacagtaacattctcagaggcaaagttgggttcatttttagtagataccagtgtgcagaacctgtcattttctttaaaaagaaaaacattgaaatgtgttcagtgcctacataagtaatgttctttatttcatttgcagaattctatattaaaaatactgagaagaccatttttttaataaaggtgtagaagacagggataaagagagaaaggaagagagagaggaagaggaacatcaaagggtggctcttttcgagatgttagataaggcaaccatctctctatggtaaaattgaaatactaccttttagaaaaaaattttaagtgttttatatttgctatttttttgactttaaaatatgaagtaacatttgcaattctgcaaaaattccaaaacggtttttttatttgtgcttgtatatataaaaagtctttatctctttctctgactcacccgtcttccatctatatatccagatagaaccgtgaagctagctgtgccaggcacacagtaggcactcaacaaataytcatgttggcagatggaaatgaattatatgtttattatttgaccttcttcagaatgtgaatcatgtgatattataattacttgtatgtcactattattcattctccagggaaatttaatttcttataaccacctgcttattttggccacaacaaactgttaagtttcagataagcagcagctacttcaattggaaaaataagactcctttgggacaactaatactttctagtctgccatatttttaaaaaattccctatgggaaatttttctgtttcaaggcttaacaaaattttgctctttatattcattttccttctttgtccctggactttccctgtcaaaatgactgttgaaacatcgtgcagttgctatgttctctgcaatgcagtttggcgtatcacctctaccagctgtcaaggtgaatgcagtttagccctttcttgatgtacttcctcattttcccattagtgctctagaaccattagtgtttccctgacttttgttctttgttttcacttttattagttatgtcttatatagtcagaatgtacctgtttctacactattttctcaaatgcagcaatgaaaagaagtggcgtcaatctgaacgtgactcagaaatcaagtcgtctatttaacttatagacattccagaattattctttaaattcaattcctttggcctcactgtagagtttcaggaagtagatgaagagaacctactttaaactataatactacattatttttaaattatgggggaatttattattttgtatacataggtattatataataatttttatcctatataatacagcatcttcttctaacaagctataaaaatcagagaccccatagatgcagttgtatctggaggcaaaggaaaatgatatctaaagaaagtagratgtatcaattgctcaaataaagcacagaaaatgggatttgataaggaaggtttatttgtaagaaagaaagaaaatrgtagaaatgaaagagtaggaagataagaaattcggtgaaatgttttggggtttggtgtgaaagtaacagaatttgtgaccagaagtctttttttttctacagtgaatatctggaaaactctagaacctgaagataaaattgaagatctatagtatcaatcactgcttttgctctatatttttaaaagcatatttcacccctcattttactttggtcatagtcttctgatgtaaacaccccactaccccaatttctgagggaaatgcatcaaattaacttagtggcaagacaaaacaatacaaaatgacacacaccaagagaaaaacataacccaattcttcaaccattacaatcctccattttagaacacgttactctactaagtgaatttgaactgtcattaactgttttttttttctttgctttaaatctcatggtagtaaaaactgattgaaagaggcamawctgcttgatctcagattcaggaagaaatagtgccatactcaacctctcagttgtttcttaatacagaattaacttcaaagcttttaagaatttaaattcttactccaatgctaaccaacacacacagtaccccaygtgaaaaactgaaatctaatttaaaaatggacagctggtgaagattgcattttaatattcctaaaaccaaaagagttacctcttcaatgcctttgttctgttttcctttacatatcaagtaagagacattttaaaaatacacaagattttcattagagcttatacttggtgaatttaaaggcctttgtaagaaagaccacagccatatattagtaggaggaaatgagaatgtaacgaattttttactcaggrtgagtcagcatcaatgtactacataatcacatccctcaaatcaatcagcaaaaggacaattcttttttctgatacttttacctttagatcactgcatctcctcctcagattatagccaaaaaaaaagaatattcatttttgaaaaaaaggggcagtaagtcctccatttctagggacactaaaatggtttgtcatcaatcactccaagaatattgacaagagggaccaaattatcttctgtatgtcctaagagaagatacaataaaatggcatgaatgctttacactattcaatgttaatactactactytggaagaacaactttataaatgaaaaaaaagaggaagtaaaatttatagaaaatatattctatgttaagtgctttacccatgtttccttattttactcttacaagaataatgaggagactataattatcttacaatttcctgactgaaacaaaacaaaatcaaagaaacaaggctaaagaatttgttcaaagtaccagaggtagcaagtggccgcgctgggatttgagcttaggtttgaatggttaacaaagcctagcatcttctcactatagtttattcatctcattcaacaattatttatataatatatataatacaaaatatctatttttcatctatgttatatatacttggaccaaactgatgaaaacaatgaaattgtctctattttcaaggaacttaaaaattaaatagcagaccctgaataagagaatacaacacagagaatgtagtgtaaaagtataaaattctagaaattttaataagtcagcagtggggtgaaatggaaagatatcaggaaagcttctggaaaaaagtcactagacttgaagagtaagtttacccaggcgacataagagccttcctggaagaggaaatkgggtgtgtgaatgtctcrggtggaagtggggctgggggacatttttgaaaataaggaaagttcagaaaagccaaagcttgagtacaaaggtgataaagaggagatgaatggcacaggggaattaggcaaaggacatgtcatgctgggcttttattatagctcatatcaaggattttagacttcatattagaagttatgagaggctactgagacattttaagyaagaggtaacatgatcagacttaaatattccaaaattctctccagctctattatgagtatgaattgcacagtatgcaagggaaatgtagggagatgagttagctattgcagtaattcaaggaattatgaaaatgaattatatctaatttattaacatttatcagtaattcaaggaagaagttatcagtaattcaaggaagaaatgatggtggcttgaacttaagaatacggcaatgcatagaaataagatgagtgaagatgtgtcaatgataattcaggacattggtctaaaaattggtcgaatggtggtaacatttatcaagaatgggaacacaggatgaggagcaatacggagcaattgcataataacggttactattatcaataataataatatgcaattgctgaactattactgtgatccataaactgagctaagtatattatatgtattatttatggtgtgattttatatataattttctcacaacaatgctctgaagcaattattcttattatcacaattttataagtagaaaaattaagaactgaaaagtttagtaaattgaccaatatcacatagctggaatgtagcaatgccaactatatagggtgtattaaaagagtgttaaggagatattaaatgttacatttggaaaaacacagcttcaggcacattaaagtcttcccttaagggtataaagtcttacagagacatcctaatgactaagtatccttcaatgtaaacagtgataaggagagtcttatccttaagacttatccttatccttaagagaaagaacaaagtcaagttgagaatgacagatgcagcaaagaatcaggagccagatagaagctaataaaaatgggctgaatttggggacaaggagagagttgcaagactgccccaaagagctttatccagcatatctggtttgtcttagcaaataaattgcgcatgtcatacctggttgccttaaattatagagatacaatggagaatgtcaatttgaaaagccaaaaacaaaataataaactttctttaggccccaaaatattttagtttctatatgttttaactatacaagctacatatagcatgacagcaaagcctagaaaataaattatctttgtaaagtgtaatgatattcatttatggttgcatcaaagcaagccactrgcaaaagtataatgaacataatattttgacataaatctgtggaggtaacttgaaaagaaagagggcacagaaagaaaacaaatattttaggaaaaatatatcactttaacagcaataaataaaaggttatcgattcaaaaaaactaatttatgtgtgaccaatttgatgcaacatgctcattgttatggtttccagaagagaaccaataaatgtttctttggctgatattaatgtggccttggggcttatcatcaggttgttttcctttaaaagaaagctgttgtcagtggacagaaatgtttatttcctatgcaaaagctaatgctggggatttattatttgttgatctcagcttatcttctactttacacaatttttgcatgtcttttatttgctgggcttccaaagacagcatggacgcatctataagatttatttgtatcaggaaaaccatatgttccatacttgttctttttgaggcacttcgtctcaactaattaatccttaaaactctctgagaccaaagggatgaaagcaagtaattctgtttacagagaaagcaaattgaggtacctttcctggagtctttcagtaaataagcacgggaaaatggacatctatcaactcttccaacatgtgctctaaaaaggactacgctgcatgttcaggctgctagacttacaagtcattcgaaacactgtttaacagaggaggccaaactatccaggctgacatagatctcttgagtcagctctattttcacagctgaggctctaggtcagacgatatctgctttttccccttatcttcacattagcttcctaaatgctctcccagctttaaactcactctctgcagacatatcttaaacaatggcatcagggttatctttctcaaataaaaattgggttttttcatttccttggtcaaaagcctttgatgtattcccaatatatacaaaataagatcacacaccttggcctagaattcaagtccttcttcaatataattataagttatgcttttaaaatttatgtccccctatattctgacccttagctcatttttcacaaataaacataactgcacatacatataagcacaccagcaccctacatttcagtaccctgaacatgctctgagctttctcaaatccaagtctttctttgttcatgctgttttctagagagcgtttaaacttcatagmagcctcctcttcctttctaggtcacttgcataaggaggcgttccaattcactccattcagacaatcctgtattcctattctatctcacagtttcctattctatctcacagtactttatttttgtttgtttgtttttgaggcagggtcttgctctgttacccaggctgaagtgcagtggcatgatcttggctcactgaacctccatcttccgggctcatacaatcctcccacctcagcctcctgagttcctaggaccataggtgcgcagcaccacacctggctaatttctgcatttttttttttttttgtaagatggaatttcatcattccatcggttttgcccagactggtggcaaactcctgggctcaggatatccgccagcctcagcctcccaaagtgctgggaatacaggtatgagccactgcactcgaccatttatgcatttcttcatatacttttactgacaaccgtaaattaacctctgtgtttctgtcaatcactggattttaagtcactaagtagcagaactatatctaatttattaacattcatcatccccctttgccagcattgaacatgatgttttgcatatagtaggcattaaatttgctaaatggaactaaataatgtttgataaataacatcatggcacatgaccatattaggcctaactaattatttattcttccatttagtgagtgcaaaactttagtcaaaaacattaaacatactattttctaattaccttattttgcattatttaattgaaagaaagtgtaattaaaaggaggcctctaatggacaaacacacattgcaataacagcagctgtggacactttacttattcagtattaagtctgttctatgtcaactatggagattcttgacattgttacatctgtacttccaagcaacctattagttagctatcaatgatctcattttacagattacaactgaagttcagaaatgggctaggtgacttatcccacatccatctactatgcaccagaggaggaagtagatatcaagtatgtttgactagagtctgcgcatattctagcctacagcacaatcacccaggtctgtaagattggaaagatgtgcaaatgtgtagagagaagatggagacactattttctattcttatttacaagaaamtgtatacagaaatttaacatcagaagaaatactgtacaaatatacacatataacctaaactatatggtgttatcacatgcattttaaatcatatataataattacaaaatgttatctccactgacacctatcaaacatcagtcactgtatgaagcacttaattcactaattaatttaatcctcacaagggcactgagataaataatatcattattcacattttrcagtcgaagaaatggagaacttagagatgttactaacctgtacaaggtcacgtgtcactatgctagttggtggtagaacttttgtttagaactgggtctacytgaatggcaagatatatttcttaactacatgcacaaattaatagaacccaagcaaaacttaagcatctaaaactgttaaatttagataaatatttaatcatgttttgtttattatatgatgagtgatttatcggcacaatgtttatgatcatttcctttaaaatctttccttgagagaaattctatttaatattcctattaacacacccatcagttcttattttgtatctaatataaaatgttaagccctttggatgaacattatgtattttgtatttttattcacacatattccaagtattttccaaaattaggtggctaggaaaactttttcttaagttaaacaaaacgtcatttgctttctcctcatgttgacttctggggctcaatgtaagttgtttttcttctgaagagcataacacttaaaactgtaaatcatctcacgtgtaaaagaaacaatatgacactttcaacattccgattctgaattacaattcttctacttcccaaacgcaaaagtgcaaatacaagattaataatttgcataaaatgaagtccatatggatcgctaattttactagatttgagtataaaattattctcctttattttacctctaacagtgttacagtgagaggaatacatctgcttaaatttcaagtactgcatttcaaattaattataattatatagctcaagtattatctatcatatcagttcacaatgagaataaagcacatttgtttctaattctttttgaccttgatgttctttgtttcaccacagtcttcaaggttattaagacagaatcctgaaggaaaccaatgtcctaattatttggacacatagatctattcctcccattctaatatattaaacatttaagaattactttataaaaccatagacctgaaaatgactctagaggtttatcccttctttctcagggttttacttatagcattttatcctgatgctattagtcctgacattaaatgcctctaggggaaaagattctatttcctccttcagcaacctgtttcagttcataaaaatgcccttatcagtatgagatttttttcgcctttgctcctgtttacaacataaattttttatatgtgattaaatcatttcttatacttttcatctttagaataaaaatattctcctccttaattttaggttatacttcttttctaggttatgggatcctaaacacagaggactgtagagctttctctgtgttctctccaacatcagaagctatctatggcagcaggtgcctagtcacctgaggatttctgttgtcttttaggctggaagaagtcctgttcagctctcttcaaatgactacacagcatctctaaactttgagcactgcatatctattctccctttgtccctttgctcatttttgatgaataatattctcatagacagtattccctaagatgggaattacccgtgttacaaagagcgttatgaaaattaaatgaatggaaacgtgtaaagaggttagaacagtgcctgccacatagtaacagttaataaaatgttagctaatgctcctgatgccattgttactattcctattatcccagctgctgctgctgctactactaccacttccactgctactatcactgctactgctatttctactgctacttctgctgctgtggatgctgctactatgcaatgaaaaatgtactttcttttaccaagtgggacatccagaagtgaactggaatgccttaatatattgaggataacctcctcctaactcccagctcttctgaattgcacagttgagctgggttctccctgatcaaatgatctctaacacaattattatccactttataaagatactgcagcaaatttatacagatcagggactctaggatctctggcccttcactattcctgagatctttctgacagtctgtcatgttgtaagagctgcattaatgttyttccattaccattaataattgaaagctcatctaatagaaatatctttcaatattatatgatgtttaacaactccattaatgggttaggagaagtatggtatacacaagtatagaaaattctagggataaaccaaatatggaattccttaaaaaggtctacaatgggaaaaattacactttttcctctgtaagttgatgtcaaagggtgttttgaatataattatcatttcataacaaattttcaaagtgccccacaatcatttctaatatttattcttcatacaaaccctcacaagagagtactgcattcatcaaacattttttcacagatgaagcaatttaagaatgggtcaaaatgtgattagatttcacagtctctgagttgctagcctgctgttaagtcaattgaacctgcctgcctcggaaaggtaaacagaataaatgagttagcatttagatttacaaatgtatcaacagtggatcataaaacaagttagcaaagcctatatccccggagatacagacaatacggtggtattacatggtggttcatgtatgtgtatatgtttgagtatttatgtagtaccacataactacataaacatcaagagtggtactacataaagactcaagcatacacacgtacatgaacaagaaatggacattaactcttctgacttacttcaccttaaaccaattctaattttcagatagattttacggtagatgtcttggtagacactaccttttttcctctaatttaagacaatttgtctttgtggttattaaggtggcctagccaacctgcctttcccattgtgctaattctgggtgacccatattggcaatcttggagacaacctgcaaatagtatgggtagtcaggtggttccgttacagcatcaaaagatgactatgagagtaaaataaaaccagcactgtaaagatacaagggccaaattcaagttccggttggtactcctatttttaaagataggaataaatgtcatgatacattttcccaaactcacagaatgtacaacagcaagcgtgaaccctaatgtaagctatggatcatgggtgataataatgtgtcaacgctggggtcatcagttgtaacaaagtacctctctcatggagcatgttgataatggagaaggctatgcacatgttgcaaaaggggatatataggaaatttttgtaccttttgttgaattttggtgtgaatataaaacatctctaaaaaataaagtatattagaaaatacagatcaatctggcccaaactcgttgtttagctcctattggcaatatatgataaaataattcattgattgttaggacaggaaatttcttttctttttaatttttttttaatttctataggttttggggaacaggtggtgtttggttacatgagtaagttgttcagtggtgatttctgagagtttgctgtgcccatcacctgagcagtgtacactgtacctaatgtgtcatcctttatcccttgccattccccagcctttctcctgagtcaccaaagtccaatgcgtcattcttatgcctttgcacccttatagcttagctcccacatatgagtgaaaatatatgatgcttggttttccattcttgagttacttaacttcgaatgatagtctccaattctatacaggttgctgtgaatatcattatttccttcctttttatggctgagtagcattccatggtgtgtgtgtatatatatatgtcacattttctttatccactcattgactgatggacatttgaactggtcccatatttttgcaattgtaaattgtgctgctataaacatgcatgtgcaagtatctttttcatatgacttcttttcctctgggtagatacctagtggcgggattgctggatcaaatagtagatctacttttagtttttaaggaatctccacattgtttttccatagtggttgtactagtttacattccctccaacagcataaaactgttcccttttcactgcatccattccaacatcaattattttttaattttttgattatggtcattcttcaggagtgaggtggtactgcactgtggttttgatttgcatttccctgataattagtgatgttgagcttttttccttatgctcattggtcaattgtacatcttcttttgagaattatctattcatctccttagcccgctttttgatggaattgttttttttcttgctgatttatttgaattctttgtagattctggatattagtcctttgtcagatgtacagattgtgaagagtttctcctactcagtgggttgtctgtttactctgctgactgttccttttgytgtgcaaaagctttttagtttaattaagtaccaactatttacctttgtttttgttgcatttgcttttggattcttggtcttgatgtctttgcctaactcaatgtctagagagrtttttcttatgttaccttgtagaatctgtatagattcaggtcttagatttaagtctttgatccatcttgagttgatttttgtataaggtaagatgagaatccagtttcattcttcyacatgtggcttgccaattatcccagcaccatttgttgaatagggtgtcctttccccaccttatgtttttgtttgctctgtcaaagatcagttggatgtaaatatttgggtttatttctgggttttctattctgttccattgttctatgtgcctatttttatacccgtatcatgctgttttggtgactatggccttatagtacagtttgaagtagggtaatgtgatgcctccagatttgttctttttgctttggctatgtgggctctttttttgtttcatatgaattttaagtttttttttctagttctgtgaagaataatggtggtatttttgatgggaattgcattgaatttgtaaattgcttttggcagtatggtcattttcaccatattgtttctacccaaccatgagcatggggtgtgttttcatttgtttgtgtcatgtattatttctttcagcagtgttttgtagttttctttgtaaggtctttcacgtccttagttaggtatattcttaagcattttattttattttttgcagctattgtaaatcaggttgagttcttgatttgattctcagcctagtcactgttagtatatagcagagctactgatttgtgtacattaattttgtatcctgaaactttgctgaattcatttaccagttctaggatcttaataagtctttaggattttctagatatataaccatatcatcagcacacagtgacagtttgacttcctcttcggatgccctttatttctttctcttatctgattgctctgaataggacttccagtattgtgttgaaaagaagtggtgaaagtgggcatccttatcttgttccagttatctgggggaatgctttcaacttttcccattcagtatgatgttggctgtgggtttgtcatagatggctttcattaccttaaggtatatcccttctctgccaattttgctgagggctttaataataaagggatactgaattttgtcaaatgccttttctgcatctattgagatgatcatgtgatttttgttgttaattctgtttatgtggtgtatcgcatctattgacttatgtatgttaaacaatccctgcatccctggtatgaaacccacttaatcttggtggactatctttttgatatgctgttggaattggtttgctagcattttgtttaggatttttgcatctatgttcattagggatactgatctgttgtttttttttgttgttgttgctgttgttgttatgtccttctctggttttggtattagggtgatagtgacttcacagaaggatttagggaggattccctctttctctatcttttggaatagtgttattaggattggtgccaattctttgaatgtctaatagaattcagctgtgaatccatctggtcctggacttttttttgttggcattttctttttattaccatttcagtcttgttgcttgttattggtctgttcagagattctgtatcttcctggtttaatataggagggttgtatgtttccaggaatttattcrtctcctctacattttctagtttatgtgcgtaaaggtgttcatagtcgtcttgaatgaccttttgtatttctgtggtgtcagttgcaatatctcccgtttcatttgtaattgagcttatttggattttctgtctccttttcttggttaatcttgctaatgatctatcagttttatttaccttttcaaagaaccagtttttttttttcatttatctttttattgttttttgttgttgttgtcgtttaaatttcatttagttgtgttctgatcttagttatttcttttcttcggctgagtttgaatttggattgtttttgttcctccagttccataaggtgtgactttagattgtctatttgtgctttttcaaactttccaatgtaggcatttaatgctatgaactttcctcttagcaccacttttgctgtttcccggaggttttgataggttgtgttgtggtaggtcagctctcactaacagctgtttcagtactgactgagtggttaagttaaatattaaaagccagtgcccttatacaatggctgggatgtaacaaaaagcccatcaggagttttgcctaggcctttcctgggccttaaagcatgacaaaataacgaaggaattcttaataggacccatttaggactaaagttttattgtgggtctaaagaaacttcccagacctccacaaacaagtttattgggggtctgaagaactcctcaaacctccatgatttagcaggagacaagataagggtaattaccccagtatctggacccatgtagattaagtaagacatttactgaggctccagagcaaggtcttcaggactcagaccttagttacagattaaaagaagttgatcactgtgtctttaggcgaatgcacacttacacatagacatatagcctagaaagtatataagctctggaaaactttataattttgaattggtctagtgataatttccaggtcttctccctgtaaccggktacagaaataaaaactctcttcctccccagtttatctgcatctcattatggggctgtgagaaataacagcccaaccctcagtttggtccgggaacagtgtcactattatcattcaattaaatgaatttttaaatttccatcttgattttattgttgatgcaatgatcatggaggagcaagttatttaatttccatgtatttgcatggctttgagggttccctttggaattgatttccaattttactccactgtggtctgagagagtacatgatataattttggttttcttaaatttactgagacttgttttgtggcctattatatcatctgtcttggagaatgttccatgtgctgatgaatagaatgtatattctgcagttgttgggtagaatgttctgtaaatatctgttaagtccatttgttataaagtatagtttaagtccattgtgtctttgttgacgttctgtcttgatgacctgtctggtgctgtcagtggagtattaaagtccgtcactattattgtgttgtcatcgatctcatttcttaggtctggtagtaattgttttataaatttgagaactcttaggtgcatatgtatttagaattggggtattttcctgttggtctagtccttttatcattatataatgtccctctttgtctttttttttttttttttttttttttttgagacgaagttttgctcttgttgtccaggctggagtgcaatagtatgatcttggttcactgcaacctccacctcccaggttcaagcgattctcctgccttagcctgccaagtagctgggattacaggcatgtgccaccacgcccagctaattttgtatttttagtagagacaaggtttctccatgttggtcaggctggtctcgaattcccgacctcaagtggtctgcctgcctcggtctcccaaagtgttgggattacaggtatgagccaccccactgggccccctctttgtcttttttaactgctgttgctttaaagtttgtttcgtctgacataagaacagctaatcctgcttgcttttagcgtccatttgcggaatatctttttccacacctttatcataagtttatgtgaatcattatgtgttaggtgagtctcctgaagatagcagaaacttggttggtgacttcttatccattctgtcattctgcatcttttaagtggagcatttaggtcatttacattcaatgttagtattgagatatgaggtaccattctattcatcgtgctaktttttttcctaaataccttgtttttttttttcattgtgttattgttatataggtcctgtgagatttatgctttagggaggttctattttgtgtatattgaggatttgtttcaggatttagagctccttttagcagtttttgtagtgctggcttggtagtggcaaattctcttagcatttgtttgtctggraacaactgtatctttccttcatttatgaagcttagtttcactggatacaaaattcttggctgataattgttttgtttaggaggctaaaaataggaccccaatcccttctaccttgtagggtttctgctgagaaatgtgctgttaatctgataggttttcctttgtaggttacctgatgcttttgcctcacagctcttaagattctttcttttgtcttgactagataacgatgactacatgcctagtcaatgatctttttgcaacgaatttcccaggtgttctttgagcttctcatctttggatgtctagatctctagcaattccagggaagttttccttaattattccctcaaatatgttttcaatacttttagatttctcttcttcctcaggatcaccaattattcttaggtttggatgttgaacatagtcccaaacttcttcgaggctttgttcattttttttccattctttttctttgtttttgacagattgggttaattcaaaagacttgtctttgagctctgaagttccgtcttctgcttgttcaattctattgctgatactttctagtacattttgcatttctctaagtgtgtccttgatttctagaagttgtgattgttttttatttatgctatctatttcactgaagaattttcctttcatatcctgtatcatgttttttatttcattaagttggacttcacttttctctggtggctcctggattagcttaataatcaaccttctaaattctttttctggcaattcagagaattttgtcttggtttggatccattgctggtgagctgatatgatctttttggggtgttgaagaaacctcttttgtcgtattaccagaattgtttttctgattccttttcgttggtgtagactatgtcagacggcagatctgggattcaagggctgttgttcagattcttttgtcccacagggtgctcccttgatgtggtgttctcccccttctcctaggagtggggcttcctgagagccaaaccgtcatgattgtttttgctcttctaggtctggcaacccagtggagctaccagcttaggctggtactggggagtgtctgcaatgagtcttgtgatgtgatccgttttcaggtctcgcagcctgctcyggtgaaggtatcaggggagtgaagtggacaccataagggtccctggttgtgtttttatttagtgcactgattttgtgtttgttggcctccagccagaaggtgatgctttcaagagcacatcagagctgggtgtggcggttcacacctgtaatcccggcactgtgggaggctgaggtgggtggatcacctaaggtcaggaattcgagaccagcctggccaacatgggraaaccccgtctctactgaaaatacaaaaattggctgggcgtggtggcrggcatctgcaatcccagctacttgggaggctgaggcaggagtatcacttgaacccaggaagaagaggttgcaatgagctgagattgcacaattgcactccagcctgggcaacaagagcaaaactcygtttaagaaaaaaaaaaaaaaaaaaaraagcgcatcagctgcaatcctatagagaagatgcaaacttgccctagggacacctggttaagtattcaggtttctcagacggtgggcagggctatagggctcccaggagattatgatctttgtctttggctacctgggcaggcagaggatgaccactaggtaggggcagggatagacgtgtctgaactcagcctctcctgggcagagcttgctgtggctgccatgggggatgggggtgcagttataactccaatggagttacattccaagggggattatggctgcctctgctgagtcatacaggtctccaaggaagtgggagaaagccagcagtcacgggccacaccccgctcccatgcagcctgcacacctaaaggccggtctcactcccaccatgccccaccaacagcaccgagtctatttctatgcagcaggtgaccagggctgagaatttgccccaaaccacgagactccccattgagaaagcaagctgactcacagtttttcagcatctcatggagcctgcagcagtgatacagttccttcaaagggtctgtggattctctctgctttcctggtatgttcctgctgtagttcttggagcaatggttcacaatgaatctccacacactgctctgtctgtctgagtgggagccacaagctagtcctgcctcctatccaacatcttctagttgcaatatcgacatttctaataatatgacaaagtatctagatttggcacatttcttgatggaatatttccattgagtataaatgaaatcactatattatctaagagtaagctgttttatttactttctgtataagccttatcttgacatctatgatggggatgtttggtaaagcttcatgattgttatttctatcactcactttgcttcctgtttgtcatcattcactaccccaagttgctatttttcttctctgtttttttcaagcagtcgtttgcaatcatggctacacattagaatcacttctaaagcttttaaacaatactaatgcctgagccccaagtctagaaattcttatttcattgtctgtggttagactcaattattcatattttcaaaacttccaagatgatcctaagtgcagtcagggttgaaaaccactagtctagaggagtttactttgcttcagaacacctaagtcacatggacattccttaataatgagaaagacggggtcattaaaagggctatactatgggggtggcaactttactcaacttcttcaacttaatatgaagaagtctttctaaaagagtcagaatgatttaaaacaaattttagacatactacaagttctacaaaggcaaggactctatctatcttagtgattattgtattttcaggtgttggtagttccatgctgataacatataaacacttgataaaaatttactggatgaatgaatgaataaacaaccgcactgagagcaaccatgagcttagtggaaaatacagcgtatttcttgtgacaatgctatctgactattatcttctcctgaacattttgtactgctcctctactgtgctgctcctgtgtctcagcccctaaggaaacttcccaagtagttgtgtataggagtcagcaaaattcgtaagattcagtggtgatctttcaaatactagacgtaaattacagagacagtacataatttcagtttttatttattgtctacttacatttatttctattccacacaaaaggggatcatcagctactaaggtgtgggtgttccttgtggaatcagtagccaatttctaagaaacgatcaatgcctgtagcagttccttgttatgcactaatctaggttcaacttccatggaaaatacacttctggtataattctgattgtccagagtttgtttgcttttcctttataatacagttttgcttttctttaatagtaagagtctttagtaatagttcgattcttgagtgcctactttgtgtacaaaatgctttaatacacatttttaaaatttaattatgccactaactttataaaacaggtattaccttccccattttacagatgggaattaaagtatccaaagactgatgtaactttctcaacggcaaatgactagctggtaactgagtagaaatctaatccctggtctacttaaccccatctctgaacaatagattagtttctcttctcttccctcaaccaacaaatcccaccaccacttccaacacaactaccatcattccatcttcagggaatcttacacttgagtgtttagtatttcttcacttctgtctagaaagagttcttctctttacgtatgtcctgagggtcttttactcatctctgaacctgagactaaaaaatgttaaaaattcttattattactgtattactcttctaaatttatagtattctaaaatgacagtggtaaaatcattatataaatgcaaatgatacattatgctcagtctattaaagttctccttcacagtatcaatgaataaaattaaaatttattttacatttcttttacaatatttcatacctgcaaaaatgaagatattaggtttctgcttattatttataagttaaatgacatattaaatgatgtttgcagcagatttttttaaggcatttttcaaaacctaatagtaaagtatctgttttatcaatggcagattagaagctttcaaatactttacccacaaacatgctataagaaaaatactttatcatcttcttaatgacccaaacaagggctatctgcttttctcattcttcctgtgtatgtttaaaagcatctatgcccttttatcagccttaacaggacaacgtagttaacccttccaactattatgcttataacctcaattatttaaaaacaggtagggacaacttataaaatctgtatataacaataaaggtattaacaagtcagtgacagaaagtaggtgatgatagtcagggatggggtaaggaaatttaggacaatgtttgctactttttaagaacagtttttatacgaagggatgtaggctgtctgctaaccaagttaatcttagccagtgggtaagaatgctctgtattctaaggccaatggtgactgctgaaaaagagccaaagttttccaaacagagtggctcttgttgtctttgtgggaactgactggctcttggattttccagggagggcaggttttcatggtttgagtggtcagaaaaggatagcctgaaagattggtcaaaaaacataaaaccatcaggatataacattaaaccattaagagattatgaaattagcattagttacagtaactggatatagtcttttgcttatttcattcactttttttcatactgaaatctgataagaaattaaaagaattgtagacaataaatctaggcctaatatgtgtatttatatgcaacaatatacatttattgccactaaatattccctcttaactactctgaattgctttaactagttatttgatatatgggtaataataaaatttatattctgatgtaatatgacattttgatttatactttcaaacttacaaagtttaaaaggaaagatgagtattgtaaatataccaacaatcactgcactagcttttagaaaggtaacaggcatgcaatttccttgaaactaaagtgtaaagaaaaaaaataggtcagcaaatatttactgaaatttgctgggtacgatgatgcatacagaaatgatcagtgtctgaactatatctgaataatttctgttaaaactgaaatgcaattatttttgaaatgcaaaagaccaccaaactcaagtagcattttaaaaaaatgacaaaaatcagttgcagtctgtgttttaaaggaatttcaaatatgccttataagaaattcacattaggggctgcatttctatgtattttgagtaaactaaccaaagtaacttaagattcacaaggaaaagagatgagagtagaacaaaataaaagaagtgtgaatgtagtaaaaaaaaatcaaagaaaaggaagaaaaggaaaaaaaaaagcttatgagtcctagaagggttagaacactttttttttcttgctcttggcagaaggaacaaagcaacaagcaatctccagtgctaagaaaaatgtagacatgaattaatggtgattagaaattggtaaatattaccagcttctttataaatggctctcctaaacatgctatggttaatggtttagggtacaaaagatatgaccaaagcaaaagccataaaagaggcttttatactaaggaaataatttatacaataaacacaagtgtagtcattccagctggcatgctgctatccatcttaattattgcaataaatgaaccactggccatcacatttaaaagactatggaaaactggatggctaccaaaagatcagaaagaaaagctttatgttaaaataaagtgatgattaaattgaaaatcaggccataatactgatgatacattttcactaggctaaataaggtagcattatctctgaaaattatatttacttgacctcgtaaatttctcagtaatttaagaagcaactatataatttgtgcactatccacataccagattgtatttacagaaagcattttttcttctgaaaaaaaatgaaagagggggagctgcagtgggcatgcatgggtcagcacagcataggctaattgaagttttggtatatagacagcactgcctcctctaggacagctgttctcaaagtgtggtcccaggactggcaacatcagcaacatatgggaccttgttagaaatgcaaatttggaaccccacttcagaaatactgaatctgaaactgtagatgtcaagcccaacaacctatgttttaacaaactctccaggtgattgagaggcacgtgcaagtttaagaaccaccattccaccaaaacaaaagcttcataggaccatgttttctttatcactgcatccctagcatccaacttaacacagtagctaacccatggtagtcactcaacaaatatttgttgaattaattagttaagaaagcttttattaaaaagtggatttaaaatgatattctaaagcattattttacatatttttagtgttgtcaaataaataattccatttatcaaacagaagttcaatttttttaaaagcttcattttattggttcagttcttatttgcatttagtcaaattatatttggaaaacaaagtgttctttaaaaaggtatgtgacaatcattatacgtaaatagtttagaatttctggatgagtggttaatttgttgtgtttcgttgttattgaaaattggagggagggttatttgaggaaagcttgatcatgaaaaatggaatctactacctattcatgaatatattatgttatgttaaataacaagaagtgatagctataagtttaaattgatatgtttaaatctattatctctatacttggtataaattattttttaaatttagtcacccatttaaacttagagttatcactttttgttattcaacataacataatgtacttacataattttgaattacaaagcaactcaagcactttgactaggtttacttcatatatacatgtgtacaacttgcagaagatacactttatttttcaaaagtaatgtttataaggaataaacaaaaatcaaaacttaaaacaatagtataatatttatctgtaaagcttaaactcacattgccagttagataagggaacaaatgccaagagaaaaatttattaatctcaaaaggcagagtaatggcctcatcatttcacaaagcacaatttcaggagacacactttattgtatttctttgtgtgaattataaactttagtagaaaatgggaaataggcaaagtaatacattttaactgtagcacaccaattgatatagcctcgcaaaaaaaggttattttgaaaaattaattcaattcatctacaataggaaacctgtcaccataagctgaaattggataaaagtccacagatagttaacactttcatgccacctaaaagtatacatatgctttttatgaaaaattactatctcacatgctaacatttaacaaaggaactataaaactgctaagaaatgaatccagaggctatggtctttggaaaggtatggtaacctttaagagggcaatcactttttcctaaatactacttgcagagttaaccatcccaataatcgctgacaccatgaacatcaaggacagacagaggactgggcagtagggaagctatggttccacaatatttttactgttagatagtagatattgctgaagaatgtccaaaacttcattaaatctactagaaattaattctacttaaaaactcaatttgtactaatgcttttgttcatcctttgtttctaccttttaggaagaagtccagtaagtttctagtaatcttgtcccgtttctcagttttgtctctttctccagatttgagacattgcccaatcaatccctgtgcttttccaagttcagttttgccctttgagtctgatccttctttccttttggctcccacagatattcaggtctcttctatttcaaagattctcaggaagatcatacctcctagctcctaaacctcctatttctctccttatgatcatcactaagctccattctctgtcttcactgtactccaatgatttgcacagcagccacatccttgaattgttgaatatagatacagtattttactcatttattcagcaccacggttataacttgcttatgatgagtgtctaataaatattaatttaattaagcaaaaaatgctatagtaggcagttattattgtgcttgcccagtctactttattagcacatcccaaggcttcttgaaattgcacagaaacctatcaaattcccctcctccaatgttagttgactggtcctaaatggacacctgacccaagctaagccaatcagaaaccttgccctgtgaattcagaactaggcaaactatgtttattaaatggaggagaactcaatccaggagacatgggctgccatatggccttagaatcaaaatgggatagtcttcagaaagagagaaggcaaatgaaaagaaagaagagctgaggaattgagacagacagaactgatagccttcatgcccttaatttaaattcgttcttgagatctaagtcctagcttcattatagagatgcatatcttactatagctctgttacagagacttcttgttccctcgttatatatcccccatatttgcttaagctagatcctgttgattcctgtcattgcaataagatatcctaaataacatggtgtcataagtcatattgaattaattgcttttaacttaatagtaaaagaaaagcatattttcatgggaataatctaaaatggagagctgatgtaaaagaatcacttgacatcaaatagaaaaaatatgtcacatgagtatacatacataacaatttagtaagaaaacatctctggatataagaaataagagctcatttgttgctgtgaatttctctatttctgtgtactctccaaggacaaaaaactcttgaatcttcatattatactttataggattacagtgacactgtatgaaacatcctcctgaaaaagttgcattgaagattgtacaacctgaagagtaaaaacatattccattgtggtcactaaatatatattttaatggaaagatcttgaaaggcccaaaataactgccaaaaaattttaataccagaaatcctttgttaataagttggcagggcggtcatttgatgaaaagtcaaatcatacatgttgattaacttaagataaactttgagaataagtttatggcatgaggtacatgctttatttactgtgcttacagttataaagttagaaattactccgtgaaatacagtcattattaccttgcttgcattttatttcaccaattataaaactacaactactttccacattagtagaaaaaatgaatatatacaaccaaaccttacaggtctgctataataggctcagaaaaaacaaaggcaatttgtgtaagctactgaattatctaaaaaatttcccaaaatatagtcattggtttgccatgcttgttttatggctgcagttaatattaaaatggaaaaagaaaccacctttctgcctaaacaattttgcagatgtcaataaatctatagattgcaggagaaaattggagttgtgtagtactaaacacaatttaactctgaaattaaaaaaatattttcaggagtagtttatggaatatattacatgtcctgtgttttcccaaaaatagtgaaaacttgttaaaattcctttgggacataggtctgatttataaagccagactagctggaaggcatctaaggaaatccctgcagttttggtaaatgtaaataacaacaaagaagcagagacatttctatgggcctgttgaaaagagaaccagggattcagaaaagcctaggcacgtgggaggaaatgcagtcatttccagatcatgacgtgtttgctctgcaggagataagtacctcaacatgcctatgcttccctcatccctcgcatgtcccttccgcgtagctatgtatgtccttctcagacacagacatacataggtagtgagtcatatgtcagggaaacacatagcaaagtaaaatgcgaagtaaacaaaattaaccgattactttaaattattttgtattagtggattcaattgtctaagaataaaattttaatcttttcagctttaggaggcttacaggctgttaccatacttagtcaaagtactatagtacttggctactagtgaaagtaccatagtacttgaatactgatgtgaacctcttgaaagaatggactcgaaatattttgtaaaaatacacaggcacaaaataacagtattttgatattactgactgcttttccaaatttgcaattatctatatttgagtgagcttaaaataaaaatttagataatataaattccaaatcatgtggaaaacttacatgtatcttcatggaaataaataatagggctttttgtatttatttgttttgttcttctgttgtattttgacttataatgaagaattatggttatagaaggtaccagacatcaaatagtcctaaatctagacactgtatttcattcatgtagtatattttacttcaaaacactgctttccaaatgctggttttccaaatgtctcaagtcagacataaggttaaacaatgtaaacaatttctttataccaggagttagcaaagctcatttctattgtgaattctaagagtgagtataagtatatgccattataaaattaatttggttgtggtctaattatctggatcacaagaatttaggaaatacttctccagaaatactatgccacagcttttaaaataatccattgtattaagtgtggttcaacaatcttgagtgtcaaaaaattattgatacaaaatttaaattcctcttatggtatgttttcttctcatacttgctcgccataacatgtataaatttatttctactgaagaatatttgcacttctgttaactgtatgtttgggtgattttttttttagtagatatcctctargcttacattgttacatttgcaaatcacttcaaaacatcaatcaagaagcaaactatgcaacttcatcttaaatgtgatttaacttaaacatagactaatataagaatggcaataaaaatgaaagatcattttaatttcaatatgtttgtaggtttattgtaacaaataagaaaaaaattcgcaagcctaacggggaaaagaaacaagcaacacataaaaatgagcacaactgttatcctaaagtttcataggaactataaccaaaattcctaatttctcaattcataataaataaattactatgtgagaagatgtatcttgtctacaattttggtagtaatactgttgttacaataattttgcactacaatcaaactagaactcaagatcaagaaactcactcaaaatcacacaactacatggaaattgaacaacctgctcctgaatgactcctgggtaaataatgaaattaaggcacaaatcaagatgatctttgaaaccaatgagaacaaagagacagtgtaccagaatctctgggacacagctaaagcagtgttaagaggtaaatttatagcactaaatgcccaaatcaaaaagttagaaagatctcaaatcataaacctaacatcacaactgaaagaattggagaacccaaagcaaacaaacccagaaactagcagaaggcaagaaataaacaagatcagagcagaattaaaggagatagaggcataaaaaaacccttcaaaaaaatcaatgaatctacgagctattttttttaaataataattataataataaaatagcctgctagctagactaataaagaaaaaaagagagaacaatcaaacagacataataaaaaatgataaaggagatatcaccactgaacccacagaaatacaaacaacgatcagagaatacaataaacaccgttatgcaaataaactagaaaatctagaagaaaaggaaaaattcttggatacrtacaccaccccaagactaaaccaggaagaagtggaatccctgaatagaccaatagtaagttctgaaattgaggcagcaataaatagcctaccaaacaaaaaaaaagaccaggaccagaaggatttacagctgaattctaccgaaggtacaaagaggagctgataccatttcttctgaaactattccaaaaactgaaagacagggacttcttcctaactcattttgtgagaccagcattatcgtgataccaaaacctggcagaaatacaaaagaggaaaacttcaggccaatatccctgaagaacactgatgtaaaaatcatcaataaaacactggcatactgatccagcagcacatcaaaaagcttatccaccacaatcaagttggcttcatccccagatgcaaggctggttcaacatacataaaacaatcaatgtaattcatcacataaacagaactaaaggaaaaaaaccacaataattatctcaatagatgcagagaaagcctttgataaaattcagcatcccttcaataaatcaggtattgaaggaacatacttcaaaataataagagccatttatcacaaacccatagccaatatcccactgaatgggcaaaagctggaagcattccccttgaaaaccgacacaatataaggatgccctctctcaccactcctattcaacatagtactggaagttctggccagggaaatcaggcaagagaaagaaataaaagatattcaaataggaagagaggaagtaaaactgtctctctttgcagatgacatgatcctatatctagaaaactccatcatcttagccccaaagctgataagcaacctcagcaaagtctcaggatacaaaatcaatgtacaaaaataagcagcattcctatacaccaacaatagacaagcagagaaccaaatcatgaatgaactcccattcacaatttctacaaagagagtaaaatacctaggaatacaacacacaagggatgtgaaggacctcttcaaggacaactacaaaccacttctcaaggaaataagaaaggacgcaaacaaatggaaaaacattccatgctcatggataggaagaatcagtatagtgaaaatggccataccgcccaaagtaatttgtagattcaatgctattaccatcaagctaccactgactttcttcacagaattagaaaaaaactactttaaacttcatatggaaccaaaaaagtgcccatatagccaagataatcctaagcaaaaagaacaaagctggaggcatcatgctgcttgacttcaaactacactacaaggctacagtaagcaaaacagcatggtacaggtaccaaaatagatacatagaccaatggaacagaacagaagcctcagaaataacaccacacatctacaaccatctgctcttcgacaaacctgacaaaaacaaacaatgaggaaaggattccttatttaataaatggtgctgggaaaactggctagccatacgcagaaaattaaaactggaccccttccttatacatcagacaaaattaactcaagatgataaagcattaaatgtaaaacacaaaactacaaaaaccctagaagaaaatctaggcaataccattcaggacataggcatgggcaaagatttcatgacaaaacatcaaaagcagtggcaacaaagacaaaaattgacaaatgggatctaagtaaactgaacagcttctgcacagcaaagaaactattatcagagtgaacaggcaacctacagaatgggagaaaatttttgcaatctatccatctgacaaatgtctaatatccagggtctgcaaggaacttaaagaaatttacaagaaaaaaacccaacaaccccattaaaaagtgggcaaaggatatgaagagatagttctcaaaagaagacatttatgcagccaacaaacatatataaacaaagctcaaagtcactaatcattagagaaatgcaaatcaaaaccacaatgagataccatttcatcccagtcagaatggcgattattaaaaaatcaagaaacaacagatgctgcagatgctggcaaggctatggagaaataggaatgcttttacactgttggtggtaatgtaaattagttcaatcattgtggaagacagtgtggtgattcctctcagacctagaaccataaataccatttgacccagccatcccattactgggtatacacccacgggaatagacatcattctgtttataaagatacatgcacaggtatgatcattgcagcactattcacagtagcaaagacatggaatcaacctaaatgcctatcaatgataggctggataaagaaaatgtggtacatacatacaatggaatactatgcagccataaaaaggaatgagataatgtcttttgcagggacatggatgaagtgggaagccattatccttaggaaagtaatgcaggaacagaaagccaaacatcacatgttcttacttaaaagtgggagctgaacaataagaacacatggacacagggagggggacaacacacaatgggacctgttgagggggtaggggggagggacagaatcaggataaacagctaatgcatgcaagacttaatacctagatgatgtgttgataggtgcagcaaatcaccatgccacacatttacctatttaacaaatctgcacatcctgcacatgtatcctggaacttaaaataaaattaaatgtaaaaaataaaaaataatactaattttgcactagtagtttattttaaaataatgtacacattataaatattcaaatcagataaagcatatacttaaaaaataagaaggcttccctcctatctcatattcgcaggcctccctttcagagaagcccattattaaggttcctgtgtgttttttagaaaaaaaaaaaaaaaaaaaaaaaaaacctttttttttttaaccttccaagggggttttgggtttggggggttaaaaaacacattccgtttaaagaaaacatcccacacactgtttgggggaatttttttttttaacttcaacccggttttttaaaaaaaaagggataaaaaaattggtggggggataattttttacaaaacaaaaatttttccctttttttggttgaaaggggcaatattggccatattaagtacaccataccttcccatttttttggggaaaaaaaaaaatagctaacatttttgaagtctgttctactggccattcacttggctaataattttccaaaaattatctaactttgttctttcaacaaaaaattcatataaatcctattattctcctcattttacagacaaagaaattggcttacagattttacttgcccaccacttaagttacttgtttcaattattctttcttccatttttctttcatgaaagccttaacatactcattcaatctttactatctaaaacgtgattgtaaaatctcatagttttgaatcctcaagagctaaagatccacagggtgtgattaggaccatttggaatmtaattattaagttcaaaatatatgaattacatattttttaaaagaaaaatatctggtttcttaaccctaataagttttcctagaaaagtatttctataaccgaatatttagtgaagcttcaagtccaacatccccaaaataaaaaatcataaagaatttgaaacagaaggaatcttaaattagtttattcctattaagttacagataagaaaaatgttgcatttattactaaatttatcaccaaatttaccatccttttatactaaactaagtttaaagagacagcagaacatctctgcttggagtatggtatatgtataacattttgtaatactctaagaggtagaagtccctgagtcttcctcaaaagtagcatttcaaatttgaggaactagctttttccttcagcaattgcatgctgttttgtttttgttgtgggacagtcgtctgtggagatgaagaatcatggatcagtgttctcatcacagctattaattcaccttttacttcttccttctccaggtcttttcccttctttacaacaactgtattctataggtttaatcattttcttttctctgaaccaaatctaattgctctatttataaatataacattatactctcccaaaaattttgttcagtgttaaacagaggagaggttgtacttccttgtctttttattttccacactctgttactgcttgtttatactgtaatgcatttttattcctatgtctcaattattttatttatggtgcatggtgactgggaaatctcaatctgcaaaatgttacatgcttagtgcttcattatggatactgatgagaacaaaaaagtgcaaatattaaaaaaagagataatgcaaatattatttttatttggcagtagaataaagtctcacaaccacacggaagggagcccactcagctgtagcctaatgtcattgtataagcaaagaagcagaacagaaatatgaagtgattaaccaaaatctcagggctgctggtaaaggcaggactgggtctcctgttttcttctccagcctttcatatccctctgccactgatcactactaaaagccctcagcaagaaggaagttcctggtctcaattattaacttgacaatgatcctggtaaccgttactgattcaacaatgatgaaccaacactcaatactaaatatttttccgtttaatcactaaataatagagttagtgacgcagactatttacatagaatctgttttcttaaattctttcttattgtattgtttgtgaagcaactatatttaacaatgtaggtatgtagtgaacaagtacacacaggttctgctgtgagaatcaatgtttttttttttaagttagtagtaccttctgtatccttcaaacatctaaagagaaaaagctaatagattgtgcaatatttccagaaggcaaagtaaacatgcaacaaaaaagtaaagtaaaagatgatcttatgtttgaaatgtttctgagctttgtttgatggtttcttgattgtgtgtgtgagtgtgtgtgtgtgtgtgtgagggtgggaaggattatttattttatttctatttccgcctgcccttccctatagcagcaacctcatttggacgctcagcctgtgagactactacagactgctgtggaacatataattagtcctcagttattctaaagatttatcttgtggaaaaaatctcaagatttctatttggagaataacgtggggtaaaaagaagaggcaaactgaaaatttgtcaatttgaactgtcacgaacattcaatataattttaagtagggtgaggctgaaactattggaaaaataacatttattgggtaatttgctcatgtaacctttgatgggtgctttcagatgaaagagttaagatcaaaagaacagcattccaaacattggggaatatacttggaaaaagaatataatgatactagttatctggtcattcctgaattagcgctttgcatctaacatgtatacttcttttaaatattcctaacttgatgggaaagaatatactttccacacaaatttaattttaaatgaaaaaaccttcaattcactaaggaaacaattacagatatatatatatatatttatggtggtataatgacaagcccaagtctagactgtcaggaagcagggtctaatttatggtggtataatgacaagcccaagtctagactgtcaggaagcagggtctaatgctagggacccatggggaatagggataggaaggtagggtatagagaaacatttgcacacactagacatttagggtaatgtctacaaccaatgaggatggatttaattgggctctatttttgaaaacaaaacaaaacaaagaaatctgtaactggaaccaaatccatttatgccagccttgagtatttctattcagttggcccatgcataaaccattgtgcagttgattcaaaacagatgtagaagcacctgttctaacaaaagacattttactgattcacttctgtcttcctaactctgcttttctaatattaatttcttcttccttcagatttgtttacccaaacttcccttttcagaatttgagaagtcacctacttgtgtctctcttatactcatttcttaattttaacttcctctatagtcttggaaggtcaactctttgggtgaagagaagcagatgctcactgcccaagtcttatttcaggcccaccaatgcctaagtttagagcagatcattcaatagtatgtgctccattcacccatgagggagtagttttgaaaacactggttttctagattctcactgkttcagttatggaactgaacctatatagacaagtcttcagcacccaccacagatctgaatatattcaaatgcactctgttgaaagccaacatgtgcatggcatatttatgtaattttactattaagtaacattctttagactatttaactgagctttagtttcactatagaattaagcagacaaatacaattcagaattcctaaaacttaataaagaaccataaattcacatctgctgttgtaaaatttgacacacattgttaaatttggaccaaaatgctctggatttcaagacatatttgcatcagaatttctctgtaggaagtttctttccagccattgctcttcccacttcgaaataagaaattaactgaatgttagttatcgagaagagattcaaatttgggcttactagaatgtattatcaattaagcgtcatggcaaagcagtaaagaaaatttattttacatcatgatgctactggtccacataaacagtttgttgtaattttaaayagcaagttccttttcatgctggcttttcatcttatctttctttcckctctgaagagaggtccactcattcctctcccctttctcatcagtacaagctgctcctttaagcttcacttgtcctccagcttttacagaatactctcttttacagaaatcacatcttttactataaaacttggcttttcaatctaatcctatttacatatactaaaataaggcttgttaataatgaaaattatttcaccacattaaccctagattctatttccatggaaaattgagaactccatatatttttatatgtttgtggaaagattattttgttgggtgacaacatcaagaacgtgaagcctagattacatgccaagaatccaggaactagacagtatttgtcttagaaatgggtgacattttttcaagtaatagaaaagattttttaaaaaattgtcatgtagcctctttgattaatccagaatcttaactgatcactgatatggcccaattaggtttatatatttcaacaaagagaaagtcttgtttacttggctttatttgataatgtctttgctctggctacttcttgatacataaactatactgcattcaaagtcctatatttaaaaggctgaaagtgagattacaatttataatttaaaaaattaaaaaagagtcacagtttttaaacttaaaattggttatacaaatatattagccattctttcgtaaagtactattttacatggagtacagcaggtatttaataaacgagagttatcagtggtaatgtgttgtatttatattggtttatctggacaagtatttttaataatatattagaaaagtcttagaatttctgggcaagaattcagaagacagcttgcctcagagaccaaagaagtaaaaatttactaacaaggtaaattgggaaggtaatatgggaattggcagagtaaaaccatgatatagaagttaaaattctgaaggactgggaaggatcaaaagtaaagtaaggaaataaaacaaagcttataaaaaaaggacttaagttgaaagattataagaatttaagattattttgtccagagaagtgacaycagacttaaaactattaagttctcagctattaagtaccattgaataatgagatctgtgataaatccaattctgcactgtttttatcagtaaagacttatttctcaaaatgatatgttggtttcaagagcacaaggtttatttttcagtaaaaatgaaacatcattcaaatttatataattttgttaagttagtgactgaattttaaagttctctttcaatagtcaatagttttgtaaaaataaaaccagattttctccaaattttctctaatattttactctcaaaagcatccaagacatggtccacagtacagatgtattttcagtggtacaaatatgttaaatactgcctgcgtgactgatcaatctgcttatgaagtcttttctatattatttctgctagattatgagaaatgccgtgatccaaaggtttaatctattaattaaaaatagaagaactaatattaccattaatttacttctattttgaatgtaygtctacaattatcctgtgggagaaaaagtagttttagtatcttcacaaacctacagtttttaaaataaattagtttaaataaatttctataattctcaggatgatctcacatttaatgaacagactatgttcaatatggaaactcaagaagagtacttatgttaacttggattggcactcggaagaaatctaactttattccatttgttttagcactcaatttgcatagcatgggtagaataaggcaaattctttttaggaccatattttaggagagttgtcattccctcaatttttaaaagaaattgaacaattttctcaatgtagatatttcttattcatacaacattatatgttgttgtttaaaataggcttcattgataattatgaaatgtaattttgactaatgcctttattcaattgtcatgtatgtactgagaaagttctatgtatcagtagactaagaaatctaattttgactaatgcatttattcaatcatcatgggtgtgtaccgaaaatgtaccatgtatcagtagacgctgggtagaaaaaagattaagtagacacagctcctgcctccaggaatataaaaattcactaagggagagagagaagaatgaataggcaatacatgaaatgaactctggaactacagaggacaggcaccttagagagatcagggaagaatttctggaggtgatggcatataaactgtgttctgaaggatagggatacacgttattcaggcaaagaaagggtgattgagagggtgtgaagcaaagggtgttcttgaataagacagagacgtgaataacaacccactcaggaagcaggaagggcatggcacatttagaaatatggctagcacatggaattccaagaaaaattgttctgagaaatgtaagaaaaactttaaatgctatattaagaagttactattttaccctgactatattgggaagtgtccgaagtatttgaagcagagcagttataagagttgattcatctgacaaagggctaatatccagaatctacaatgaattccaacaaatttacaagaaaaaaacaaacaaccccatcaaaaagtgggcaaaggatatgaacagacagttctcaaaagaagacatttatgcaggcaagagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggggagtcctcaggtatctagaactagaaataccatttgacccagccatcccattactgggtatatacccaaaggactataaatcatgctgctataaagacacatgcacatgtatgtttattgtggcactattcacaagagcaaagacttggaaagaacccaaatgtccaacaatgatagactggattaagaaaatgtggcacatatacaccatggaatactaygcagccataaaaaatgatgaattcatgtcctttgtagggacatggatgaaattggaaatcatcattctcagtaaactatggcaaggacaaaaaaccaaacactgcatgttctcactcatagatgggaattgaacaatgagaacacatggacacaggaaggggaagatcacactctggggactgttgtggggttgggggaggggggagggatagcattaggagacatacctaatgctaaatgacgagttaatgggtgcagcacaccagcatggcacatgtatgcatatgtaactaacctgcacattgtgcacatgtaccctaaaacttaaagtataataataataataaaaaagaaaaaataaataaaaaaataaagtaaaataaaatatgacaataaaaaaaagagttgattcagatcttacatcactctgatggcagaggggagaaaagattagaagggactaaagtttgagaaatatgttagaaaatgtttacttcttttggtttcttaaaatatgatcactgggccctattttattattgtgtagactctgaatctacagagtctacataaatgtctttcgagcacagtcacttgtatactcctaagttacctatggcctacttacactaatgacctaaaacaattgcttttagacactgtaaactataggctgcaaagcatctcatttttagcttcaaattcacttttaaatttatatttcaacctcaagattgcaatgcaatgatgtttcattaacagatgggaactatgacataatgaatatgatactaacaattaatggataaagtcttggagtttgtgaatggtttatttgttttacagagtgagtagattcaaggttacgccccataaaaacatgacatcactctcattcagattctcttttttgagtggaaagaaaggtagagtggagaggagctacagctggcaattttataattctgaacctgtggcctctcttctttatgtataatatctatgtgaatcagttgggtgtataatcgtattttggggaagtgggaaagattaactgagatttaatttatttaaatacttgaataatactaacacctcttaagagcttactactgacaaccacactgtttaatgaactttatgtgtattaattcatttaactttcacagctatcctacaagatargtgctattattcccattgcatagattaggacagaagagggtttaagcaacttccccaatgccacccaactgggaaactggagaaaggagacacaggtttcaaaactaaacaatttggctacagacaccatattctcaaactctgatctataatggaaagtaagcacaataaaatgggcacttactttaaaaggtattttaaattgtgatttgttaaaactgtgatgaagaacccacaggcctttatcacaaagctcctttcccagtatggccgtcgtgacagataatctaatttcaatawgagatttttaaatctgtttctgtgttgacaattcttaaatataccagagaattggacgatttcatttactgatataattttagtaataaattaggaggtctaatgtgtgatattatacaattttctatagaatgtaataaaatcatttccatttcaaatttaaaaatgaggcccatcattgaattttttttccttaattagacttcaggtaaaattattgctcaacactgactcaaacatacaagtgcgcgtgcatattcttcttctaaatcaaaatatagttttgaatcttagaatttttgagctgtgaagaaatcacatggtacaatacttccatgagaaaaatgaacctcataaaaggtaaatgaattgtcagggtcacacacagagtggataactcccttatgtagaaacatcttaggagatgtcttataaaattgaaaccatttaaattttttaaccatgttagtggatttttgacaaaattataaatttttgaacaaaatcaacccaacaacttctttcatcataacaaaattaaaaggtaaagtaataatagataagatgatgaatatcaatttagcttgaaaatacaatttgggattacctaaatcaagggaatatatgagaaaataaaaaaggaagaagaccatttccatgtggaaatctgtaaccatttggttaaaaatctaggcagagtaattttaaaagattttgtctactattcaaatatataacagttttaacttaatagctaccacaaaattaatatgaaaacatgcattattttatcactagaaatgaacttttttctcttttgatgccttggtgtattaaagtatgtttctcaagagtatacctactttaatcatgtctagtgagttattatgcaaaaggtacaaagaactaagaactggggctttaaaacacatattatttgtggaagcattttttgaattatatgaatagaaagaggatactattcactttccaaaatatccttaatattaaaattataggtttttaataatgttcactattaaattagaggtcattggaaaatcataataaatggaagcatcctacagtgctcataaaagggaagcagtggagctccctctattgaattacacttgagaaataatgtatttaaaatcataattttattatcaaaatgacagcattgtaacaatcggaaatttttctttctaagttctaatattttcaaattacagaaacacatataataatgtcaatttctgagaataatatagtgcattacatatgtctttataattttaacacgtgtttttttctcttttttttgtggaaaattacattttaaagctataattttcaattatgttcttttgtttttcctgagatgataaaactgaaaggttacttgacattcattgagattatgaaacattctaataaaatatacttttcagtttagttatggaagcccaaaatgtattcagatggaactgaaatatttctcaatcagtaaaatgaagtatttcacaagtttttctgatgtgaataactgatattattaggttactgaaaaatgtgattcataatgattattatttggttgagtgtctacaatgtgctaggcactgacaaacataatataaattcattaccttcttgaatattcctaccaaatgaacttggctgctatcctcaattaacaaatgaaaaaacagacaaaagctagaaagcaaactcatgctctgatccatagcccaagctcttgagctgttatataaagaaatctatgctatgcagatttcagtctggagtctctgagcatagacagttcatgaagatcaagcctggagaatagtcttcttataccgtggagatacggccatactgcctaccatcaaatcactactcaagcagttcaaatcatttctaaccaaacactttggatggattctagaaaatgataacctccaaaccataccctgaaaccctactccttttttactattttataatctcttttagaaaggtggcattttctaacagcaaagaggaaaacagctgagtggataaaggttttgttttaataaacagatacgtatttgccattctagtatgatcagagaagctatttaatcttatactaaacaagcatttctcaaaaaaaaaaaaaaactatttgagaactagccagtatccattgaggctgggtggaacaggggatttatgtaatggagtaaatccaaatataaattacattttactcttagatctgatatcaaaactgttattcatacttagatccatgaccatctctgcaaaaatataaaacctataccttaaaatcaccataaacattcttcttagaaagtgttgtacctatcaccaggtagggaaaatgcttgcagaataaagtataagtgccccagatttgaacatctaaactaaataccaggcagaaactgctttactcattaaattacagtatgtgcatacaaacattacctccattatgaatatttatcatttgtttaaaaatattactttcggcatataatttttcaaaacyatatatatatatcctgctattttctatgtaaaagtgactaaaatagattttattcctactttccttaatgggttaaaaaattacaggtgaaaaatatttagtggcactgatttttaaaaaaatttgtaaaatattgtactttttatcagtttatacaaaattctgacaagctttgttggaagaattgttcaaaagatgatttacttaaggcttaaacttgttggaataattgttcgaaatatgatttacttaaaaataactgaagtttgtttagtaatgactattatacagggtttacaaagtggcattagtcagaccacccataaaatgtatactgtacctacaacgaactaatacaaatatttggaaaccatttctttgtgttgaaaagcagtattaaattcacttatggctcaaatgtggctgtctcttaatcctgattgtacagagtattaattttacaaaatggaagaggttatggcttataattatacagtttatgttctaaaagttagcaatcttatgtagaaagaacaataataaaaattcatggtaaatacctgtcttttcccatttctggcccaatctcatgtataataaagttaggcaccaatataggttttgccttgtatgtgagtgtatatgcctactactcctataattctaacttttccaataagctttaaataaatgaaaaccaacttatgatactggttaaaaagaggaatgtaatagtacagatttatgaagagagtttaagaaaggcattatcttacttttgttgggatttttttaaagatgtgtactctttgagcagtaattttacaatttctttctaaatgaaaaacacatcgttgactcagtaacttcacttccaagacattttaccaacaactgccaccaattgcttatatggacaataacatgattaggatgttcactgctctagtttgtaataacgaaagattggaaacaacctaaacttccaggaacttgtgaaatggttamattaatgatgatagtacagtaaaatccaatgcacactttttaaaaatgaggtagagctataggtgctgctatgagacaattttttaatctccaaaatgtactgttaaatgaaaaaggaaaggtacaaaatgatgtatatggtatrtttccactttattttttaagtagggaggtatacatacaaatatttactaatatgtgaatatttcaataagacaaagacatccttttgtagatcccacaactggcaagtcaattagggagattgcaggaaagtatttgaacaacttcaaggaatccttggtttttgcctcaaccttcaaaacttctttagttttcatgaaaagggataggcacattttcacctccaggagttagaaaccatgtttcttaccaccttagcatcctcagtcatgttatttcctcagcctacatcctttgctagattattcctcagcacgtagctcagatatcacttcctgctagacgttttctgagtttctcttaaatcccagactagatctggcccctttgttgtaaaatgctgttcattgttcttgtgacatttaccaaaatttctagcaaatagttatatagttaattaattgatatctgtttccctgagagaacataacatctttgagtgataggatcttgaatgtatagtaattagtttatttccatatcctcaagcacaatgtgtagtacatactgagcactccattaatatttgttgaaagctgttatatatgctgaatgatcaattgacatgagttttagttctggattggccaacaatgtgaccttagtcaagtagttaattaatttttaggttctttacaggtcaaaacctttaatctatgagtttaggcgcaaatgaaactgaaaacatgtcactaggaattgtggttaatttgctactggattttaggtaatctcttaaacctgtggtttcatttatttcagctctcaaatggggggctaaacaaaaagaacatcaaaagaacattctcatttttccaacaacccttcttttaccatattttaacttgtgacaataaattccatgcctctaatccttcagaattcattctctctctctctctgtctctgtctttctctctcctctccagcccccaacacacacaaactcacacacactgaactttccataatttaactctggagagagttaaggttttcgctctaagtgaaagtattcttattcaacactgcttgagcctctcaaaaggccgtatgttttgcccaaggatctagaaggtgaaaattgttaatacagggtcaaagtttccgcgataagcgtctttgctgttgtcacacccttgactacaaccgtatcctagccatactgttggtggccacatcaggtcgccttttctgactgatacaacttagtttgcatgtacagaagaatgctggggcttccttcaacatccctggtttttttaagaaaaaaattggtagtgtgattactgagaaatctcatagaagaacagaatgggagttgtacaatttgctgcaaaaggaattcatgctcatactgaaatagttcttccctaaataaccccgtagctaagtgtagctcccaggtgaatttcaaacaaaattattcccttggcatctgaggtcaatttagtttccattccaaaccataggatcctcaatgtttcatatccacaacattctggaattctagaggctacaacctcacatctttctttcttatacctgacatgaaaggggcatataacccattaatgatatttcactgtagctgataattaaatttaaatgggttaaaaatatgcacttggttaggatgaagagtgcatttatcacagtgaagtactccaagacataaagacaagttacaaattattgtggagcctgtatgatatgttatgcaaaatgcacttctgaaaatgaaaaaggatgccattaataattgtaccagctcatgaggcataaaccaggacagtcttaggtataccaagatgaatgaatggtcaacctactaataatatgcatattaagcaagatagcaccaaaagatatacaagaaagaaaataaatgtctataataggtaacacacaagttgacaacaaatgacaccataggtgtcacctggggaatggttagctgattgtaccacaaacaagctgaatttggaagggttcaatgtgtaggtttcaaccctgaaaacttagaagcttcttttggctgcttaccaaacattttcccatcttttaaagatgaattctcactaaccaaactcataaaccagcttattggtatacataagagcaattattgccaagggaatacaatgcttctcttccagctagtgcatcctctgactgtaaactggctatataagaagtcacattgggctcggtgcagtggctcatgcctgtaatcccagmactttgggaggccgcggcatgtagatcacctgaggccaggagttccagaccagcctggccaacatggtgaaacccagtctctactaaaaatacacaaaattagctgggcgagctggtgggcacctgtaattccagctacttggaaggctgaggcaggagaatcgcttgaactcgggaggcagaggttgcagtgagcagagatcgcaccattgcactccagcctgggtaacaagagcgagacaccgtctcaaaaacaaaaacaaaaacaaaaaacaagcatcacattataattagaagatttcttagtgaccatgaaattccaccatgggaaagtttactatatgacttgaatattcagagcattacgttcttttttaagaaaaaaagaaaatagagacagagttacacaatattggccaggctggtctcgaactcttggcctcaggtgatccgcccgcctcggcctcccaaagtgctaggattataggtatgagccactgagcctggccccagaattaggttcttataatgagttttatctatctcaacaaaaagctatacctgctaaggagactgggcaagtcatgtctgccagttagaggggccacttactttcaccataaaagaaagtgtttggattcattaagtataatagcttcaataaccacatttggcccaactcctctactttttctgtgtttctccaatgaccaaagtctttttcatccttaatcacaggtcctttacgaatatacatgttcttttctttttgtttttcattaatactactaaagtgccatcaggtcttgatagcctgtcccactctgttctttcatgatggttttattttccagttcaattctcagtgaggaatattatatcctcaactcccaaactccttgagaaaatttcttagtaatgcatgaatgtcaggtgctgccatatggagtttaattctccacatatgcattgcttctactgtatttaatgcaaagaaaaaatgtgaagcagcttctaggtgtcaagctcttaactagacttgaggatacatagacaaagatgatatttggtattcaaaaaatttatgttcaactgaaaaaagtcaccaatatcataatacaatgtggtaaaaactacagcaaagacaagtacagggaaaaggaaaagggaaaagttaagactcactttagtcattatcaacattccaatgttgattttgcaccaaaggcaagtaagtacaggaaagtttttttttcttcattcacagttcaaataaggtaatctagactctctctaaaactatacagatggagaggataaaaatctacttatatcaatttctaaggtgaaagtatctttgagatttatctccctcaagaaaacattgtgttggagtgctggttgatatcttaatctacaaattcagttaacttctctagtgaaatcatcataataagttaaaataatcaaaaataaagtcttttttaattacaagttccaatcttcctaacatttatggatttgatattactggttttcactgtttactgtaaccccataatccattataagtagtaatttttttttctaaaagcaggtgtgtgaaaatcctactggagagtcaacctacctggctgctaacccaactcataacatgaaaagggtattgctttattattcatttattcatggaaactcatatgatgtaataaaaaacttgcttaagaaaaagggccaggtgagggtaaaatttttctaaaacttgaaatgtgattttgcagagctaaacaaattattcatagtggaagtgtcattgagcaaaggccagaagactacagcaattgccatggtcatagtatgttttcctgtgaatgaacatcaagggtctataatatttataggatttgagaagattgcaaaggtttagtttcatctcatagatgtttttagtcttacttgggccaagattttgcatcagttccttaagtgatacagaaaagagctaaaacaataataacagtaatagagaagcaaatcagagaagctggacagctgtctaatttctgattaacctattccccagcagtttagtttcattgtgttgaagtactatgaattcttagaccagacaagtatagacatgttcattgaagtacctcaactcaaagtcaaattaagtaatcctttggttagaagatgttttggattgtgcgcaactctgatttccccttcaatggaatggataattgagaactgactggataaataagagaggaagcattaaaagctaatttcattcttggaacatagactacagtaatgggctatgataataggttagcataaaacaattactgaataccataccacatttggaactaggcctatctgaaatatataaggtattctattcaataataagggagaaaagagaatgtaaaatttattatttaagcagagaaattagctgcatgaaaatatcagtaactccaaaaatatggtaatgacttacgtactatagggacactataataattgtaggatttagatttaaccttaccaaacagcctgcaatattctcttcctgaatatagaatatctattttagtcttgaatttactctccacaaggaaaggaaaattctaccctaataaaaaaagtaatcaaaagtataaatggatttttttccatttcttattgaaaataaactgagttgaaatccaaaagtaataaccaaataaatgttatcacccaccacacccaagaaaccattctttagtattccagtaagttagttcattcttcatatgtcacatacatgtgtcacacacataatgtgtaagaaatgagattagcctctgtgaatacttaacaatgaagaataaaattaacacattgtgagaaattgcatttaagtttctatgtatacattgagacagagacatattcttctatcatagctatacctaagtggatcttctgcatatctgggctataaattgcatgtgtctacttgagtgaataccttcagggagctagaactctttgatggtgttttatgctaaataaatggccagaacagaaagaagtgtgtttggaattgtaaaacatggtgattataaagcatttaaaatactatctgacaaactgctgccatcttacaccaagtaatattgacaacttaggtggtactaagttttacaaaggcccacggttagtggcatgaaaatttgacggagaaaaagaaaaaagagagaaaaaaaaaagaaacatctttctattattttaataaaatgataaaagtgataattaagtggaataaattaaagaatgttattctattaacaatataataaaagccttaattaatatagcacgttttacttaaaaaatttgaaatgctgagcaagggaattactaatctcaacacaatcagaaccacacattgcacagaaagaaattcacagatgggaaataaaaaagagcagaaaaataattttcccaaggtcacaacattcttacatgacatagttagaaactgaacacatgaatactgactacaatatacaatttttctaataacacaagactatttaattaattttcttctttttgataagtcaatggtagacatgcattttcatctgaatgtctattaaaaaagataagctagtttgaattttttacaaagtcagaaaaggtttggaatctggtaagacaagatattttggatttctacaagttttaaaacaatagaaaaatattagtattttctatttccttctgtcttgcatttacaaccatgttgcaaatcaactttttgagcaactttaggatgtacaatatgaggctttgtcatatgaatatttaagcataaaccataatttacatctcattctaggtactatgtatgcagtttatataggaacaggtttgcaggagagatgagttacactagcagggctttctgaggcctactatcctttcttacttttgggtcctcttttcccaggagagtggaaggctaatttctctccttcacgcttttttttttccctactaaggctggaaagagtaagcatagatgttatcatgaatttttaaaggtagaaaaaaaaaggaaattagaaattggggtctactgatacttttctaataatacaatttatatgaattttgtctagactgagatccttagaaaaatagtgttgaaaaatgactctgcctgcctaaattggttttttaccttaagacttcagaaacaaagagtttttgagctgggagacatttcagagagtaggcctctagtctgtctttttattttgtatgagaaaactgaagctcaaaaaggttaaatgacttgctcaagtgcctgaaggtagatgtcctgaagaaagcctagaaaagcaatttactgcaaataatgctccattaaattgtaaattgctattggattaaataaatccttaaggaaaaaatatatatatattggctgttaaacagtttttagtttttaaattaatcaatttcaatagtcctacatcaatagtctttgaaaggacattatttgagttgatgctttcccaagtcctgttgagatcaattgatatgtttcaaacataatatcccactgaagaaagctttatgtgtgcttatgtcttagaatgaatcttatatcagtgagatcagtgagtagttatgaaaaatcccatagaggggttcatacagatgacccaagtgaagaaagagttaactgcagcgccccatctccttgtaaataatccagaaaagcattctttttttaagcaatacaaaatgtcaccacaggctgacgctctttctacaagaataacgagaatattgctatctcggatgttgaacacacacttcattgccttcatctctgaattcagttttcgtggttcatatatttttctcctcctttcaaaacaggtaacgtggcacgcctaaaatatatcaatgactttgtagcgactacaagccgaaagacccggggaagcagtttcacaaactcgagtttttgacctctacaactggacatacactattaaaactgctccggaaatgaagagtggccggcagggaaggcagttaccccgctcaaatgaagccggcctttggcaccgcgcccccaccgggctctgctatgcagagggctccgaagaaggcgcmcttactgtccaagacttgcttcctcagtgtagacacggcgcctttagtgctgtaacctttcctttcaaaacacactgatactgcaatgagaatttcggcaatgccagctcggtaattcaccgaaaccacggatctgagggtccagggccgatatcggatcctcagattcacggtggctggttgcggtgagccggggctagccgctcgccgaaagcgcgcagctcggtgccccctggacacacgagcctgtggcgccaaaagaaccaccgtgaaggaggtctgaaagcggaactttcccccttttagcagttaaatgtgtagaaaaacctatcctgcgacgtggcccgcctgtgacggcaccgaaaaggaaactggttatgtgcctgtgtcaggggtgtggacgagggtgagattacattctccaagtctcgagggggttaatcggaaaaccaactgtgggcgtgtggacgtttgcatgttacaaaccgacatcacccttgtcctcccttcttggctcattccctggctccaaagtgtcctttcctccatcggacagtggaatctcgaaaaagtgaaatccacactgtgccaggcccaagggggtctcgcctttccacctacctccccagcgttgttacactaggacacctgctttaaatccggttgaactatggtttcacagtccccgccccagagcccgagatttgtcagagaacgcagacgccttttttttccctcagcctcagaaacatcaggtgagctcattacctcacccagaaatgtaactttaataaagagatctggagagggcactcctcccgcccacacacacagcaacggcagcagcagcagcagctcgcaaacacttgtaatctcttcctcaggctctggcccccaaacccctctccccgccagttcctgggagagattcagaggctttcaaacctcttctgtgacctgagcttgccgacagctgaagggatgtgcacggataaaaggaagtgagatttttctttgataaaagctaaagaaaaagctaagaacaaacaggccaaaataccaggaagtaggagtttaactggcaactgtctacgcagggatagaaaaaaaaaacttcaaagaaaaaaaaatcccctaaattttcagtttaggggagcaaaggaacctgctgctctgtcaggcaactgtgagcgcacggaataccctgttagaacaacttgtgtcagccgccaggcgggcctgaggataccagggccaggggacgtccccgagggtgtggaaagggatttcccgagagatattttagttgttgggaattttgccttttctctctctctctctctctctctctctctctctctctctcttccaagactcagtacagaactgagaactgaggctctatgagcaggtcctggaaattcacaaacctctcactgaggtgtctcccaggcctacctactaattcctgttctggctgtgttatctgcctgcggtcaccctttcactcaccacccgcccagacaatggacggggaccgcagggggtaacgttgaaaccacgattttaagctttagcaggtttcgcaaggggggcggggggaggtgattaaagtcctctccttctctacccctcccatcccttcctcggctcaccaaggggaagttactaggggatttatcacgaaaaagtgccggcagttatttcatccgagaactaagcgaaagaaaaactgctcggggcgcagtgacgtggacttggatacccagagacaggaggaactgtcagagggcaagagtccgccgcctagctgggagccgcagggacaaggggagagcgtcaggcgaatcctgcccaccccggagcaccaagttcctggagattcacccagtttccccagcttgatgcccaaacttgagctaaccagccaagcccaaacgtgcggcacaggtgaccgagcccggggacagctctgtgccaggacagcggtccccttacctccaccacgcgcctgggcgcactgcctcgggggtgcgaggctgggacggggacctaggaaactgctccaggcccacgtctgtctggggctgctcccaggcccttgctcacctggcctgaagacggtggcggagatcaagaggcagaagagcagacggcaggaactggcccccttggattccatattcctcctccttcttggtgggccactgacggagtccacrccgcaggagggggcgtcgtcccgggccccgcggtgcccgcgcgctggcgggtcccgacgcaggggcagcgtcttctcccagacacaccgtcccctgggctgtggcgctgcaccttcggttctctgccgcacgcaactttccaccacgcaatgcccccaactcctcctccctcccggtcaacaccagcccacgggcccttcggctgctcctccggggacaacgaccctctgtttccaggagacacttgagtaattcggaaaggtgtaagcggttcttttcgctggtatcttcttttattttccttgtattggaatgataataataatggcagtggcaatgtgcatgaaacgccaggtgctaagaaggactcgcaggaggcggcgacgggggggcggcgggtctcctcaggtggcagcggtggtagcagcggcagcggcggcagcggtctccgggctgctctgagtagagggactggaaggcgtgtgtaagctgcctctttcctcctctccccgcctcctccctccctcccgtctcctccccacttccccggacgcagcgcaaagcaggtggttgaagcgcggatccgcagcctagaggcgctgcaggactgagtccgagccctgagcccagctccgggatcagggagaaccgcgtgccccggtcctggagcccggatgagcggtgcttcaccgcggctccgcccccagggccaggtccgccaataagaagcaagcacaggagccgcgcgcgccagggagagccctgggactaacactttctgtgatgttgcagcgccccagtgataaggcctctggcttccaactgcccacccaccctcgctgaggtttaaaaatcgactgccctctccctccacccatacgcccatcccactgactcattcctcagagatttttctccgccgtgctgctgcagccttctgtcctgtaaagagaatagtggggcagggcggtggcggtggggagcgaaccttgggtccaagagcgggagtgaagggaaaaggaaaggaaagggcaggaggaagtggcaaaggtggaaacttgcttcttgggagttaacaggaatagctacttgttggcaggggcaacccctgtactggactgattcctcctgtacttttcgaatctctctcctccccctgctcacccccaccactcccctcacacccggctggcatagacttggttttaaaggaagactacgtgagtcgactgcccggtaccaacagaagatatttgcttttcccgggggaaattaaatccggaatttctaaaccgtacttcgtcatacggattttcccaatgtctacaaaagccctctagagagcgtgtcacttttttactttgagttaagcggtgattttaagttatagacagaaaatcctcaaattatttcagattaaaagccaagtccgtcttggtccgttcccgaaagccaggcactccagcagatggacaggcttcttaggcaatttctaaagattgaaccacctcccaggaggaacatcgggaagctgtgttgctttcaaatcaggcagagagcatgaaggaagattttcctctagaacaccggggtggagctgtcggagccctaagtggctctaaatcagggatgcaggatcacaactctcatcaccaaagaataataaaatcttggtccctgaagcacttcgctggggcattaaatagcctttcgtgcatcacagggtcacccttttgtgagactggtctccagcagaggatgccaactagtaatcgttacatactgcactttcatcagaaaactgcgagttaccagcgagattggagactcgcaacacacagacacacacacacacacacactcacacactgatttttaaaattgtttatcttttagtgctctaaactattaagccctatcttcagctgtgatttttctcaaaagcctgcttgtcctgttcttccagttctccttacattaacaatattctagagtagagcttttataccatatttttttcctctcaaaataagtagtttctcccacttggtttaaacattaacatttcatttgcatcttatgaatcaacaggaaggctatcgctaggaggcaaatgccttttaactctatattccttgagctaagcttggctgaaatgctagcatttccatggactcctgtagaattgctttagggaattgttttctttttcactgtggttgtaagtggggtgtattagaataaatcgacctgacaatatatttaacctaggtccgcgaacgctctatctgatctcctctattttacgatgggagttaatacagcataattgcttaaaggtagatttgcaaaaggaagactgatttgggctctgacactaactgtatgatcttggtcaactcacttaacctctttaagcttcagtctcctttcttgtaaaaagtgataatagtgctagcctcatgggattgctgtgaagatcaaatgagatcaaacacacaaacacacacgtggaattctgggagcaactgactatacaaatatgtacatattatacttatacacaaacacatgcatatatatatgggcatatgtataatatatatttgaatgtgtagtccactgcttccagaattgtttttagaaaggaatgtgtcctagtttaggaaaatgccttgataagccacttggactagtaactccaaaggctattggtcattaaaaaaaaatggtgaaacggctctatattaaacaaaataataaccatgaaaatagaaatttggcctgggagtggggacgaaggcaacaatacaaagcatgagtttagaaatgttcaaaggtctttagatctattaattagcaacacttacatgttagaatattctaagcaatttatatgaattaatagatgtattcccctcataaaaatttattgaaggagttgctattttcatcctcattttactcatgaagaaactgaaacccagagactcgaagcaacttttccaaggtcacacaatgattcatagcaatggtaaagccagggttctacccaggcattctgattcttgaactgaattcctatctactttgctcatcactatccactttgcttatcaagaatgcgtagcaataaatgtatggtttttttggtggggcgattgatttaaacataagttctctcatcctttcacacacattttcattaaggaaatttattaataaagcagcgcaccctatctgcgtaggccagatacagtgcatatgagatgacaagaccacttctaaactgaaataatgtagcataagcaagagctcagagttagaaataaacataaaaatgtaagctccacaaagtaatgtaatcgaattaatctttcaaaatctagtcaatgtgggattggatccatcttacctaattcttgagaggaagagtgtttccagctacatgtagatcacagtcacttttgttacaattgagaatacatagtattccaataatatttattgtatagtttagtcatgcatcagagaatcataagggtacatcttgctgaaagggaaaaatgaataacatttatccagggggaaaaaatttcacgttacctgggacatgagaagagctttgtattttaagtataaaggaattcatcatcaatcaggatgatatgctcaaaagcagtgacatggtaccggaggcaagtttcctacttacggtctgttgagataaggactcaggattcccaaggctcaggccaggaccccttccctgtactaaaatattaatcccatcagtatgtgacaacatagccgagtcaattgtgtgtgcctttgaagaatggaagtagtttttctcccctgattagcaccgccaaaatttccactggagatgaaatttcaacaaagatagttttggaagctgagaacatttgttcctaccactgtataccattgtgttttgtttgccttcctactccttgaacaaaattgtatgcagttccagagcatgcaacaaatctgattcactcttctctccttcaagcgtcacctacggtgaatgcatgttcagccatacttaaaaatagattggacacttgataaatttttgtgaatggatgataagtggtgagaaaaatacctaatggaatataagccttcaaacaatcttacaagggttcatgatatgagaagatgaaaggggtttccattgggtcttcaatgattggtctaggcagactaaggtttaggaaaggcaaaaagaatgagtcaagtcctagtcaacaaggtgataactatgaagtataaagtgaggaaacaatctacagaagaaaggctgtactaaaattatatgccatcaattagaataaaacaaagtggcccatgctgagcacagaaacctgattagtaaaggttctaggtgatcaagctagggcttaggctaatatactgatgacaaagattgaaataagggcctaagtgggatttatattaagtctaggaagaaacacaatcttaaagaggcacagagattacatctgtataatataaaattctgttttattctagactccaagttgtttttaagtaaatgatttccaaagttattgtattaaatacacatggaggacctctgggtatatctcttcccaagtccattgaattttattgtttaatttcagttgttaacagtatcatctgtcaatgaattaatacaattctgcaactcaccttttcaataatgccagctaataaagacatatcactgaagctcaggagagtaaaaactttcaaagtctatgataaacattatgttcttatttcacagaatgttcagtctgggtacaaaaagaaatacatagctatttcagttgaactagaaatccacttagtcattttccttcctgtctcagacatgaggaatgaagaaagaatttagctacgctatttgactatgaaacttacactatattaaatgaatttcaaaaactctcagtgtattaaaaactcataatttgtgggtgatttcagtaagtgtataaatttacatacaaaaagtgtaagagtctgggtttaccccttaacttgaggatttctcttcaaagttttcccactttcaactgaaataagcaggtcttttagttttgagtaagtagaaaatgactcaaggtatggctatttaagtgtttgatgcctttaaagaaattccaacttgaattatatattttcaagaagtttcccagagttatctctaatttctttgatatatatttattacccattatgatctgcaatagttctattcaggaatatgaggtgaatatataatgactgtaaaaatatgaaaataatatatatttgattttctaaagcaaaaaagtcactttggatctaatggatttctagaaagtctaattaattaattaattactaggccccaattttccatactattttcctcttaagtaagatagttaagttcacaggaaagtattaacaaacgatggttggacaaatgtatgtttttgctccctaaggagcaaaaactctattattgattaacaaaaaaagaagtattaataacatggagtcaaggatcactgatcatatattataagaaagaactttagaattttaatgcttttcagggccttagaagtatcttaagtgaactgttttcaatgcttaaaagcaaccctttttcttctaatacatgcatactctgaagtccagttttatatttgccccttgttcaatttattcaaatcatagtagtctcctcactgctcctaaatgtactttgcatactcccacatcggtgcctttgcacttgctctttccactccttggaactcttttccccaagttattacggtagcttacctcctcattgaagccttccataaacaagtatttaaactgtcagtcccagcccccaaattccttttcctgcttcatttttctccatagagtttatcaccatatagcataatatccatttaactcatgtagtttgattattgtctgtctctctactagaatgaaatctcaatgaggacagaagtttgtgtctgttttacattcttccatatgtttaaaatagtcacatagtagacactattggattcaaaaagtcaggttcatgaatacatgagttattgtgcaaggtaattaataagctgttagaggtggggctgtttgggctgaatctttgtaagcagcctgaggtttcacctcctcctgtagacactctaagggtttccaggacagttagataaaccactggaataatgtaactacctcatataacatatgaggtaggtaattgaggtcccgggaggaagaacacttaatcaaaattaacacagctatgggcaccattcttgtttaaatgcaaattatgtctttcaagtagggtaaatatacaagataccctgtaacttaagtcaaattcttgggataata

SEQ ID NO: 17656 - DNA, 110711 bp, Homo sapiens
tttatcttagaaataaaaaaaatgaataatctctgatttttggcttctctggaccatgaggaattctatcaaactcagtatattgtgcacttatttatggtgtcttctctctgatcttatactgagctgaacaattgaaaacaactgaaactgtaattgggatatgacaccatgaggtgaatataggtcttacaggtgtgtatgtgttaattctttttactccaagattccgtttagtgacaataattgtttttttacttttacaaaacctcagctcttttataacaaatgtgaacatgaatacttaatacaaggagtaagaaagattaaatataagctataatacagtatttttttcatgttgcatatggattaatccttaattgcaactcatataaagctgattcttttctctggactttgatttgctcagtttgagtcctatcttggagtcacagccaacctaggctagtgaatatctactctactcagcaaagcaatgaaaaagtaacagcttaaaagtaacccaccgccacaccagccacttctacctttctgtggctacttgtagttttcattactcacactgttttccagggaaggatttctgggtgtgagagaaggagctgggtgggagaatcccagtagcattctcttttagctttctgcccctgcttttcagcacttttcttctactgtgttttaattttcattctctttttatgagtttaagtacactttgagatatttaaggagatctgtatttatttttctgtgaactttttttttccttcaaggatgctggcctttttctatgaatttctagttcttcatgtgtaaaggagggaattatttttccagttcataactaaatcatccattatgcaattcttgacagggattgaaaacatcaggaaatgatgttttccattagaagagaaagcagtacagatattttcaaacttttaaaatggaacctggttgtcccatcataggcagtattgagtgcagaagacattactcagacctttcttaagaaagggctaatataaaaaatacatttattacatgaattgattcaaggcctgaaaatgatgattaggataaacatgacttttgtcactccactttgaagaaaactctccagatttctcctacaatataaaatggaaaccacagctttaaatggactctctgaggctgggaacagtggctgacacttgtaatcccagcattttgggaggctgaggcaggaggatcacttcagcccaggagttcatgaccagtccgggctacatagcaagacccccatctctatgttaaaaaaaaaaaaactttaaaaaaaattactacagctttatatataagatatatgktggcacctgctgtagtcccaggtacatgagaggctgaggtgggaggatcacatgagcctgggaagtagaggctgcagtgagccatgatcacaccactgcactcaagcctggccagcagagtgagaccatttctctaaaaattgtttaaaaatgaattccctgtttttctattcatattgcttctgtttcttggtccccatatccataaatacagccctctttagcagattctccaagcctagacacctttcatttctccctctccctcaccacccctttgctcatatccaaacaattgccagtccctccacctaaacatttctcaaatccatacaattctaagaactttgagaaacaatctcctcaccttctccaatcaccctcacatatctcacccagaaaggcatctaactatctcctagcctccaggaagggtaagtgctccacctgctccataatccactctcatcattgtgtagcaatgtttctaaaacacctgccaaaacatgttacttccagtggcttcccaatgccccttagaatataattcaggtttcttaacttggcctacaatctgccttcctctccagattcaattctcaccatcttcttcccaaatctttaagctcagtgattctcaaagcatggtccctgggccagcagcatcagcatcacctgcaaacttgttagagatgcaaattctcaagccccaccccaaatctaacaaatctcaaactctgggtctaggactcagcaatctctcttttaaggagccctccaggtgattcttaggcctgctgaagtttgagaaccactgctgtatccatactggactatttctgttccaattcccctacttgcggataccccgacctctttctgtgaacctcaccaccctttctccacttaattaactccttctccttgtcatacaatctgacaagttcatgtaatatgttgaatctaccttgagatgtgttccaaactagagtcgctgaggggctaccagatattgatgaaaaatcccctgaagacagttaaagtggaagataaatctggaaagaaccttcctggcaaagtgtggcccctcaaggatccccccattcacttggtgcttacatagtgaaatgtgagcctgctggaaccctggtgctcatcctgctaaatacactcagcgcagatgattcctagcacaccacaggttgcacctgaagtcctgagtgggggaaccttccccatggtgagttgcaggaagtcaccaaacaaggtatcagactttcactacctgacttcattattaagtgcatcttcagaatgaaattgagaattttatttaaattcagatatacctaaatatttaatacttaaataagtataaatttaaaataataaattttctaaataatagaagtcatttcttaaaataatacaaatatctggtcctctagcatttctctcttctgagcagcactagactcattaatgccatgtagtcgtacccaggttttaaacagtggtttctatggcttaggacaatgtttcctaatgttctaaaatccatatcctctttttaaaaaacagctttattgcaatataatcataatctcttttgatttgttgctctttttctctatcgccacctctttttcttggcaagattcactgatagaaacaatctttttaaattaaaaatgtagcgattgtaaacatgatcaagatataaagtttgaaaattttaaacattacagagggtcgtacagtaaaagcaaagtctccttccatactcactgacctccccactctccacgaccccaatcttctgctctcaaagtaactactcttcagtttatgtctagattgtttatatatatacacacacacacacacacacacacacacatatgtggataatatgtaattcccctaattttataccttagaattataccacatgtatattctgcatcccccttaatggcattttgattatcaatggtgtgggactccctagatctatatatagtattgtgttacttactgtttaaacgtatagcattgaatttggtctacattagctctttgaaagccccactatacatataaggaaagaagggtccagaggtggtgataagtgatttcaaaagattaaagggccaactacaaatggaattggatcttgaatttaggccttttgaatttatctgtcctgctctttcaaagtcaacaaaccccttttacaatactgatgtacctgtggcctcttgaccaagtcaatttggcctattgccaagagcagatttagatggtgacactcgatacagtggcctccaaagtttggaattctttaatgctaatttaccatgctggggatttgaattactgattatggtattcgaataaaaactaaccacttctagggtttaaagttaatgtatacacacacacacacacacacacacacacatgcacacacacacacagagactcctctgcctaaagtgaagaatttttaaacaaattatagctaacacagaacttcaatcaattgcccaagaatacgcttctttctttacccccttcttcatgctatgctgcaaacacagtgataaggaacatgagctctagagtcacctgatctgagtccagatggaggcactgacacttagttatgtaaccttaagtgaattattactttacctctctaagcctcaaagcctcactttccttctttttagtcccatcaaacttgcagcaagcaattcactttacttctttgtaggtaaggttaataagaagtaatgtgacaaggcatgcaaacgctgagtgaaataataatatgactattattatttcattattcattccatttattttttattcttctaatttttctttctcccaagtccatattttacatccatccatctaatcatatttattgagtcattattaagcacaaagttctatggatggcacgggaaaacccagtgatcaatgcgatggagtccttcccacaggagcctacaatctcaagcaaagttcagaattaattagtggttaatctttactgacttcataaaacgtatcaagcacagtgcagagcacttgacactcattatcacatttaattttaagctacctatgaggtggacgttcttttacagaagaggaatctgtagctcaataaagctgagtactttatctaggctggatccaaacccaggcagcctgactcccaaaccctgcatgcatgtctacatcacaccccaggcccctcagctctgtgagccctcctgacttcgattcctcctctgcttgcactcttttaacattagtcatcttaacaagaactctaatctatacaattcaagacgttacactgtccttttaatacaacccttcttccatagattttctagaggcagcatggtagaggcagctcagttaagggcccagattttggagtctgctgcttgacagctgcctgacctacagcaagccacataagcaatctgtgctgcaggtctcacctgtaaaattggggtaaggctacccacactccagagattgtgttgataattaaatgcgttaacataggtgtcagcacaggcaaagcacacagtcagtactgcataagcggtgggcttcattattcatcctgtaattacgtattcatactagaatcatgtatcccataggtcagggaccaccttttctttccttaatacccccaggattggcaaatcttgctctctcaacaaatagtttactcggtggaacctaacagaactaatatttctttctgtccgtaaataaaaatagatcatgcttgaatgtgctactttgcccgaactccccaagtcttcccgcatcttcagttcctccccctccaacctggtgttcatcaggagaggggaaagagcatttcttgcctggcaggaactcaagacctagaagaaagagggcctaccctgccaaggaaatgaccttccccttcctcgcctctgctcctcttcccgtttcctgtcttttccttcttttctcctggtgtttccttctcccgttaactatggggacagacgcagctattcacaagtccgtctgggcagcacactccgaggtaaggcacgaaggtcaggagacaggttcccgtgccccaaatcctggagaagatgagttaaagctcttcgcttcgattgccttcgcccttcccgcgtctcgggagcaattcagtgtcgcctcacgtctggccttgcagaagtccggagttccggctctgaactggagctccccgccattcccgggccctccggtttctccctcaggccatctgaggaattgaggtaggatttcgcgggtgttaggagcaaactcccaccacaactcggtcccgggctccctctccgttgagccttgacctctgcccaaaaaacaaggaatcgtgggcgtgaaggcggccttgaacccgggcggcggggctcggcgggactcgtcagcgccctgctgcggcacccgggccgctcaggtaagtaggaggcgtgtgcgggcggggccgagcgggccccaatccgtacgcgaggcaggaaccgcccgccgcgcccccgagagctctcggcgccgcgcagtcgccgctgggcaccccgagaccatggggaagctcgtggcgctggtcctgctgggggtcggcctgtccttagtcggggagatgttyctggcgtttaggtgagtggcatcttgacagggcgtcttcgactctcyttctctcctcttccaagtgaggtcaggggctgcctggcgcccccttcctagcgggtaggaaagagcagctttggaacctcactcctccatctcacccagyaaaccgccccttgagactcgcttatggggaaagtgagctacttgcgtttccaaagactgccgagccgaattagtcccatttattttttgaaggttatgatcccccactttgctttctgaaggtcatgacccccttttactttctgaacgtgatgacccctttcccagctcgccctcaacattctgcttgggaaaaaaggacgtccattggaaacgccggacttgggagagaggatcaggctaccagttggatgtttacggctgactgagacattgcccaggtctggctaaccatgcagaagtactgggttatggaacctatcctagatttaaagagctggccagacagcagggcaaaccagctgaaacctgcaggcggtaactggcattttgtaggcatttgaccttttgaagtggaagatacaatggtgatagccagcctagaaatgtctcaggaaaagtcaatactgggctagaaagaagaacctttaagtgataatacacattcatgagtggatcgaaagcctctgcttgctttcagttgtctttgagtgtttatgtatttctcttagttgaagctggtcttcttagaggatcacgtctagaatctgttgaggtgcctggtgcctattagtaatacttccagtttgagagttttattgttacatttgctcccagtgcaaccacatggagaatcataaaataatagtaataataataaagtagatctaagggtatttttttaaataaatgactgtaagataagtattgagtctttctgaatatactttaataaaaattttaaattatccctgatattagaagaatgtggaaacattccttttcactctggaaacaagaaaattgtgttgaaaaataaatcggccaattgtttaaattgtggttggtttaatgaatttacatacttgcggagtaagtcagcataaaatttaaaaattaaagcaaaagtgatagagtttgactattaggagaccctgttgaattttgggaaagcagtttggaaggaaaagttcaaagggcaagactgtaggggattaagtgcagatttataacagacgatactttagaaaattagggctatttcgtgcatttaaattaataatattgttcaattactcatactattaaatagtgtcttttatttgggcagcagaattttccatgttgaatcatattatacagtttttcagcaataactgggtaaggttagctgatataggtaaaatacccacataatgtctacattatgtaaataaacatgaaaggaagtacctacttacttgttatgtcattcataaattatgataaagatagttaaccaacacgaagatgattgaagtccacatttaaacatacatkttgaatgctgtgccttgacttccagggytgggttttatcttctacagagaaagggtgaatgcctctcgagaagtggagccagtagaacctgaaaactgccaccttattgaggaacttggtatgtatgtgacagtaccaagaggagccagcacagcttcttggtcgtcatccacctgactgagccctaccagctcatttaattacctgtcactacttaagccctcccagtgggacatctgccccgtccactctgccccatgcaaggtcttsaggggtgtactaaatgacattctttgtgggtttttctcagcacatttccttactgacatctctccacattacctaaagaatgtcattgaccactccctggttttcccctcactgaatgcttctcctttcccatctgtggtatttcactctcctccttgtcctctgttacctttcctttttttgcttcctttcttctttccttcctccctccctttccttattgtcattcctggcttcaagtgttattttttttcaaataatatgactcagcccctcccctcaagaacctcacagcaggctgggcgcagtggctcacacctgtaatcccagcacttgggaggccgaggggggcggatcatgaggtcaggagatcgagaccatcctggccaacatggtgaaaccccatctctactaaaaatataacaattagccgggcatgktggcggcgtgtgcctgtaatcccagctactcggaaggctgaggcaggagaatcacttgaaccagggagtcatcggaggttgcagtgagctgagatcgcgccactgtactccagcctggcgacagagcgagactttgtcttaaaaaaaataataaacgaaggaacctcacagcctacctaccttcttttaaaaaaattcataaaaaatccatggcccagtccctaacctttcaaactgcagcccttcttttttagtcagttaaagggcagctccagctcaaactctccctaagctgaaatctattttacatttctgtcgttttctccctcatcctcccacccacaaccagctctgcttctagacttttcctatgtatggtacccccattctcaaaagattcagttcaaaatccaggaaccattgttccccgcttgtccctcatgcttctacgtgagacatgggctaatctcacctactagttaatgccacacctgcttatttgggctccacagctccaattcttcctgacattgctaacagaaaaataaaataaaatcaggctarattgtgttccctgttctgggaatatgttctttcaccttctcacctttgcttatgaaattccctccaaacttactgattcctctgtctctgcttactaaaatcagctgcaaaattcatctccttcctctgaactctcacagcactctgaagctccgattcacttatgacacctgccacatgccttgtattatagctagcagtgttctctctttcactatcagattgtaaactccctagggccaagaactgtgacttatttattagaatgtgatgagatagcttattttgggatatgattttctattttattgctatatttaaaaatacagaaaaagtacccttttgatttgagttttctgccttttcttgcctctcaatttctaaaaaataaagtaatctgaaccttgcactccctagtcttagaggtggtttgtgctagcagctgkaaagcagaagaaaccaaagaaaacgcctttcctgaattgtttttaaaaacctgagccccttcaagggattctgttggagaagggatatgaatatgtggatatctttgaataatggggatccttaccccactggctgacagcattctgggagaggagcaggacctcagaaggaatggttgcaaggtatctttagggacgctggaccctgtgttccagctaaggtaaagaccttgtgtcaatgcattacatggaagtagcagaattgtctaaattaaagggaccagtaactttggcaatgaataattcgatgatacgtagtgtagaatgaatgccagatggcctttccaaaacattctgcttaggtttagaacccaccacttaaaatgatttcataaccctaacagacaaacccagtaatgactcagattggattttccatcaacttagtggaataggrtatcagagtgatttaatttgattttaaaaataaggaaatgtgacatttactcatttgtttactgttttgtggtgtagtagtattcatattcactmtacaaataactgtcaaaatatataagcctgcaaataatcaagaggtataattagactagatgattggtagggtctagtctgactcgaattgtatcactcaactagatttgagaaggtaaaattacagttaatattgtgagtcttaggtcaatgttctgatttgccaaatattttgaagaaaatggcttaaatagttggaagcaggctgggagcagaagaaagaaatgccatgttacttctcatgtctattggcatatgtttggtgaactaaacaagttagaatgatgatgggtcatgtgtcagtaggacaatactgatatatatgttttgaaaaagctgctttatcaaaggcctggtgactatgagcagcctgttgagtcctttacaaacatctacatcatcctcataaccaatttgtaaagtggatgctgctatctatgctttgcagattaggaaattgacatacagaagaattaagttgcttgcccaatggtccggaactagggggtgatgggcttagcttatgagccaagatcgtttccttctatgcctttttactctctgttgtgtaacactaactttctgatctactgacaacacattttttattttggaagcttcaggaaagtattgcaacagtggaaaacagaaaatctgagatgcaaacagctgaaatattactagatacaggttaatcaaaacaaggcagtctagatatttaaattaagataatggataagataatactcacaaatcacaactggttgaggagtagaggctttacaaagccctgaaaagctgctgaaggattttaggtagggtatagtaggctgtaacagagctggagaaaaattcttatttgtgttttcaagacccagacttttgaggtttattttattggtagaagaaactcttattttgttttccttctccagcatttttttctgggaagaaaagttgaaaggtgaaatatatctttctctggaaatcatatctcatagatctttttgtattacgttcatctttttatccaaggcttttgagggtcaaggattgttttaaccaggacgttatctggctgcccttgacatctaatcaaagctgcacttgaaatatgaatacttcagtaggactttcactaggcaggattatcgagtaggtggcctctgtatttaatacctacgtatcttctcttccactsctttccattctatagcttcccatgtctccaatatatgcttctactccataataggttccatgtgttttcttagctggctatcagaaacttctctccaagatgtgaagtgacgataataaaattaactgatagtaatgctttgatgtgatcctttatcagagtgcctgtaggggatgactggagaaatgaagaaaagagtaaagaaatgaagttatgccaagtagcagtagggttgacaggctaagaagcagtaggcacctattcataagactgattttagacttagcagtgggattytaatgatagttgtgcataggctaataagtgtgtgggaaagtctcagaggaaggtatcctgggggcttttgctcccacaggtgccattgttgctgagatgcatggggcctgtcgtgcaggcgtagtgtaggtgacagctcctttttcaacttgttctcagtcaaaacttacttattatatgtctctttccatagaaaaaaatgctgaaaactagctcttactgagaaaaaagatctaactaaactttcatattaatattcagtaatctttcatattcatttatactcattagtttattactcaataatttcccaatatgattgtataatgtagcgttttaggctttacgttggaagagaaggaatgcttggcagagaggcctgtaataaaagaccttcacgattatgactttccagattttatcactgagtctatagagcagccttctatgggggataaagctgaatctctcaggatatgccctggaaattgttacttaaagagtaaatctaggatatgagtttattttctaggtatttgcctttttctcctgaaaatggggttctaaaaaaggatttagtatttgaggagtctgactcaagctttactatagagtagcatgcctgtgagattctccaaagttaatatggtttcccaagtaaatggttgaacaagtcaacaatttccmaaagaagtttccaaaagatatttgtagtttggactgtgagacgtattttttaagccttcatatatgcatttttctgattctacccttcttttgcagaaagtggctctgaagatattgatatacttcctagtgggctggcttttatctccagtgtgagtattttccatgctgctctcatgctcacatcaatagctgtatagacagtgcattaatgttgtcctctggagctgccagatggatccctatgctctcatcccacctccgggtaaaccagtcaactaaaaaagccaaaacagaattttggagggctaattagaacaccacaggaatgcccagctttgactgcctcatggtgggcaactccctgggggtagtggcatactcagtagggtcttgataaatgtgtattgatttccactcgattcctaggctagtctccagttctgtcctattgctatccattctcatcattgccctatttgactgggcttccgcttctggtagtcatcttcccactaactggtattcctctcaccatgtctgcctttatttggagctctgcaaatgtttgtggatcgaatattaaccacgttactygatttaaaactctaaacacgttccatcttgggttccctgccattcttaacaagtctttcaaagagaaatagagaacagactgcattttaattcccagtactgtcttcacaggaataatcaagaagttacaccagggacagcatttcggtaaacaaacaaaaaaatgtgtatttatgagatgttgaaatttttcatatattaatatttgttaaatcaattgcattttgraatggggatatgattttgaaaaagtatatttaccacattttcaatgtgaattctgattgctggaattggatgtctaatattccatttggggcaataaaataccaccaaagaacatggattttgaatttaaatatttttggccaaaaaaggggtacttataataaccgtggcctgaatttataaattcataagtacacacagtagaatagagtgaggctctcatttggaccttaaactgctgctggtgtcactgctggaactggtgctagtctgtgtgggcaatattttatttctttatttttccatcaaaatcaaggataaaacaaaatggtctagaaaagttttttccttgttgacctaaattttctattgtcagtttagatttttttttattatacttttaagttctagggtacatgtgcacaacgtgcaggtttgttacataggtatacatgtgccatgctggtttcctatacctattaacttgtcatttacattaggtatttctcctaatgctatccctcccccagccccccacaccctgacaggccccagtgtgtgctgttccctgccctgtgtttatgtgttctcattgttcaactcccacttatgagtgaaaacatgcagtgtctggttttctgtccttgtgatagtttgctgagaattatagttttcagtttcatccatgtccctgcaaaggacatgaactcatcctcttttatggctgcatagtattccatggtgtatatgtgccacattttcttaatccagtctatcactgatggacatttgggttggttccaagtcattactattgtgaacagtgctgcaataaacatacatgtgcatgtgtctttatagtagcatgatttataatcctttgggtatatacccagtaatgggattgctggatcaagtggtatttctagtgctagacccttgaggaactgccacacggtcttccacaatggttgaactaatttacactcccaccaacagtgtaaaagtgttcctatttctccacatcttctccaccatctgttgtttcctgactttttaatgattgccattctaactggcatgagatggtatctcattgtggttttcatttacatttctctgatgaccagtgatgatgagcatttattcatgtctgttgactgcataaatgtcttcttttgagaagtgtctcttcatattctttgcccactttttgacggggttctttgtttttttcttgtaaatttgtttaagttccttgtagattctggatgttagccctttgtcagatgggtagattgcaaaaattttctcccattccataggctacctcttcactctgatgatagtttcttttgctgtgcagaagctctttagtttaattagatcccatttgtgaagtctttgcccatgcctatgtcctgagtgttattgcctaggttttcttctagggtttttatggttttaggtcttacatttaagtctttaatccatcttgaattaacttttgtataaggtgtgaggaagggatccagttttggctttctacgtatggctagccagttttcccagcaccatttattacatagggaatcattttcccattgcttgtttttgtcaggtttgtcaaagatcagatggttgtagatgtgtggtgttatttctgaggcttctgttctgttccataggtctatatatctgttttggtaccagtaccatgctgttttggttactgtagccttgtagtatagtttgaagtcaggtagcaatgatgcctccagctttgttctttttcctkagaattgtcttggctatgygggcccttatttgattccctatgaactttaaagtagttttttccaattctgtgaagaaaatcattggtagcttgatggggatgacactgaatctataaattaccgtgggcagtatggccattttcatgttattgattcttcctatccatgagcatggaatgttcttccatttgtttgtgtcatcttttattttgttgagcagtggtttgtagttcttcttgaagaggtcgttcacatcccttgtaagttggattcccaggtattttattctctttatagtaattgtgaatgggagttcactcatgattggctctctgtctgttattggtgtataggaatgcttgtgatttttgcacattgattttgtatcctgaaactttgctgaagttgcttatcagctgaaggagatttgaggctcagatgatgggattttctaaatatacaatcatgtcatctgcagacagagacaatttgccatcctcttttcctaactgaataccctttatttctttctcttgtccaattgccctggccagaatttccaatactatgttgaataggagtggtgagagagggcatcsttgtcttgtgcaggttttcaaatggaatgcttccagtttttgcctattcagtatgatattggctgtggatttgtcataaatagctcttattattttgagatacgttctatcaatacctagtttattgagagtttttagcatgaagggctgttgaattttgtcgaaggccttttctgcatctattgagataatcatgtggtttttgtcattggttctgtttatgtgatggattacatttattgatttgtgtatgttgaaccagccttgcatctctgggatgaagctgacttgatcatggtggataagctttttgatgtgttgctggattcggtttgccagtatttttttgagggaggattttcgcatcaatgttcatcagggttattggcctaaaattatctatttttgttgtgtctctgccaggctttggtatcaggaagatgctagcctcataaaatgagttatggaggattccttcttttctattgattggaatagtttcagaaggaatcgtcccagctcctctttgtacctctggtagaatttgtctgtgaatccrtctggtcctggactttcattggttggtaggctattaattattgcctcaatttcagagcctgttattggtctattcagagattcaactttttcctggtttaatcttgggaggatgtatgtgtcgaggaatttatccatttcttctagattttctagtttatttgtgtagaggtgtttttagtattctctgatggtagtttgtatttctgtgggatcagtggtgatatcccctttatcattttttattgcayctatttgattcgtctctcatttcttctttattaatcttgctagtggtctatctattttgttgattttttcaaaagagcagctcctgcattcattgattttttgaagggtttttcatgtatctatctccttcagttctgctctgatcttagttttttattgccttctggtagcttttgaatttgtttgctcttgcttctgtagttcttttaatcgtgaataaccagatagcatcatggtgatggatcaaattcacacataagaatgctaaccttaaatgtaaatgggctaggtgtcgattttagatctttcctgcttcctcttgtgggcatttagtgctataaattcccctctacacactgctttaaatgtgttccagagattctggtacattgtgtctttgatgtcattgatgtcaaagaaaatctttatttctgccttcatttcattatttacccagtgtcattcaggaacaggttgttcagtttccatgtagttgtgtagttttgagtgagtttcttaatctggtgttctaatttgattgcactgtggtctgagagacagtttgtgatttctgttcttttgcatttgctaaggaatgttttacttccaattatgtggtcaattttagaataagtgcgatgtggtgctgagaagaacatatattgtgttgttttggggtgaagagttctgtgtatgtctatgaggtctgcttggtccagagctgagttcaagtcctggatatccttattaaccttctgtctcgttcatctgtctaatattgacagtggggtgttaaagtctcccagtagtattgtgtgggagtctaagtctcttggcaggtctctaaggacttgctttatgaatctgggtgctcctgtattggatgcatgtatatatactttttaaaatatatattttttattatactttaagttctagggtacatgtgcacaatgtgcaggtttgttacatatgtatacatgtgccatgttggtgtgctgcaccaattaactcatcatttacattaggtatatcttctaatgctatccctccctcttccccctaccccacaacaggccccagtgtgtgatgttccccttcccgtgtccaagtgttctcatcgttcaattcccacctatgagtgagaacatgcagtgtttggttttttgtccttgcgatagtttgctcagaatggtggtttccagtttcatccatgttcctacaaaggacatgaactcatcattttttatgtctgcatagtattccatggtgtatatgtgccacattttcttaatccagtctatcattgttggacatttgggttggttccaagtctttgctattgtgagtagtgccgcaataaacatacgtgtgcatgtgtctttatagcagcrggatttatattcctttgggtatatacccagtaatgggatggctgggtcaaatggtatttctagttctagttctagatccctgaggaatcgccacactgtcttccacaaggttgaactagtttacagtcccaccagcagtgtaaaagtgttcctatttctccatatcctctctagccctgttgtttcctgacttttaatgatcgtcattctaactggtgtgagatggtatcccactgtggttttgatttgcatttctctgatggccagtgatgatgagcattttttcatgggtctgttggctgcataaatgtcttcttttgagaagtgtctgttcatatccgttgcccactttttggtggggtgtttttttcttgtaaatttgtttgagttatttgtagattctggatattagccctttgtcagatgagtagactgaaaaaattttcttgcattctgtaggttgcctgttcattctgatggtagtttcttttgctatgcagaagctctttagtttaatgagatcccatttgtgaattttggcttttgttgccattgcttttggtgttttagtcatgaagtctttgcccatgcctatgtcctgagtgttattgcctaggttttcttctagggtttttatggttttaggtcttacatttaagtctttaatccatcttgaattaatttttgtataargtgtgaggaagggatccagttttggctttctacatatggctagccagttttcccagcaccatttattaaatagggaatcctttccccatttcttgtttttatcaggtttgtcaaagatcagatagttgtagatgtgtggtattatctctgaggcctctgttctgttccataggtctatatatctgttttggtaccagtaccatgctgttttggttactgtagccttgtagtatagtttgaagtcaggtagcgtgatgcctccagctttgttctcttagcttagggttgacttggcaatgcgggctcatttttggttccacatgaactttaaagtagttttttccaattctgtgaagaaagtcattgatagcttgatggggatggcattgaatctataaattaccttgggcagtatggccattttcacgatattgattcttcctattcatgagcatggaatgttcttccatttgtttgtgttctcttttattttgttgagcagtggtttgtagttctccttgaagaggtccttcacatcccttgtaagttggattcctgggtattttattctctttgaagcaattgtgaatgggagttcactcatgatttggctctctgtttgtctgttattggtgtataagaatgcttgtgatttttgcacattgattttgtatcctgagactttgctgaatttgcttatgagtttaaggagattttgggctgagacaatggggttttctagatatacaatcatgtcatctgcaaacagggacaatttgacttcctcttttcctaattgaatatcctttatttctttctcctgcctgattgccttggcgagaacttccaacactatgtagaataggagtggtgagagagggcatccctgtcttgtgctggttttcaaagggaatgcttccagtttttgcccattcagtatgatattggctgtgggtttgtcatagatagctcttattattttgagataygtcccatcaatacctaatttattgagagtttttagcatgaagggctgttgaattttgtcgaaggccttttctgcatctagtgagataatcatgtggtttttatcttcagttctgtttatatgccgaattacatttattgatttgtgtatgttggaccagccttgcatcccagggatgaagcccacttgatcttggtgcataagctttttgatgtgctgctggatttggtttgctagtattttattgaggattttcacatcaatgttcatcaggaatattggcctaaaattctctttttttgttgtgtctctgccaggccttggtatcaggatgatgctggcctcataaaatgagttagggaggattccctctttttctattgattgggatagtttaggaagaatggtacyagctcctccttgtacctctggtagaattcggctgtgaatccatctgatcctggactttttttggttggtaagctattaattattgtctcaatttcagagcctgttattggtctattcagagattcaagttcttcctggtttagtcttgggagggtgtatgtgttgaggaatttatccatttcttctagattttctagtttatttgcatagatgtgtttatagtatcctgtgatggtagtttgtatttctgtgggatcagtggtgatatcccctttatcattttttattgcatctatttgattcttctctcttttcttctttattagtcttgctagtggtctatcaattttgttgatcttttcaaaataccagctcctggattcattgattttttgaagggttttttgtgtctctatctccttcagttctgctctgatcttagttatttcttgtcttctgctagcttttgaatgtgtttgctctggattctgtagttcttttaattgtgatgttaggttgtcgattttagatctttcctgctttctcttgtgggcatttagtgctataaatttccctctacacactgctttaaatgtgtcccagggattctgatatgttgtatctttgttctcgtcggtttcaaagaacatctttatttctgccttcatttcattatgtacccagtagtcattcaggagcaggttgttcagtttccatgtagctcagtggttttgagtgagtttcttaatcctgagtgctagtttgattgcactgtggtctgagagacagtttgttataatttctgttcttttacatttgctgagtagtcctttacttccaactatgtggtcaattttgaaataagtgcaatgtggtgctgagaagaatgtatagtgtgttaatttgggtggagagttctgtagatgtctattaggtctgcttggtgcagagctgaattcaattcctggatatcctttttaactttctgtctcgttgatctgtctaatattgacagtggggtattaaagtctcccattattgttgtgtgggagtctaagtctctttgtaggtctctaaggacttgctttatgaatctgggtgctcctgtattgggtgcatatatatttaggatagttagctcttctcgttgaattgatccctctaccattgtttaatggccttctttgtctgttttgatctttgttggtttaaagtctattttatcagagactaggattgcaacccctgcctttttttgttttccatttctttagtagatcttcctctgtccctttattttgagcctatgtgtgtctctgcacatgagatgggtttcttgaatacagcatactgatgggtcttgactctttatccaatttgccagtctgtgtcttttaattggagcatttagcccatttacatttaaggttaatatcgttatgtgtgaatttgatcctgtcattatgatgttagctggttattttgctcattagttgatgcagtttcttcctagcctcgatggtctttacaatttggcatgtttttgcagtggctggtactggttgttcctttccatgtttagtgcttccttcaggagctcttgtagggcaggcctggtggtgaccaaatttctctgcatttgcttgtctgtaaaggattttatttctccttcacttgtgaagcttagtttggctggatatgaaattctgggttgaaaattcttttctttaagatcgttgaatattggcccccaccctcttctggcttgtagagtttctgccaagagatcagctgttagtctgatgggcttccctttgtcggtaactggacctttctctctggctgcccttaacattttttccttcatttcaaccttggtgaatctgacaattatgtgtcttggagttgctgttctcgaggaatatctttgtggcattctctgtatttcctgaatttgaatgttggcctaccttgctaggttggggaagttctcctggataatatcctgcagagtgttttccaacttggttccattctccccgtcactttcaggtacaccaatcagacgcagatttggtcttttcacatagtcccatatttcttggaggctttgttcatttctttttattctttttgctctaaacttctcttgttgtttcattttattcatttgatcttcaatcattgttaccctttcttccacttgatcgaattggctactgaagcttgtgcattcatcacgtagttctcatgccatggttttcagctccatcaggtcctttaaggacttctctgcattggttactctagttagccattcatctaatcttttttcaaggtttttaacttctttgtcatgagtttgaacttcctcctttagctcagagaagtttggttgtctgaaaccttcttctctcaactcatcaaagtccttttccatccagctttgttccattgctggtgaggagctgcattcgtttggaggaggagaggtgctctgatttttagaattttcaatttttctgttctgttttttccccatctttgtggttttatctacctttggtctttgatgatgctgacgtacagatggggttttggtgtggatgtcctttctgtttgttagttttccttctaagagtgaggaccgtcagctgcaggtctgttggagtttgctggaggtccactccgaccctgtttgcctgggtatcagcagcggaggctgcagaacagcgaatattgctgaacagcaaatgttactgtttgattgttcctctggaggtttcgtctcagaggggtacctggccatgtgaggtgtcagtctgcccgtactggggtgtgcctcccagttaggctactcaggggtcagggacccacttgaggaggcagtctttctgttctcagatctcaagctgcgtgctgggagaaccactactctcttcaaagctgtcagatagggacatttaagtctgcagaggtttctgctgccttttgttcggctatgccctgcccccagaggtggagtctacagaggcaggcaggcatccttgagctgcggtgggctccacccagttcgagcttcctgaccactttgtttacctactcaagcctcagcaatggcgggcgcccctcccccagcctcgctgctcccttgcagttcgatctcaaactgctgtgctagcaatgagcaaggctccatgggtgtggaaccctccgagccaggcacggaatataatctcctggtgtgctgtttgctaagaccattggaaaagtgcagtattagggtgggagtgacctgattttccaggtgccgtctgtcacagctttgctttgctatgaaagggaattccctgaccctttgcacttcccggctgaggtgatgcctcaccctgcttcggctcacactcggtgcgctgcacccactgtcctgcacccactgtctgacaagccccagtgagatgaacccggtacctcagttggaaatgcagaaatcaccagtcttctgtgtcgctcatgctgggtgctgtagattggggctgttcctatttggccatcttggacagatgcatgtatatttaggatagttaactcttgttgaattgttccctttaccattatgtaatggccttctttgtctcttttgatatttgttagtttaaaatctgttttatcagagactaggattgcaactcctgctttttttttttttgctttttatttgcttggtagatcttcctccatccctttattttgagcctatgtgtgtctttgcacatgagatgggtctcctgaatacagcacacagatgggtcttgactctatccaatttgccagtctgtgtcttttaatcggggcatttagcccatttacatttaaggttaatattgttatgtttgaatttggccctgtcattatgatgttagctggttattttgcccgttaattgatgcagtttcttcatgtcatcaatggtctttacaatttggcatgtttttgcagtggctggtactggttgttcctttccatgtttagtgcttccttcaggagctcttgtaaggcaggcctggcagtgacagaatctctcagcatttgttgtctgtaaaggattttatttctccttcacttatgaagcttagtttggctggatatgaaattctgggttgaaaattcttttctttaagaatgttgaatattggcccccactctcttctggcttgtagggtttgtgccgagagatcagctgttagtctaatgggcttccttttgtgggtaacccagcctttctctctggctgcctttaacattttgtccttcatttcaaccttggtaaatctgacaattgtgtgtcttggagttgctcttctcaaggagtatctttgtggtgttctctttatttcctgaatttgaatgttggcctgccttgctaggttggggaagttctcctggataatatcctgaagagtgttttctaagttggatccattcttcctgtcactttctggtacaccaatcaaacgtagatttggtcttttcacagagtcccatatttcttggaggctttgttcgtttcttttcactcttctctcatcttgtcatctcactttatttcattactttggtcttcaatcactgatatcctttcttccacttgatcaaatcggctattgaagcttgtgcatgcatgaggaagttctcatgccttggttttcagctccatctggtcatttaaggtcttctctacactgcttattctagttatccatttgtatcacttttttcaaggtttttagcttccttgtgatgggttagaacatgctcctttagctcggagaagtttgttattactgaccctctgaagcctacttctgtcaacttgtcaaactcattcttcatccagttttgtttctttgctggcaaggagctgtgattctttggataagaggcactctggtttttggaattttcagcttctctgctctgctttctccccatctttgtggtttttgtttggtgacctacagatggggttttggtgtagatgtgctctttgttgatgttgatgctattcctttctgtttgttagttttccttctaacagtcgcgcctctcagctgcaggtctgttggagtttgctggaagtccactccagaccctgtttgcctgggtatcaccagtggaggctgcagaacggcaaatattgctgcctgatttttcttctggaagcttcatcccagaggggcatccgcctgtatgaggtatctgtcagcccctactgggaggtgtctcccagtcaggctacatgggtgtcagagacccacttgaggagacagtctatctgttctcagagctcgaatgccatgctgggagaactactgctgtcttcagagctgtcagacagggacgtttaggtctgctgaagctgtctgccgccttttgttctgatttgccctgcccacagaggtggaatctacagcaaggcagtaggccttgctgagctgtggtgggctctgccctgttcaagcttcccggcctctttgtttacactgtgagcacaaaaccgcctactcaagcctcagcaatggtggatgcccctccccctgccaagctgcagcatcgcaggttgatctcagactgctgtgctagccgtgagcaaggctctgtgggcgtagaacccgccgagccagacacgggagggaatttcctggtctgctggttgcaaagactgtgggaaaagcacagtatttgggcaggagcgtaccgttcctccaggtacagactgtcacrgcttcccttggctaggaaagggaaatcccctgaccccttgcacttcctgggtgaggtgacgccctgccccactttggcttgccctccatgggctgcacccactgtccaaccagtcccaatgagatggaccaggtacctcagtcggaaatgcagaaatcacctgtcttctgtgttgatctcactgggagccgcaggccggagctgttcctattccgccatcttggaagcttcctttcagtttaaattttcaatgttatgccaaatataccactaaaagtgatgattctataactaggaaatttctttactgttgtgaaataatgtttgtccttcctactgtatgttttcttttttttttttaattttcactggaactaaaagttctgaatcattgctatacaggaagtatatattttcatcacaaataattttatgagaaatgttaacatgaagttttaaataatggatctccttttgtaaatgaacaaacaacttataggataaggattctgttgttttgcttgtttctaatccttctgcactgtaataaattcaggaccttgttcttttggtttctccttttaccctttcttgccatcctagaagatgtttggaagttgctgatttggagaataattctgtgcaatagatatttctagtctatttagggatgacaaacaggatattttcttccctgccttgggacttgacatgcttctctttgactccaagattactcccttcttcacactttgccagctaactcccacttctttgtgagggttcattgtggtggcactttacttcctcaggagagtcttccctggcactctcttgtggggtgaggtgcctcttcaatgttccctcttgaatattccctcacatcccctgagtttaggctgttatagaccacaccatacttaagtgcttgctctaggtttcaagatccttgaactcaagactttggaacatgtattgacatgcccaacaccgaacatactaccaggcatttgcaagtcctcgaatatttactgagttcatgtggtgatggatgagtatagtggaagagttcattgattgtccacatttacctgtagtttgttgggaaaaataagattcctgcatgtctagatgatgattttcatcactttcaccagtgaatggtatgaaaagaattgcttacagtcattaacacacagttggtttgctgccacaaattcctacctaactgctttacacagaaaactaggtgaatgtgaagccatttatcagaagtgtttctttgatcatcacacttaatctagaccaagcttgtttgcagtgccctgcccttatctatctatcagattattttatttctgtaacatccagtcttttcactagctggctatgctccaccttcccccaagctaccaaggtacttgccattgtgttctgtcttgagctgccttcctgagcaatactgtttacttccaaacctttctgtatgtgtggcagagagagtctgaacaataaatgatctgagtgatttaggcaaatcactcttctaggcctcatttccctcatgtgaaagggaagatgtgagataagatgcccctaatatatttatatgtatataattattatatattttttatttttaacatatgtgagtgtgtatatatatacatacatatatacacacacatacatatatatgtatacatatacatatatacgtacatatatacacacatacatatatatatgtatacatatacatatatacattaaattttttcttcagtactactattatctgagccattgagcttggtgacaaattggttatggggaaaagagtagactgaaaattgaattttatgttctgatgttggggagcatagtgatgtccttaactgagaagaatagatataaatgagaggatggattcgaggggagagtgttgattttggttttgactagttgattttgagctgccctttgggaggaggttgggaaggcaagctagagttacagagttacaaataaatgtgcagacttgaaagtccttgatataaaggaaatacctgaatctttatgtataagatctgcaaggaaagagtatagagtgagaagggaggagggatcgataaaaacagaaggaggyataaatccaagagtcaggaagaggagcaggatttctatctgggaactcaacttttgacgttttgataagaaagaagaaggtatactgtagtgtcaaatgccacagagaagcagatcagaagtagaaaagttatcaaaataaagtaatttggagaccatttatatgatctttataagggtatttctacaaactggtgggagtggaatactaacttcagggaattgagagttggagcagttcacattaggcaataagatcaggtgatgtttctaagaaatttgatggtgaggggaagagagataaatgcatatatgaagaggcagtaaagttaagaaaatatttatttcaaggaaggaaaccttgtaattttttaggccaaagaagaagctgttagtgaaaaatgagtggtaaagcaagagagagagggtgtaatctctagagacagaccctagagaacagggaaccaagaaagcaggtaaaggatttaatctaagaacagaggagggacatttcttacttgagaaaagagggagaaagaaagagaatgaataaaactgaagaagaattactgggacagaaaggaaagaattataggaaattcatgttaaatgacatgacattttcagagaagtagtaagtaaagtcatccactcataataaagaggaagaaagtatgggctctagaacagtggtcccagcattttgggcaccagggaccagtttcgtggaagacaattttttccacagatcatggagggggagtggggaatggtcaagataaaactgttctacctcagatcatcaggcattagattctcataaggagcatccaacctagatcccttgcaggctcagttcacaatagggtttgcactcctatgagaatttaatgccactgctgatcttacagaaggtggagctcaggcggtaatgctcactcacctgcagctcacctcctgttgttccttgtaaggcccagctccttacaggctacggacaggtaccagtctgtggcacaggggttggggacccctactctagaagataatgaaataaatttagaagtgagacatgaggaaatccaatagattgcctatcataatgagccaaaaaaatcaataaacagtactaaatgtctggctgaagttgggatagtgactttgtagtggagtttttcaatctgattttagacttgccctatataagagctagaccaaggcaaagggagttcgcacagaatgtgataaggaagcaaagggtgtagctattgatgacgacaggattatggtctggaagcagaagtttgtggctagggacatgccaatcccttctccagatgtgctgacttaaggagaataaagagggaacagtgcctcctctgatgagcttcagtagtgccggtgttgtctgggaaaagccaggtttccctcagacaacattgggacatacgaattgggcatagaaggactgttctaaaaaaagtttgaagatatagctggggttgttcagaaaagattgactacctcaagagggagcagtggaagagccagtaatagtatcataagtgtatgtgtacgtgtgtgtagaaaggacagggagagggaaagaggcagaaagacaaggtgaaataggaaagagagaattgcaatagactgtaaaagaagataaaggtagcagagaagatataaagttattgatattgatatatatccagtgatagataggggacatggagaggaagtggactgttttgtaactggtgtagaataaaccaaccccaaggtttgtcacagtggactcagatgcagcaaaggcttcatgcattcaggatgcctattgttgattaatagctacctgatcctaatagtagaaaggaccactgtccaagttactggaataaactttttgtgatgtttgagtaaagcattcatgtcagaattttcagacatacctatakgaacaaaataggtcaaaaatagtcaactatataagactggtatccttatgttaattcttagccagctatactgtttgccactacatgatataatcratgtaggaatgggaacaatacaattaaactatacaccccttctctctgctttgaggaaggttagttatagaataccaggaccggaaataatcttataatcatgtatttgaacttcttcattttatagatgaggaatgtgaggtacgggcatgtgaagggattcacacaaagtaacagcctagtctcttctgttatatttttttggcttaactccttttctctaaattaaaaactcttccttatcttgaatatggttctttctgtgttcatagccaatgtttagatgacatcagtaacaccccagatcagatcatggaaacagctgacagagtgaaaaagcccagtaatctaaatgaaatttagaactttgaacatttttatttggctttgagattttaaattccttatgaaaatattgttttgatatgtatatgtgtgcacacttgttctttatttttaaaagggattaaaatatccaggcatgccaaactttgcgccagatgaaccaggaaaaatcttcttgatggatctgaatgaacaaaacccaagggcacaagcrctagaaatcagtggtggatttracaaagaattatttaatccacatgggatcagtattttcatcgacaaaggtaaaacctgtatgtttaggrataagggggaaatgagggaaatagaaaccatttatctccagcccctcaatatttatgtaacaggaagagagaagatgctattttaccatacagatgtgtttttttwaaatgataaataggtataaaaccttgtaaacattgcattaaagaaggaacactagtatttttggccctatgtggcctcctcctcttccttctatccacttgtcttcttgtttgactgtcacaacctgtttgaatactgttctcagaaatctaacatgtaaactaaaggccctttagtttagttgtcactaaagacaactgtgagacgttaaaaaacataacataagggggaaaaaaacaaattagactcatcaaagttaaaagcttttgtgcttcaaaagacaccatcaagaaagtgaaaaacaacccaaagaatgagagatagtatttgtaaatcatatattagatgagagacttgtattcagacaatataaataattcttacaacttaacaaaacacaaataatgtaatttaaaaatggacaaagtatctacctagatagacatttctcctaagatacacaaaggcctgtaagcacatgaaagatgtttatcatccttagacattaggaaactacaaatcaaaaccagaatgagataccatttcacacccactaggatggtgataattaaaaagacagacaataacaaatgttggcaaggatgtagaaaaattggaaccctcatactttgccagtgggattgtgaaataatgtaaccactttgggaaggagttttgcatttcctcaacatgttaaacatagagttaccacacaatccagcaactctgcaccttggtgtatgctcaagagaattgaaaacctatcyatgcaaaaacccatatacaaatgttcatagcagcattactcctaatacaaaaggtggaaataacccaaatgtctatcaactgatgcattcataaacaaaatgtgataggtatttatacaatagaacactatttggcaataaaaagaaatgaactactcatgcatgctataatatggatgaagcttgtaaatattatgccaactgaaggaatttagtcactaaaagccacacattatgtgattccatttatatgaagtgtccagaataggtgaattcacagacagaaaaattgttggcaggagccaggggagtggggaaggaggaatgacagctaatgagtaggtgatttctttttgggtgatgaaaatgttctggaactaaatagtggttatggttgcacaattctgtgaatatactaaaacccactgaagtttacattttaaaagtctgaattcagtggtgtgtgaattatatctcaaaaatatattataaaaacataagttatcaatataccatatatgctttaaaaacaatagtttccaatattatttttgacttgttcacagttcataatttcaaacatttaattttaaaatatttttgggtctatacagcatgaagaaaattaagaacagggaaacttcactaacagtaaccacatgaaaggaggaccaaattgaagtgctagaattccatgaaatcttatatacacttttatttgcttagcaagctctgctttaaaagataattgaatctaacaatttttcattggtttatagtatacaaactattttcatatataatggtgtctttacttctcgaaataaaatcctgggcccaaccttgacacttcctctccctggcccttttgatcaactcattataatgttttgtttaatgtatctctccaatatctctccagtctgaaatatctgtccatctctccccatcctcactgctaccagcagttcaaggccccagcatgccttccctgattctgcatgggcccccaactgtaccttccttctcataccacctcaattcattgtcatagtaaggatttctttttatgcaaatctgattatgtccctcttttcatcaaatttttcatattgttctgtcactctgaggataaaccccaaatctccagaacggcctgggttcctgggtgcttcccctgtaccttctggcacctgtatgctctccagtttcactggaaaccattctcctccagactctctggaccagccatactggatttcttttcattcagtgaagtgtctcatgcctcaggatctttacatctgctgttccctctgcctggaatgtccgtctgccacttctggctcactctttgtcatcattgaagactcagcttaaatatcatcttctcagggaagcctgcccaccatcttgttccaatttgtgtacctttctatatttcttctcaatgtacctcttttttaaaatcattcattacggtggtaactaattttttttttatgagatgaagttttgctcgtctcccaagctggagtgcagtggcacaatctaagctcactgcaacccctgcctcccgggttcaagcaattctcatgcctcagcctcccaagtagctgggattacaggcatgcgccaccatgcccggctaattttttgtatttttagtagagacagggtttcascatgttggccaggctggtctcgaacttctgacctcaggtgatccacctgccttggcctcccaaagtgttaggattacaggtgtaagccaccactcccagcctacagtagtaacttttttttttaaatgttaaaggataggaattttctttccctctcctgctcttgctctatagcaagttcctaaacttaactgttactcttcaaatgaatgacactctatgaagaacgtgtctccccactctagtattctttgttttaatttatttaataatttttcctccttgttttcctctctcaaatataatcaccataaaagcatattgatttgtccattgctggattctgagagtctagaacagtatctgatgcacagtaggtactctatgaacacatatcaaatgaataaataaacgaaccctataggacaggcagagcacatagtaatattcaactttatagatggatacaatgaagtttagaggaatgcagtgaagtgtgacttcacttctgcaattagtaaatggctgatccasaactcagacagaggaggtctcacttctaatcctgtgtcttttactaaaatgagattaggactctatttaaataattttaaaactgcaactgttttgcctcacactgtacaagacataagattctgcattggagatggtataataagtgattagatttacctgaaactatttcattgcatgggatcatattagaggtagaggtggaggtgggtttggggctttttttctttctttttttttttttttgtttgtttttgtttttgtttttgagatgggacatgtttatacaataacagtcatataatcaggcttccataagttgagtatattatgattcacagcttatcttatttgtttgtcatctcccttaattatgtatttaattcataaggccaaaatattacatatagaaatagagayggaatgaggagatggagaagaaaagtactctcactaagtatatcttatttggaaagagggattcagtagatgcactagaagaaatgaaatcaggctagcacaagtgattgttcactattgtgtctagcaaaagactgaaggtccgtgttggggctgaaatccaacccatgttctgtttgccacgccctgagccttgraacagagctggatcagaccagaaggaagatttcctctgtgagcaagcacctttccttaatttgcatcaaagtgcccagtgtgtttcagaggtcctggttatgaattttgcatctcagggtttgggcttgttccatcacgtgcttaaaaactacatttgggaaaggaatagggaagatgaatacagatcaagtcctacagtgggaggatgggaccagaccctttaaaactccagagctcatcaaacctagaactcctgataagtcagaagacagcattctcagaggccaaattactaccctcaatcttgttcacagcagttcacattccaattgaaatgggtaggtgacatttctgaggtgggtactacctagaattagttagtttgttttatctcgcattcatatttacatgccatgtccattgagctcactaaatattgttatgttggcttgtgtcagaaattcattgtctagctgggaaatgttgcttattttaaggtgtttacactgccctgacattcactgagcttctgttgcaatgtagataattattgtacacacacaacatctcagcaaagttttgtttgcttgcactcacttctcttgctgaagggccatctggggaaaccacatccctgtttatgcatcattatagttctgtaggctcctgttagacaggttatgcatataagggtgaagtgactatggcaaaacatcttggctctgccactttgtggtgatgaaattgctgatggatcattcgcctcctgagcttcaatttcctcaactaaatctggattctggcatttgtctgacttacctatcatgtagactgtgagggtmaaatgcaagatgtaagaagaaaacttttggaagtgaccaagttttaaaacaagtctaatattagttgtgataggggtaactttcttggaaattatcccttttttccatgtagacaatactgtrtatctttatgttgtgaatcatccccacatgaagtccactgtggagatatttaaatttgaggaacaacaacgttctctggtatacctgaaaactataaaacatgaacttctcaaaaggtatggaatgaaagtattgtgcggttctatttactttgcacctctgctgtgtgctttgtattttttggttcagcaggctttcttaaacttttgttttgaaattgttttgatttttttctaaagctttctaatgattcccatggtgactcttcccagcgcctcactagaaattgccatgttaggtattgaatatgcctatattttcgagcattttgaaagcattttaatcctataaaggtgctcaattaaattcccagctctaattccattctctttaccacggcaactcaatacctactatcggtctctgtttaaacacctacacccttttttggttgtcctagtaggttgtgttctgtgagcctcacccactgggtgttataaccaacctccagatgagccacttctttgtttaattacagctttaaagtagaattttttaaaagyccttgggcacttataaaaattacatttgttaagcattgactatgtgccaggcactatgccagaatacttaatttaacttaattctcacaaagcctttaataataggcatgggtaaactaagacttagagaaggtttgggttagataacttgcccaagttacacaatttgtaagtggcagaaacagggtataaacccagatccatctgaattcaaagctgagctctcaattgcaatgaacatctttcttactgcattcattaaaataacaggcttttcagtggagaggctgcctgtttaaaggctgtagcaaacaataaagaattcatcttttatcaaatgggcttaacattaaaaaactggctccaaaacagtaaattgtttcatgggatagaagaataggaaaagaaaagaaagttcatcttctttcctttgctctctttctcaacatcatgtattaatttctccccacagaatatgggggaaacgagtgcagagcatagaagtaagagaagttgaagttattgaactctgctcctaatgcaccgtatggggttctgaggccatagcggagaacaggacttccacagggttgctgggaaactgtggacaagtcacttaattggtgcctcaatttcttgagcataatggggattctcatttgcctgacttacctaactagtggattgcgaggatcaactgctttagcataggatctcacaggaagagtctcccagaaagtgcagcctgagggcacacctgatatttggccacttcattagggagtacaatcccaggaagcagacttgagaaaccagtgtgaggcaaggaagggagaaggttatgggttgaattttgtgtccccctgccctccccaccccactccccctgccaaaaaatatgttaaaatcccaaccaccacttcctcagaaggcgacactttggaaattgagtcattgcagatgtaattagtaaagataaaatcatgctgaaatagagtacccttaatgcagtagaactggtgtccttgcaagaagacaggcagatatacagggagaatgctatgtgaagatgaatactgacattggagtgatatatctacaagccaaggaatgcctgggactactggaatgccttgctggaagaggcaaggaaggatccttccctagaaccttcagagataacatggccctaccaataacacggttttggattcctagcctccaaaactgcgaggcaatacatttctggtgtttaagccactgagtttgtggttctttgctgtgccagccctaggaaacacatgcagtgagggaggtacagcaaaggcgtcattaagccaaccgctgctaactgactgcttgaaatcatggacttatcctccagtaatcagcgtaagctgcatctcaggacaatctggtcaaggagaaaaagggagaagggtttatccaccagccccatctcctattagtcaaaggtttgcctcaagaggccttcattttcccacattcttggttgttgtgcatgtgcaagtctagttttgtggtatcctatgactcaatgtcaacatgaaatctggaagtgggaggcaagaggcccacagtaggcatgagctgagacactgctaggctgcccctctgggaagtacatcagacctgtgcagaactggttgaartagcagcagctggaacaaggtaggtgaggctatgaggatctaaagaggagcctgagggtacactggcacaggcattgataagcacttacaagggggcataacagagagctacagaaacaaattgtgaggcagtttaacctaatttatgatgtcaggcaatactttttggagtaaagaatgcttaagctgagatacaaaaggtgagtagccgagtgaccttgggaaagtcattatatgtcaaaacttcaaagtatttcctgattcacccaaattttcctccctaaaatttaatctaaaaatgtttaagcattattttttcaagtcactttttttttcttttcaaaaataaaaatgactttatttttcttacggattgtaagaataagacttgctctattttaaaatgtcaatgatattgaagaacgtaagaaagaatatcacccataattccatctactcagagaaaatataaaggtccagatgaactgggttatgctatgataacaggacagcaaaaccctaacatcttggtggctcaaaactgccaaggtttgttatgttttttcatgcatgctatgtatccagtgtaggtgatttagggactcagtttcatattatcctcattaagggccctaggaggaccacagtctctatcatcataaaagttgctcattactgtggaaacatgagggaaacatggtgaagcaagcagtggttcttaaaatcttccatccacaagccactcacctcatttcatttcatttcattggccaaagcaagtcacatggctgtgcctaactgcaaggggatggggaagtgtaattcctgaaggaggataaccatagctatcagtgaactgcactacaactgtcacagataaccatgatcaacatttacaagtcaacagattttggggtttgagatttatttgtgaatttatttcttttcactgatttctgtgaaagagaagagtaagaaaataacaaatggctaaagaaaacccatcagggcaatgcagaatcatgattttctgtggaattccttaatccatactagttcatgtatcctttttcaaattgatgaacgtattagtctatgtagagatgagtgattttgacaaggataaaggatatttaaatacctcatgggtctctttttccacctccctttcactttagtgtgaatgacattgtggttcttggaccagaacagttctatgmcaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtaagctcttttgtgtatttttctatcctttgcccttgacattttcgtggactcctttccttacgaggaagttacttccttacttaggcttacgtagtgaatatatgtgtggagggatcagttgtggccagggttcacactaaatctgtcatcctaagcaatccatttgtttccttggactttaggttcttcccagttaaaggagggatgtggacttaaggatataaggacctcattccaaatttttacataactcttgaaacacaytttcctaacacactacaaaggaagataaatgagcaatacccctgccccttatgaaagtacaaagtatttgaccacttatgctaagttcagttacacaaaagctcttaggagagagggaaggctaccttagattgggcatagggattgtataagtttcagacctactgacttacaacagcagaccattcaatgagaaaaccctattttaaacagcatgaaattttatgagaaaacacttttaaaaagtgtttaaaaattggaggtttttttataaacagaagtaccttgaatattaacatgtatatttgagataatgagcaaagatgatccctgtagaaaacacctctcagtgtccttcctcttttaaaatattgtgattgagctttatggtcatttgatactttttttcaagcactagtttttagaagtatatacacttytggccttgtaagagatccacttaccttcattcaatttaaggaaaaagttgtgacttcgaagtaataagattgagcctatatatgtcatctagaaacaccagtttcattatagtcataactcatattcaaagcctgtttaaagcacttcaagaatattaaaaatactaccccattatcttcttttactgtggtttagaaaaggattgcagtggtactttcaaggrgtgtgcatttttatacctcttctccaaaataaaagtgagtgttgtctctcattaccacttgcttaagtgtaaatgtcatttacttcaaaggtatgtctatgtagctgatgtagcagctaagaacattcacataatggaaaaacatgataactgggatttaactcaactgaaggtaagagtaccctgtctggcccacacaatctgacttcttaccttagtcccatacttgacccaggaatgtgccccttgaatgaggaaaacatggctatttgagagcaatgccagtgagattatgcatgcgtttctaaaatacagaagcaaagccccctaaaaacaccaactttaggtgccagaagaagctgtaggggttgtggggatgaatagggaagaaagcgaggaatcattgagacaatgtcttcactactccctctttgttgtaaggtgatacagttgggcaccttagtggataacctgactgtcgatcctgccacaggagacattttggcaggatgccatcctaatcctatgaagctactgaactataaccctgaggaccctccaggatcagaagtaagttcctatacctctctgagctcacaggcaaagctgcargaacaaatttgttggggtgacttggaagaatttaagccagtcacatttggtgttatagaactaaagaaattttacgtatgagaaaagtaaagtttttgacaggtagggagataaggttcgttaactcttttaggccaccattaacttttcaataactcttgctgttgggaataatggaaaaacataagctcgattattcatattgacccagattgccatatcgtatttccaatcaggagatagtctctgagcaggtaggtcttgcagttagacaaagagagagttgtatatggtaccatcttctttcacactgtccaacatgaagctaagattaaaggatttaaataactgtcgcctcaaaataaaatgagtttttgcctgtaagttctaacatatacgatggtgttgaaaattgtcttattttcaagatatcatttgtgttattttaaaatatctcttctaaaacaatagcataatccattgaattttctacattaaaaacaacattataagacaactgcattttctatggcattaaggttaacaatttaaaaatctttagtgaatttatatatagctataaattctaggcacacatactcagagatttattcacaaaaatttattgagtacctgtaatgtgtcagacattgtacttatgtttaggatatatcagaaaaaatatacagagatccctgatcttaagaaagggggacaaacaatgaacaataagcataagaaataagtaaattacatagtaactttgaagatggcaaattttatgggaaaaaaggctcagcagagtaaaggggatcaggattactatatgcagcaggatgagcaggtcctactactaaagtcagagatsagagtaggcctcattgagaaagtacaatttgaaaaaaattaaaatgtgtgaatccacatttggtgatttgagaaactgaaattcaaattcaaacccagtaattggcctagtgggtaaattaggacatacagttatttctacttccagtattgctgtctttcagttaaaaatatgattatttctttttttattaatgtattagtcacagcttcttaaaaagaacacaagaaatgtaaaaagaaacaaaagtccaacctaagcctagaaccagaattgttaccctaaactaggaagcaatccttgcctcagatatgtacccctaagagtgatagacaaaactttcctttaaaagcccaaccacaatgtctgtcttaaggaaatgaaatatgatacataggattattggagaattgtttaggatctttttcgtatctctattttcaagttgaattatttttaaaattttagataagactttttgtcacaattactgacaccctttaattttggttgaatctcatgttttgtacatgaaatcaaagcttaagtatttttgtctaacaaacctgagatgaaggatctcccttaagataaaaaaaagaacaaactctgttctaataagagatatcaatatagactcgtaactcataaatttctaattgttttcctttaattccaaaataaaaattttattttattttgtttgagtgaacttcatccagcctatttggaagcctgagtgcttaaatatacactgattagcaaagttaagtgtattaatcctgggatcaataacagtactaggcagtgatgtgtcaaatgaaattccaaagtagtatccattatttatgctttctagcaactttgcagatgtgaaggggctccagctgtgatgactgccatcccatcagttaccatgttgggttggctggataactgggtgtttcttcattattttgtcttgtttctctccccatactgtaatctcaaaggcaagattcttcccacagagggaggaccaccatccacttgagaactaaataagagcatcttaactccttctgtaagggatgcctgcactaaaaaaattrtgtaagtcatccctgaggaatttggctaatgtcagaaagccagttcactttggtgcatagatatctatgacattagtactttcatcagaagaagaacaatttattgaagatatacagattttagcttctgatttctgaaaaatagatttatcctagaatgtttgggaaggacatcatgaaacaggtgtttactcacataatatactaataaacgatcttttctcgacaggtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaaaagtctacatattttgtaaaagtaaactgataattgtatgataagtggcactgtaagtaaatagcaaacaccaaccagtgagtgtggcttttcttatggatagaagtaaaggagcagacagagattccttgatagccatcaaattgcaagtcaggttaatgacagtccaacaagaagccaaactttacggatctttgttagcagccccaatgttctttctacaataaaacatgtggactatgtccagtgaggtctccgactcacctagaggtccttggtaactgggtccaagtttcctcctacagttttgacgttctgggtctcctacagtccagaccaagagaaaagctaatgttcaagtatttacaacccctgttctctccccgcagttgtgctgggcacagacagttaattaagtgtaccagtctgcagataaagaattagcatcatgtgattgcccaaagcccttagaacttgcattctcccagggtaccgacacataggaaattgggttctgagaaatctgacagttgggcctcagaggctaccttagggcagggagtgcttatctctaataggcccttatttgtattgatgcttgtatctgaaatacagttggccctctgtaactgtgagttctacatctatggattcaaccaaccagagattgaaaatatttggaaaaaaatggatggttgcatccgtactgaacatgtacagactttttttggtcattaatccctaaacaacacagtataacacatatttacataatatttagatgatattaggtattataagtgatctagagagtacctacataggggaatgaacataggttatatgcaaatactatgccattttatatcagggacttgagcatccgtggatgttggtatccatcagagtccaggaatcaatcctccatggttattgagggacaactgttttgctaacctactgggctctgaatcttagatgaagccttaaggcagttatctttgactgcctttatcttacccttctggtttattcaataaacagttattaagcaacctccagtaaatttggccctaaggaatctgaaatgagtagaatggttctggcctaatgtcctatcttgaagaccaaccttaaacttaatttgatgagaatgaatagaagtgtccttttttggtcccaaaccagtacaacctttagcaaacaaaccattaattaaagtcagagcacccaagcacctcccttccctttttgtgacttttattcgggagtggttggttgatgctttttctcttttggggagaccattttatatgcaaaagaacattgctcagttttatgtaggtttgctgaaaagttttgcagggtaaaattctccttttttccagtgtaacccattgtgattttgactataagactttgtagttttcattgcttcaaagaggaataaacattcagcagaatgctatagtcagttattagattttaaatttcaaaagcctagctatcaagagaacacagaataaaaaagacattaaagacataatttaagaaaataagtagagtcagttttgaagaatataatagtctttgttttagtccctagccctcatacttactatattataatgtttaccagactaggggagaataaagagagataggaaaagacaaagataatttagatgctggtaagttcctgagaattgatcctgctctgccttctcctcaggccaagttagaaaggctgggggataaaactttcctcaggaaatttgggtgatctgattgctgagggactaatgtgtcctttccctgggagggcctgggaaagtcacaaagccttagggattctctgtgctcagcctgatgaaaaaacagagaagaaatgctagtgtgatttactggggatggcatcacacctacacttgaacttggcacagaagcaaattcccacgtgcccagaggggtatgggggttagcagagaaagaactgatagacttaaaaaggtcttgctgtcaggaaaaagaaaataagtagtcatctgattcaaatgaagaccgaagtttagacggtgacatcaaagaccagctgtctcccatgatgctttagctctccctgctggattttagagaaaactcccaggattgggagggggctttggaattgccttatatattgatttgtgcttccaaacaatgtgtggggagtcaaaaacaaaattacatgaggctgtggaaaaaataagttctgttacacttcatggttttagctttttcagaattggaacaggataragtggaaagaacttagtcttttgctaatggacatgtgattagtatcttttattccttgttctgtggctaagaccaatggactattaagttggttttctcctggaaatgccagtggaagatccagcataatctcttttacacttcacccctgctcttgctccaagtaggtcagtctcaaccttcagctactgggatcccctcactcagtgtgtcctctctttgggagaggccttggcaaagtggttgaagcttggattcctcctggagtaggcaatttacccattctttccaaaggatagggttgttgattgtcccattatcatcctctctttgccttgtcatctcccttcaataagttttttctccccttcatagggaggcacaggtttaccaacaggcctgcagcctagacagttatctcaaccaattttccctttgcataagcacccccaatctttatgtgattatcttgagcctcttcactcacttggcttgggaaggagaagaatcgctcctcacaataaatgctgcattttgataattcattctcttctcttccctagtctttctgcttaattatcagagacatgaattgggaatacaagggtgagggttagaggtagatgaactcttccaggagccacaagcaagctttggttgtgatatttgacttcaagtattttcagcaattttcagaatgtggggtacttggtgctttgttgtttttatctttgagcccttcgatgctgattctataatcacagaaaaattctcattctrtattcctttggcatcaaacaggttttagtttcaggtagcagaaaccactctatctagtttttggggaaagtgatcaaatgcaggaactaatgcttcacaaaatgctggggtatttcctttgcgtttggaaataagacaaagattctctattttaccatgactgttgtttaacataggattggaagtcctgaccaatgctataagataagaaaaagaaataggctgggcacagtggctgacacttgtaatcccagcactttgggaggctaaagagggcagattgcttaagtctaggagttccacaccagtctgggcaacatggcaaaatcccatctctactaaaaatacaaaaaattaaccagcatggtggcacattcttgtagtcccagctacttgggaggctgaggtgtgaggatcacttgatcccagaaggtcaaggctgcagtgagctgtgatcacaccactgcactccagtctgggcaacagagagagaccctcactcaaaaaacaaaagaaaaataaattagaactgtaagaattgtaagggtagaaatagaactattattgtttgtagattacataatcatctacttgaaaataaaacaatagaaccaagagatataccattaggatactcaacagtgttgcctgatacaagctaaataataacatttaatagcaatgacaattatgaatttgaatcatagagaagatagcactcacaatagcaagaaaatctatacagcatctaagaaataaatatgttaactggccgggcacggtggctcacgcctgtaatcccaacactttgggaggccgaggcgggtggatcacgaggtcaggagatcgagaccatcctggctaacacggtgaaaccccgtctctactaaatatacaaaaaattagctgggcgtagtggcaggcgactgtattcccagctactcgggaggctgargcaggagaatggcgggaacccagggggcagagcttgcagtgagccaagatcgcgccattgcactccagccggggtgacagagcgagactccgtctcaaaaaaaaaaaaaagttaaccaagagtacacaagacctctgtggagaaaatgttcaaactctaataaaaggtctagaaaatattttgaatatgtagatacatattctaggctcctggataaggtgaacttataaggatataaattctctccaaattaatcagtaaattcaaagtctagtagaattcttttaaataaatgacataaacttatttatatcttaaagggacaactttgatttctagcaatacaacaggctaaataattcagaacaaaacagcctaatataaacaacaaaagataatagagaaaatatttttgaaagcatcaaatatcacacaagataatatagaatcagcaaatcataatttaaaggaaagcagaaatccagaaaggtaagcaggattgaattcggtcttgtcctgagggcatcctaactgattgatcttgtgctttgggttttaatgtctcagagggcaaggggaacagaagccaaatcacagttcatcctaaaatgaggagtctaataagggaccaacacctataaaaccaaaaccctctgaccccaaagggctaaatattcctctaaggttgaaataaatataaatctgttcaatatttcgactcccagaaacctaaaaagaaaattgtcttgggactgagaaaagtaaaataaatacatttaatattgctgattaatttaatattgatgaaataaattcaagattgttgttgatatccatctgcttatcatcactcagattttgagccaaattcccactgattgaacggaaaaaaaaaaaaaaaactcaagctgtaaatttagtataaagtcataccatatttgtagtatatttactcacctggcagaaacaaacacatatcctctctggattttatcctagatcttaagaaacctaacaaataattatctaagcaatgagcaacaaatcatagtaaataaataaataaataaataaccaaagaaacagagcaggagaaacaaaagccagcagaaacaagtgatggcagaaacagacttgcagagaccccaaatacagaaatgatcaaatagaggctcaataactatacttacagagtttaaagaaataaaagacaattttaaacccagggtacagtaaattgtataaaaaaattgcaacagatttgaaaaatataaaattgaactttcagaaatgaaaatctagtaatagaaatttaaaacttaatgagtagccaggaaacattttattattgaggtatagcagcttaaaaattgttcacatatacatttataaagggtctcacaatctgagggaaacattttccactttttaatttcaaagcacacaaaaagtgttactccattggaaaggctatgaggatgacttctaatcttcgggactcaaatgcctcgggatagtcactcaaagcctttttttttttttttttttttttttttttttgagacaggatttctctctgtcacccaggctggagtgcaatggcatgatcatggctcactgcagctttgacctcctgggcttaagcaatccccctacctgagcagctgggactgcaggcgtgcaccaccacacccagttaattttttttttttaatagatagggtttccccacattgcccaggctagtctcaaacccctgggttcaagcaatctacttgcctcagcctcccaaagtgctgggattacaggcatcagccactgcacctggccccacacaaagcctctaaatacaccctcttaaggtagatgactagtgaggtcatgtaggttgcaaataaagacaggccaaaacatgctcaggctcagataaagttatgggttatgtgatacatgtggctaattattggaaagggggaaagggacctgaattcattcttaagtttttgaggtcagtttttcggaaacagtgtggggttgtgtcaaggacattagggagcaaaaaaaaaaaagaaaagaaaatgagagacagaaacaaaaacctttaatgggtgaatttaacaggaaatgtagcagatctgaagagataattaatgaaatgaaaaatagttcatgggagattatattcagtataacacggaaaaactgagagaggaaactctaaaaaagacatggaggctaaaagtgagaagatctagcataggacaaattggatccccagaaggaaaggaaaaaaagaaaagagttgggtagagaaaatattttaatcatgctgagacttagaaattcatacctagccatatcttggtgaaactgcagagcatcaaacacaaagactttaaaaggagccaagggtgggaagaactatattgttcaatcaaaatagactttaaaagtaaaagtattaccatggatagaagggaccacccagaagatagagtgattttaagtgtacatgttccttctaatacaaccttaaaatatacacagcaaaaatttgctgaactactacaagaaaaatacaaacagtcgtactgtcatcatgattgattttaacttggcattcattgtttattggtagaactagcaaaatttttttaaaaagattagtgagaatagagagtacctaaaacacacaatttgcaaacttaacctaataggattatatagaaccttgtgccaagtaattgcagatacacattatttcaagctcacaaggagcatctacaaaaattgactatatacctggctgtcaagcgagtcttgataatagtatatattgtctgactacaatgcaatcaagcttagactcaattttttaaaaacctagaaaatttgcatgttgaaaaattatgtaacatttctaaataatctgcgagtcaaaaaagaaaaagaagtaaaatggaaataagaaagtgattttaattgaataataaaaattttccaacagataaaatcttataggaaacagctaaaattaaatttaagtaaaatttatactcttaaatgagtacaatagaaaagaggaaaaactgatattaaagaggtaatatcatccttttgttgatagaagaaaacagcaaagtaagaccaaagaaagttcaagaagggaaatagtaaacatcagagcaaaaactaacatagtagatagctctaggattgttagcagtggtggatccatatgggtctgcagcaacttgattcttgcctcctcaaaggaaataatttacctaaggggtataaggtagagtgagagaccaaggcaagtttttgaacaggaatgagagcaggagtgaaaggaagaaagtatacttggaagagggccaagcgggcaacttaagagatccaagtgcctcatccaacccttcacttggggtttttatacattggcctggttctgaggtttgcatctctccttccttgatttttccttaaggtgggatttccacatgtgcagtggcctgccagcacttgggaggggctgcatatgcaatgtgtttattgaagttttgtgtgtgctcacttgaggcatttttcccttaccagttgagcattcctagaggaaggtcatataccagttaaactccaccattttgcctcttagtatgcatgctcgggcccactcacccaactcctgagaccttatcgggaagctgctgatcttgtttcaggtgttttctatctgttgggagcctgcctgtccctggcatcagctgcaaccaattactattttagtgagacagcttaacaatcacctggccatcacctgatcatctgatggttgcctgagattcatggaagcagcggcggggtgggtgcctcttttgccctgttcatgtctgccaaactacctactctaacattcccgacccaattctttgggaaaatggacaaaggtcagtcttctgtaactgcttcctgctgacagaaggacggtgatgattgttctgtgggtcttggcgtcttgctgtcagggcagggtggctttgtgggttggtgaaagtggtatccagcaaggtccaagggagacaggggcaggatttcgcttctttcatgtctcactgatgggcagtctagtggtcctctgtagaagtgtgactcttgaatattgagacgatggtatctctcactgaggatcatctgaagcttgatggcctgaaggtgtgaggagacaaatcgggttgctagatttagaagacatggcccaaaacggagcaaaagtaggagactaacaagtgggcctaaaaggggaataactcaggagaagcattttcagcttccttcccaatctaaccaaccctgagaggcttgttccagtaaactggaggctcaatttaggagttgtctgatattgtacttttcctgattgattgacccataagcaaaatttttcacctaaggctaaacaagtttctctctgtgctgctgttaacttgtctaactcctgataattttggaggactatagctgccaaagagtcaatttgttcttgcacagttgttaaggttttagccgtagcatcaatgttcttggctatttcccttgagggctggctatgggtcaaggaggcttttgtgattctagcaattctggttcccatactggctataataccaagtcctgtgagaaggagaattaattggatagccctcctcatcctggaaaagatggaatgcctgtagattggtgctggaagagagagattgccagggactatgaagatgtctagggatacatagcctatggtacaagttccagtccggttagtggggaggcactggtgaactggctggccacaaatatagaaggctccttgggttttaagataagtagagatgtaaaaatgaaacaagggggtgaggacagctccaagaaatgccaaggctgccaacacacccaggtagctggtggctatagtcatgcctgctaagacttatgtgcatgggctttggttctgtttagttcccttggttttattttcctaaaaaagagaattttgagtctggtccaatagaacccattcttctgtagaaatgagattggcaatttgcaggcattggttgtatcagcaggccggaaccagaaattttgaatactgcaggagcttgggtgtccctggcaaaactgggtggatttatccagcaaagttcccagaggaaaggtaatatttgaaggtttgggaaatcttgtgtgatggtagaattagttgtgggtgtacgtttggcaagttcgttggttaggatctacagtgagagtaacattgctaactgtactggaaagagccccaacatccattccatttttcttattggccgtaatgcaaataggggctagtcccattaaagtggtattagaaaagatggatccaaaattgggaggttctttgcagatatcagggaaatcttgctttacttttgcaagaaggctatttgcaggcccaaacatctcccattagcctcccattgatagaaaatatgcagttctgcctttatacttgtccaatctcttggtgaggctgaataagctctccctgccgttttagcagaagagctggtacataaccagcaattggtggagtaaggggatcctgtgctttggagcagttactgagctttttccaataatgggaaatcaggatggtagtgtcctgctagtaaaggggtgagattgagaaccaactggagcaggcccatagcaacctaaggtgactgtgaagagagaaactggtcacaaagaaagctgccactggaaggcctagtggtgtacaagttagggttaaaatagtgataataatcagagcaattgcaagtaagatttctaatattaagatcatcttactctgaagagaaaggatgttgaggggcattacttatcttttcacttaaagaggaatcacagattttccagtgcctctcaagtgtgttctggagctgagggcattgcttccagatctggtgttttggagcctttccatggcttcactcaggtgtgatgtatccaactgacaatctctgatactttaatggctctaagggtgaagaggccccttcggactggagttagttgggaattcagagttccatctctccaagctttaataagaactagtgagcctggaggatacagaggctggtatttttccccttctgattttggctttctttgtaaccaaaattcctggagagcctgttggaaacctgctaaagaagagacacagtaggtgattttggcagttttttcatctagcattaagtctgaatataggaatggcttaccatataaggcctcaaaggggattaattgcaagggagtctgaggggcaatatggatccaaagtggggctaagagtaagaggtccacccatggctgtgctgttttctgacagagtttattgagtatgtgttcgagggtttctttagttctttccacttttcctgaaggttgtgatcaccaggcaaagtgaaggtacatttatgcttactaacggccctactaacctgttgagttacttaggaaataaaggatggaccattgtcactttgcaatgacctgggtagctcaaaccaggaaatgcrttcctttaggaggaatttagctacctcctgtgccttctcagtctttgtggagcaggcttctacccattttgtgaaggtatctacacagaccaagaggtacttttacctgaagcctgcagggagatgagtgaagtccatttgccagtcctccccagggtatgtacttctcctctggattggacttattaatggagggggcttccctctctgggaattatttatggtacatagggtataggcttgacaaacctgttgaatggttttgtttagtcccttcccactgaacacttatttacaaatttgtcctagactgtcctttgcaaggtggaagaagttgtaaaaactcttaatgactttccattgggaggttccatttttggacccatcttttctaatatcactttaatgggaatagcccctatttgcattatggctgagaagaaaaatggaatagatataggggctcttcccagtacggtttgcagtgtgactctcactgtagaccctaaccaacaaacttaccaaacatacacccacaaccaattctgccatcaaccaagattccccacacttttctccatctacctgccaatttcttcatctctcctccaatttctccatctacctcccaatggaaagcttttccctgggaggctttccattgggaggtagatggaaaaattcttccaatctgtaccatccactggtttcttctttatacccatgttggctggaccaatctatttcttccttagtgtattggagaaagggcagttcactggggagagagaggaacaagtctcccatgaaggtatcatttgacatggctgcctcttcagcatttttgtcagctaacctgtttccccatgtagtttaatagaagcccctgtggtgtccttcacaatgctctactgccacttcctggggcaaatgagcagcctccagtagctctaagacttgagacccatacttaataggagcatcctgagctgttaggtaccttctttccttccagatagccatgtgggcatgaagcaccaagaaggcatatttggaatctgtatagatggttattctttttctttcccctagttttagggctctggttagtgtgatgaattcggctagttgcactgaggtccctggggacagagctttagtctctacaacttggtgatgggactctgtagcataccctgcatatctagttccatccctgacgaagctackgccatctgaaaaccatattttgtctggattatctatgggctgatcctttaagtcttcccagctggcataaattttgttaagaatctcacagcatgaatatgttgagttatcatctcctggtagtggcagtaagagggctgggttaatggtggaacactgctcaactgttacctgtgggttttccaacaacaagacttggtactttatcaatgtgttgtcagtgagccattatggtccttttaaattcaataaagggtctatttggtgggacattaggagccagattgattgtcccattgtgataytgaagtcctcctcgagaataagggctgctgtacccactaccttgaggcaatgtggccaccattgtgctgctgggtctaggttctttgaaaartaacctacagcatgtttgactggcccaaaggtttcagttagaactcctagtgctataccttgccttttcagtgatgaaaaactgaaatggtttggttagtatgggtagctcaagggctggggcttgtgagagggcagtttttaactacctaaaggcttgctcctgattcttttcccagagattgtgtccctattagtcccttcttttaaagcctgatataaggatttaataattccaccacattccagtatccaaagtctgcagtatcttgtgatccccagaaaagctcaaaattgcttttgggtggttggtgtagtattctaaggattgcctgtatctattctgcagaaagcttgtgttctttgaggctcatgattatccccaggtattggattgcttgtcttagtagctgtgtcttggccttggacactttgtaccttctgtctgcaaggaaatttagatgttggattcctaactctcttgttggggagcagattaacaggtcatccatgtactgtaggagatgccctcccatataaagacttaggtcctgcaaatatctagccaaggcttgcccaaacaaatggggactatctctgaaaccttgtggaagcactgtccaggtgagctgttaacttcttcctttttcattctccaactccaatacaaatataaattgggaggatgggtctagggggatacagaagaaatttttgaagtctaagaccgaaaaccactgagcatctggaaatcttctagaattacataaaggttggggaccattgggtgtattcggactactgcctcatttatgactcacagattctggactaacctgtattctccgttagtctttttaacagttaagataggggtgttatagggtgagttacaggatattaatccatgtgttagaaatttttaaatcaggggctgaagtccctctttggcctccaactgaagaggaaactgccctctgcaaggataactagaaggatccttgagctgaattgctataggcatggccattacagcctttcctggtattcctggggcccagacctctggattaattggaaggtctgtgggcagttcatccttgtgtgtggtttccttgaggaataagattgcatttggaaaagggggtgttggccctggaggaaaggttaactgaactcctagtctaaacaaaatgtctctacccaaaagaggcataggacattctggcatcactaaaaatgaatgagaaaataccatttatccccacaggcagcaccaagaaggagcaaacctctatattatgggcaccccatttacccccattgcctggcaggatttgaggataattgcccagaaaaagaggtaagcactgagcaggcagctcctttgtccaaaagaaaccttacagtcatacctgccgtgtccaaagcagcccttagcttcatcccctcaatagtgatgttcaatccaggagctggccagaccatagggccccttcagctcaaggtcatcaggggttgggattctgtcccaggggccctttggccctcagagaagtctcagatccagtggctgagcttgtggcagaggggcaagccatgcggggctttttcccatctgctccactggggctgtttgccttccagtggcctgacttctcacaccaatgtcagttatctgggagggttgtctgagggcaacctggagggggctaatggacccgtagagcagccaatagttggagctccctcttttcctttcacttctccttttcctgaacactttcctcttcctcctggtcctggttgtaaaagactgaggaagctattttgagggtgtcaggcataggggtgttgggacccagtgctagtttctggagtttcttccaaatcatctggggctgcctgagttaggaartggtcctttaggaccagttgcccttctggtgtctctgggtctaggttagtatatctcattagggcctcttgtagcctccctaggaaagcagaggaggtttcaagaaggccttgatctattaaggccaatttattgtagttcacaggctttgttctgctagctttcattccttctaccagatagaggaatatgtggttccttgtccacatgccccactaggtattgtaatcccaaaagaggtccacctgagaaactgttgtgccccctacccgcccccacccccagagtaggcaccagggtcagtcatatgcattgcatttgcaaattattgggccacttccttaatggagtcacgttctcccttagacagagtttgccctagtatgactgagaggtccctccaggtgagtttaaatgttaagcctaccttgtggaaccctttcatgtatttgtcagggtcttccataaacttacctagttccattttaatttggctcaggtattgcatagtgaatggagtttggaccctagtggctctactggggctgctaacctcttgaagcggcataacttaagggggtggtgtccagaggatggccctggttagggaaggaaatgagccagggctgggagacttggatataatagggtagaaggggagtttgagctaagctctgcccttggtttctctggggcttgagccctggataaacacaataatggtctcccaaaccaaccagagggggctgcctgactgtggctgctatcattgctggatccattttacaagcctgacaaaggtcagggttgtttcttaggactatgaaggcctgtacataggagatttttgcccaatttccctgctgccagcaaaacaaatccagtcaatagatcatattaaaatttatgatctcattttctggccaagattcctggtccctgagcttggattcaacccaggctatattacagaaaaatgttagccttttcttttttagagtttgggggtcaaacttttcccagttcttgaggatgcatctaggggtgtgtcctgtcatatggagaggcaattacccatctgtgaagagagaacagaggagaaaaaaagaaaaaaagaatgcattccctcttattcccctatcatcctttcctaaacattgcatcccccaattcgtccttacagttccaaaataaaccagtctcaccaagtacccctaaccttggtcccatctcatcatgattacccacttgagaacaaaggagatactggagtaaacagggggccccttcttcatccttggggtccagaatgaactggtcttattgggaacccctaaccttgctttccttcatccctattctaatggtaatctgtgcctatagcttgggaccagccttcatctctgtcctatgagtacttttgtctgttgtgcctgaagccttgggctggctcatatctgtctctatgaccttatggtgacctcacttggagcattctagcaacaaaatgattatttcttttctgatattcctattttggggggcataaaatttgaataaactttaatgaaaaaggcaaattaaatgtaaaaacattgaaattattcttcaggctttcaaagaagttgttgggttttttaaaattatactttaagttctggggtacatgtacagaatgttcaggtttgttacataggtatacatgtgccatggtggtttggtgcacccatcaacccatcatctacattaggtatttctcctaatgctatccctcccctagtctccaccccctgacaggccccggtgtgtgatgttccccgccctgtgtccatgtgttctcattgttcagctcccacttatgagtgagaatatgcagtgtttgattttctgttcctgtgttagtttgctgagaatgatgtgctttaagtagacgggaagactggttctcagccaacggctgcaaggggttggactttcctcccttcaaatatggccttgaaggtccttatacctattgagaagaatctggaagtgatcagaagaatggggaaaattttgtatttggggttccttatcctcccggggtaacatggagaacaaatgcttcaacaggcaagataatccctctgctacaggaggaaatgggaagaagcaagaagaattcccacggaaagccttcatgtgcttgcaaaaccagcagcccttggattcaaaagggcagcattttttgccttcttaacataaaggaggaatctccagaggacttggggcttggaagaataagggtttgcaaatggcaaaggaagaattttccttcctccctaaggattgcttactcaaaaaaaaaaaaaaaaaaaargtgggggggcagtggtagtaggtggggtccttaaaaagccacagagtgagatcctatgcagtggataaacagcatcaaaagacaccaaaaaacttggccctggagcatagcataaacgaaatgcatatggtaagtcataaggagctggcaragtcagggttctggtaagtgtctgtcctaraaatgagccaacagacatccacaaggaagcccatttctttgctgctatgcaaacagcaagagcttcaggcatataaataacaaactgggagtgtgtgtttaaggcagagtaggaagtcgtgtggcatgcaaagtgaaagcggggaaaaggcagacttgccccctggtgggtacgcaagaccatttcagaattcacagagagaaaacagaataggtggtgttggttttaggaaaaaagccaattttagtaggaaaaagagaggaaaccccagacattgcacagtcttaggctttagccctacccctctcatgagcctcctatccaggagagctgttattgtctcaggtctacttggtgcagtctccaaggttttattcacccctgtgagccaccatcagggccagctgagagatcagctatggggaccagagctactgtgactgagaggaaccattttgggggttagttaataagcaggagaatgaaaggggagaaggaaaccatgtatgggtatgggggttggatgcctccagcctaagaaggcaaggcatagagatgtcttaccagtagagaatatatccaagtcatggtagcaaagtatttttgcactggcaaatctgtacagctctacaacagctcaattcttgcctcctcaaaggaaagaattcatcttacttgtataaggcagagtgagagactgaggcaagttttttagcaggagtgagagtttatttaagttttagagcaggaatgaaaggaagtaaagtacacttggaagagggtcaagtgggtgacttaagagatccaaatgcctcatgtgacctttgacttggggttttaatacattggtatgattctggggtttgcatttcttctcccctgattcttcccttggggtaggctgtccacatgcacagtggcctgccagcacttgggaggggccgcatgtgcagtgtgtttactgaagttgttcacatgctcacttgaggtgtttttcccttaccaatcgagtggcaggttatataccagttaaactctgccattttacctcttagtgcgcatgcttggacccactcacccaagccaagatcctgagatcttatcaggaagctgctgatcaccagcttcaggtagtttctatctattgggagactggctttctctggtgccagctgcatccaattattattttagtgagacagtttaataaccacctgaccatcacctcatggtcacctgacattcctggtggtgggcagtgggagggggaggctctccttccctgcacatgtctgcctaactacctactctaaccccaataccggaatcccaacatgaaccccaacatcctcacttcctggtattcatgcccttgcatatccccctacaacatcaaatagggctgacctgtttaaccaataggatactctagaaatgatgatgtgtgattgtcaaggtcagatcatacaataacgctaccatttccaccttgctcccagaaagaatgtgttatgataaacatttctgattatttttagctgctaagttccaaagtaatttgctacgataaccagtacaattaatgaaatagaaaatgaacatataatggagtgattcaacaaaccttaaaagttcattctttaaaaagattgataaaaactaatacccctgtgatgagacaatgaagaaaaataatggctcaaatatccaattttagaaatgaaaactaaaacatgtagatgctatagacagagagggaaagaggagtcaatgaatcattttatgccaacaaatttgaaaatttaatgaaatggacaaacttctagaaaaaatatatcatactctattaattagggtaagacgaaattactataacacatagaacagaaatatagtagcttaaaaatcatggatgtttatttctctctcatctaacagttcttgtgagagttattagtaggggagtttctcttgagggggtcattcagagaccccactcatcaaatccttcaggaaagagaaggcacactcagaacggctattgagggaagttctttaaggggactattgatgtaaggatgggaaaactaagggaaattaacaagacacaatacaatactccagtgctagcaatgggatagaagaggtggggtgaggggaaggccaggagctcttaccatctctaggtttgaaggaataaggagtggaagcagatactggcacaagaagagggtagacaaagtggagactctcccagtagatgctgtggccattggtagaaggatgaagccaacctgtgacagctcagcacagagggcatggagggaatagatatcctgacttaacttattccaccctttgaactagaagccagaaggcaagggagctattggtggagttcataatgcctccagggacggagcattgagggggctgcatagagagtgaatcttgagcagtgagtggctctttcatattgctaaccattcctaggtgactgcggttatctgcatggttgaatctaggtcactactgtgtctgtgttctgtcaaagtggaagaagaaagactagagggaatgtaaagaagtacccaatgtcttaaggcccaggaccagcaatggtactcagcacttcaaattcccttctaatggtaaaatctagccacctggccatacccaactaattgcaaaaaagaaatgggtaatgtcaaatgactggagagacatgttcaaggaaaaagaaaataaattttagtgagcaattagcaatctgtgcctgccatttggccaccaaatagccatctgcacccttctctcacacattgactccctcatccctcaccaagggataaaaccccaacccccatccaatttctgcacccacttcaaagtacagtatctccaggtgatgttctgacctccacgttaggtccactagggctgcatgaggaaggctagaaaacaaaattattatccaccaacacatctagattacaatctagagtgtgatcagagtaactataataagcagtcttaggaaaagaaaggaagaagggaatacacttaatagtcactgaaaagttgtttcttttcttttcacattgcatagcaatgagattattattccaccagagaggaagtgagatggtcccctgtcctgaccatggtgtacttccccatgttctttatgatttcaaattttgccctttggaaattcttcctagtctgttatgctttaaggccacctctgaagtgggtcttgaaaagaccatgtaattttagtatccatttcctacaggtataggtctgagagtctgaggacattttcaggccatgcttctggttgcttttgaaatatcaataccttagaaacttgataggcttctgggtctgtttggttccatgtgccagcaatgtcacccagatttcatttcagagcatggtgttaaagccaactttacttcctggttaccatgacccatttccctctctcatttaaatgctgtctcttttgaggccatcagaatatatgggcaagaagaagcaacacctttaatataatctcccatgactagttttcctaatttggaggcattgggaagggctgtgagccataacaatcttacctcctggtgttaaggacatagcaccatatttctagacattctctgtagctttttcctttatacctgctagttctctctctctctctctctctctctctctctctctctctctctctctcttttttttttttgagacagagtctcactctgtcaccctaggtggagtgcagtggcgtgatctcagctcactgcagcctccgcctcttgggttcaagcaattcttctgcctcagcctcctgagtagctgggattacaagcacacaccatcacacctggataatttttgtatttttagtagagacaaggtttcaccatgttggccaggctggtctcaaactcctggcatcagatgaccagcccacattggcctcccaaagtactgggattacaggcatgagccaccatgcctattctactagttctcatttgaaaacacaatttttcttttactgacctctgctaaaagcatcaaggaatggccaacacacatcaacattctggttgctctctgggtaaatgatcaatctttcaagttactgccagagagagttttacaaaatattttgtgatgacagtacaagagtccccatttttgcagcctgtgtgtgaaatctgtttcctcagttctgctctaacgacgtatttatctaggttcaagtttctatatttttaaggtcatgctaagctgttgtaatgaagactccaaatatagtggcttacaggacgtagacattgctggaaggtagtgcatcacagtgggtaaaagcacagatttgggagtccaattttctggatttgaatcccagttcagtcacttactaactgtgcaaatctggccttctctgagcctcagtttaaaaaaaaaattaggtaataatagttactactaccttcagctggtaataaatctttaaaattgaggtaataatattacctagcattggtaagaatattaaaagagttaatacatataacatttagagttaatgtatgttatatgacaatgccatagaagtatctgctaatttttttagaacatttatattctctttcacataagagatctcagataattattccaaatcagtgtgaaaattctgatacttcaggggactaagagctttccattgagttgcttacactctatggggcattgtcattagcttcctgatcaaaattcgctcaccttcacatcagattccagccatggaaagaagaaagagaggatgagaaaacaygtcaaatatctttgggcccaatttggaaatggcacaaactacctccactgacattctattgataagagaatagttatacaattatagctaattggaaggaagctggaaaatttagtttagctggtggtatggtttagctgtgtccccacccaaatctcatcttgaattgtaatccctataattcccaagtgtcaaggaaaggatcagtgggaggtgattggctcatgggggcaggttcccccatgctgttcttgtgatagtgtgtgagttctcatgagatcttatggttttataaggcagttttccctgctcttgttcacactctctcctgctgccttgtgaagaaggtgcctgcttccccctctgccataattgtaagtttcctgaggcttccccagccatgcagaactgtgagtcaattaaacctcttccctttataaattacccagtcttgggtctttctttcttttctttcttttctttcttttctttcctttctttcccttctttcctttctttcgctttcttttccttccttccttcctttcattcattcattcattcattcattttgagacagagacagagtctcactctgtcccccagactagagtgcactggtgtgatctcagctcactgcaacctccgcctcccgggttcaagcaattctcctgcctcagcctcccgagtagctgggattacaggcgcacaccaccacactgggctaatttttgtatatttagtagagacagggttttaccacttttggccaggctagtcttgaactcctgacttcagatgatccacccaccttggcttcccaaagtgttgggattacaaacgtaagccacggcacccagcctcaggtatgtctttatagcagtgtgagaatggactaatacagctgggtagcctcttgccaagaacggaaggattttggtaggcagttagtacattctactacagttccttaaactgactcgaaaagagcttggaatgtattataattctataatgattgaggaaattaagttagtgaattagtataaaatatctttatattaaaagaaactaaaaagtcaaaacaatgaaaggtctataaacattgaaatggataaataaattatagtagattcatacaatgaaatatggacagcaatttatcccacaactagagatacatgctaacaacatgtatgcattttacaaataatgttgagctaaagaaaacaaaagcaattcatgtagtatgattttgttgtgggggaattccaaaataaaaatcaaacaatgttgtttgaagatgcatacctaggaggttaaactagagagaacagaaaggtgatgattatcataagagttaggacatttgttgcttcagggaaagctgtcaagggaaggtacaggggaggcttctgggttgttagtaatattatattttaacctggatggtgatttacattggtgtttgttttataactgtcctatagaaggatatatgtattttatacactctcaggtatatatgatgtatgtcacaattttctaatggatatgagagagcaaagtcagcttcaaaaaataaagggcaagggtaggcctaataataaattagtttagtatttgtgcaagaaaaaacaaatagaccaattgaacagaagagagatctcagaaaacaacatatttatgtatgcagaattaatataagataaagttagcagcaccagtcaatagggaaaggatgttttgtttaggagatggcattgggagaatggtctcactctaaggaaacaaaactatatcttatccaacatctctagataactacctaagaaaggtggactctggatgggttaaagatcttaaggtgaaggataactcttagttaatagaaggcaataaaggagagtatctttatgacctaaaggtagggaagaacttctgaaacaaaatttaaaaagcattaaccctaagactaaaaaacctgattgaatttgaatcatcaaaattaaggatttccactccttgaaaaacaccatggcaaagataaactgacaaggtattagtaagtagactatattaggaactcttaaaaataacgaagtggggataataaccccaaggaataacagacaaatggtgtgaagaagcaatttacagaagagggggaaaaatgacacacatgaaagatgctcagaatcctagtaatcagagacgtgccaattgaagcagcacttttaaattactttatacctattagactagcaaagaattaaaaggcttgatattgccaagtgttgatgaggaggcggggatgtaggggaccttatgcatcattggtggcagagtagatagttgtacccgtgacagttaagatccagagctcaaggaaccacaagaactgtaggctccagagccactcctgcagccacaggcctccctgcaaaacagatgcttgcaatattgcctctttcctcagttatttctaaatttaattttgctcaagtcctggctaacttagatacaaaattacatcctatactctggcttcaaggcagttgaaggaatatagcctttagtttctatctctgcagggcaggtatgcacactagaagagtgaggtccaaccccccagttggggttcaggaactggtattttataaaaactccatacattattctaatgtatgagccgatatttaacaacacttcaccaaaaggatgctggaaaagagcttgaaggtcctgatttagtgtcctcactacacatcacagaagtaagacctaggtgcacactaagtattattgatgtgttcatgtttcattgtcacaatacagcagaaatttgtctacagcaagaaaacaaatcatttactttttgccaaagttcatttttattgtgcaatgagattttctagaagagtgattcactagaaatgtaaatgaccatattagcacagccaagggcaagtcatccaactgagggaaaccaagaggaatgtwcttaagcagaagcagagaatgtaatgaaaatttttaacatattcagtttcatattctgtctaacagatgtatcagaaaaagctcagtcctttagggatgactttgggaaatggtgaatgaataggtatcacatacttgtgttcatcaagctccaggctttgcataccagaggagttctgtggtttctgacagctaactggtgaatcacataaaccatagaatgtaattgattctatcaagaagtaaaatcaaatgaagtatagatggagcattctgtggactgctatcaattttctctaaagaaaaaaagaattggcttctgccatgaatctgaagattgtctgtgggtaaaatgcaaatggaaagtaaattgttcatgaatgaattctagaaaagcccactggtattcatagagagagaaagtaaatatctatatagaaattttgggaataataaagtcagatgtgccctactattaataggtttaaacattttgatcatttccctatctttatcttgctttactcactactttccaggacttttcctaccaggcactgtcaataaatcatgtgcttctgaattcctctgtctcccattctagggaaccagacagacatcaaatatgtatctaagttgcccaagacaggagccagatactcactttatcagcctttgtggtacactggacaactgttttccatatattccatttctcttcttgctgtgccactcttagtgggctgagtatacatctctgtgttattaaactcaggaatggccatgtgacttagtttggccaatgaaatactggtagaagtaacacagatcactttcagatagaaattttaagagccactgtagttcactgtgtctcttttctctttgcccccagactggtaatgttgtagatatagcttgctctgccagactggaccctggattagtgataatcagaagcagagccagagctaacttgcaatggacaagtagcatgagcaataaatgttaaacataaacagtaaaccattgctgttaccagcctctgttgcagcatgctgcagtagttcattctttttcatttgctgtgtgtggtatttcattgtatgaatatttcacaatttatccattccactattgatagacacttatatttatccaagtttttgtacattatgaataaactgcaatgaattttcttgtaaaatgtattttaatgcatgtatgtaaacatttcttttgactatatagaattggaattactgattaataaatcacatatatgtgcagcttttgcaagtactgtcaagcagttttccaaagtggttgtagcagcatactccttcacgaataatgttggagagttctasttgcttcatttctttgccagcacttaataatattagttttccttctttaacttttaactatttggattgttatgtaagaatatctcattgtggttttatttgcatttcttagataactaatggagttgaacactttgtcttatggttgttggccagttggaatccttgtttgtgcagtgaatatttaacattttgttcatttaagaaattaggttgacattatttttcttattgatttgtaggtatgaatcctttgtgcatacatgtattgaaaatatattctattttttagagtctttttcttaatcacttctgttgatgaacagaaagtctgcaattttaatgaaatctaacatcaatatttttgtttatgaatgttgctttgaatatcctcttttaaaaatctttatgtaccccaaaattatgaaatatgcttccttgtgawcttataaaatatttatagttatttttcacatttagatttttcatccacccagaatatacttttggttgtcctgtgagtaggaatcaagattcattttggccatatgtatatccaatatatacagcatcattttattgaaaagaaaatcttttccccactcattgcagtggcactttatcataaataaggtaaccatttatgtgttggtctacatctggacctttttttttttttttttgagatggagtttcactcttgttgcacaggctggagtgcagtggcacgatctcggctcagtgcaacctctgccttctggtttcaggcgattctctggcctcagcctcctgagtagctgagattacaggcgcccaccaccacgcccagctaatttttgtatttttagtagagatggggtttcaccatgttggccaggctggtctctaactcctgacctcgtgatccacccgccttagcttcccaaagtgctgggattacaggcgtaagccaccgcgcctggcctatatctggactttttgttctgttccgttggattatttgtcagtcattcaacaaaatcacagcgttttaattataatagatttataataaaccttgatttttggtattaaaatcccccaaatttgttcttcctcaaaattttttatggatattcttaactcttygtattttcacttaaatttagagtcagattgccaatttgtacaaaacctttctaggatttgtgttggaattttattgagctccttatagatcaatgcggggagaatgtacatcattaaattgccacctttccaagatctgaagttggtatatgtgtctctttaaatgtttagtttctgttagtgaagttgtagattttcgtgtagagattttgaacatcttctgttacatcctaagagtttagcagttctgatgctcttgtagatagtatcttcttaaaatttcattttctaattgtttgttactacacaagaacaaatgattctgtatactgactctatagctagctaccttagtaaatttatgtttttattttaaagtttatctgtagagtctttcgtatcatctacataccaagcacattgtctgtaaataatgagtgttctagatcttcttttccagccttgacatctcctctttctttttcttacctttagtttaatattgggcataagggataatcacaaatgtctttgttcctttctcaatcaccagggaaagctttcaaattctcatcgagtgtgaaaattgctgtaactttttctctttggcaaaatattcttcacctgattaagaaatttgcattctctttctagtttactaaaaatgtttttaattgtaaatgagtgttggatttttaaaatactttttctgcatctattgagatcatcatttttcccctttattctgttaattatatgttgatttaaaacttcaagccaaactcccatatggtgtataaaccttacttgattatgatattattatgtttttataattgtggacttacttgactaatattttaagatattaatgtccatgttcataataaagattggcctgtaattttaatttcccttttttgtaattaattgtcaggttttagtatcaaggttatattcacctggtgaaagacttgagagttatttcttctttttttattctccaaaagttagtgtaaaatttagcattttttcttccttaagtgtttggaataattcacttatgaagctacctgggactaaagatttctttaaggggrattttaaagtatagattacatttatttaaagaatatagaaatattacaattaaatgtttctgcttgtgtatgctttgataaatttagcaattcattcttttcatttaaatttgcagatttagtggaataaagtagttcataatatccttttgttacatatttaggatctgcggtaatatcctctttatttctcacatttagaatttgttttctttcycattttctttctgtcagtcttaccacagttttatatctttcattagtcttttcaataatcaacttttgaatgttttgtcctaagtttttattgtagtaaatttcacatagtataaaattcatcatttaaccattcaatgacatacaattcaatggcattaagtatgttcacaatattgttcaaccatcaccatgatcttgcgccagaatatttttcaccatctcagaaggaaacctatgtgcattaagtagttattccccatcctcctctcccctgcagttcctgacaactactaatctgctttctgtctttatggatttgccttttctggctatttcatgtaaatggaatcctataatatgctgccttttgtgtttggcttctttcacttagcataatgatttcaaggtgcatctatgttgtggcatgtattaggactttattctttttttataactgaatgacacttcatacaatggatagtctctcttcaagtttgttttttatttcattgattgctgattttatcttcatttccatccttctcctttctttggatttttaagctttttgagatgtgtgcttagacaattgaagtgaagtgacatagttctgttagctttcccttttcgtactttcagtttctgtttttaggtgcacgtcagttttggtttgcccatatctagacatacaaacttagggctcctacacttcctaattggatgactttgtatgaatggggataatcgtattgatcctatctccttgtccagggtcttgtgagagaatgtaaggtaaaagcattttgtaaactaacttccagacttggatagtaccttgtactttgcactgccattgctttatatctgcatagtgctttcacaggtttttaaaaatttaatacagcaaacccacaggaattatctccattttacagatgttatttctgctactatagaattttcaggaagtgaccatgaatttagtatttaaagcccagggtttttgggtttttttttcttccagctttactatagctgcctcatgcagaatggtattattggcattcttagaacattggaatttcacactttcagaaacttgagaacattgcaacaactgccaacagggctcagcatcctctgcagatgaacaacaccaagtggtatagttacccaatcaatccttttgcacttctacaaaattaagcttggcaaacttggctctggctttctaccaattcattgacagtttttactgactactccgtgaattaggctttttgtgggaaaataaaagaatgggttgatgtgattgttaccaaatatatttaggaagaagtatttgaacatgtgcaaataaatacttagcacatgaggatcaagggaggaaaggaaagggattctaatagtcaaggtgagatctgagtttttaaagaagtttgctttttaaatgtttggttatacatttctggtgataaaaaaattctaagtttaaaacaccttcataacttctcataacatttaaaatcttcacatagcatggactcatactcttgtctgcacattttaacatgtgtgaaataggaaattattgtataattaatagtttcttagaattgtgttgtagattaattatagtttttcttttttagtagtacataaaataaaagaataatagatagttatgtatttaacactgatggcattacagtaaataaaatatggaacattaaagtattccagaggattctgtaataacttttaaacattcattcattcattcatgtattcaacaatatttattgagcacctagattttgttaggtgctgtaccaggcgttagagctataacaacaagcaaggcatttttatacaggcttctggtctagtgagaaaaacagtaccgtgataaagtattaacaatacagagtggcaggaataataaagaagcagcatggtgcaatgagacatatgagaatggtatccaagatttagacatcaggaaaaactagtagaaataaattgcaaacaggtgcctgaaggagcaggtaggatttgatcatgttaagaatggggactagtattcataccctcgtgtaattccttcaccttgagagaacagaatgaatacaacatggaaaaaatgatatgtcactttgaaaattaggttacaaagagatggtgacttccatctggcttgttaaaatgagatcacagtcctggccaatgcctgggctacgaccttgggaaagaccctgaggcagaggcaccaggtaagttgtagtcatactcctggcccacagaaagtgagaggtgataagtgtttgttgttataagctgacacatttcaggcttgtttgttacatgatggtagataactaatacatctgtagggaagtggggtggacgtaggtatgagagggattgcaaataggcatgaagaaatttggaggcaaaggatatatttattaccttgatgcctgtgatgttttcatgggtgaatatatatgycaaaacttattgatttatatataatgacatatattgaattataaacacatataattatatttatatattataaatgtgtgcagtttattgtatataaattatatctcaataaagacgtttgtattttaaaatggggaataaaaagcttatggaaagacagtgtttcaggcaaaagagcaaatgaaaacaaaagcccagagcaagagctccagaaaaagcagaccatttcaaagtgtgcattgacatgggaaacctttgctcttggatttgaaagagataagtaggttaagggaaggaaggaggacaagattggttgtgaaaagaggtaaaagagaacaaagagaacaaatagtcagtgacttcaaacaaataccatggatttttgtgcaagaaagaccacttgggttctttaaggcccataggacaactgggtcagaaaaggagagagtggcatctctagtctactcccaaaccatctttcaatccctgctcctcctgcctcctttatccccaaccccttgccattcatttgtactttccttccctttacaaatatttgagcatttactatgtgccagaaactgttctaggagttagagagaaggtagttagcaagttaaggtctgtgacctctaaaagtttacatgctagtaggggaaggcaggtggcattaagtaggaagatgatttcctatggagtgctgtgaagacagtggtgatagagtccttaacaccaggtatggcacagcctcaatcagtcagttcagtcccagctgaacaaaacactatttgggagaagaatcctagagaccctactgtgccaggaaataataccttggttgctagatcatggtaaagtgagggaggattccagggaagagagaatggtcagtattgtggaggacctcttggagggtctgaggaagtggttatttaacaaccactgtagaaatatgtcattattctaataaccagtaattctgtactggtgctaaccatttgatatcagcactgaggtcttagtaactggtgcagagagagggttcaggagaagagggtgtggaggaagtctactctagatggtaatattgggaaaggcctctcagaagaagtgacatttaagctatgacctgaatgaagagaaagagaaatgcaaggggtagttgggaagttaagtcagggggatgggaagaggattctagccaaagaatagcaaagacaatgatggtgaagtgcaataaacttggtgtgtgtaccgaatggtacaaaagctaatgttgctgcaacgttatgctgagtgaattataagaaattaggtcagatgataagcacagcccagatcttgtggggcctttcaggccacaataagaaaataaaatgagaagccacaagagggaggattttaagcatggaaatgatataatctgatttacatttttaaaggattacgtgggccttggtaagaagaatggatttgtggggagggtgattagggagagaacaatggagaatctgttctagcctggagatgatagcagcctgaaccagagtaatggcagtggaaatggggaaaattgggttgattcaagattatttgaaagttgtagtggtttcaaagagctatctatacattctttgatatgtgggctaggcatttttgcactgctataaacacctgaggctgggtaatttatataaaaaaagttttaattggttcatggttctgtaggctgtacaggaagcatggtgtcaacatctgctcaggttctggtgaggacctcaggaagcttaaaatcatgggggaaggtgatgggcatcactagcatgtcacatggcaagagagggagtgggggtggggggaggtgctatagtcttttaaacaaccaaatctcacgtgaactcagagcaagagaactcactcattaccatgaggatggcaccaagacaattcagagggatctgccaccatgacccaacacctcctaccctgtcccacctccaccattggggatcacatttcagcatgagatttggaggggacaaacatccaaaccatatcaatatgcctcaaggcatatgaaggggagcctcaaaaggtgaagtttaattcttctcaccttgaatgtaaactggagttagcagtttgcatctaacaaacagaatatgacagaagttaggggatgtcatttcagaagttaggttaataaaagattgtggcatccattttggaggcatgctatctcactctttcagattgctcattctagtgaaagtcagctaccttgttctgttgtagttctgtagagaggcccacgtatcaagggactgaagtatcaagggactgaagtctctaaagagctgtgtgagtaatcttggaggctgatctcacctccttcacccactccagttgagccttcagataagatggcaattcacactgacagctcagctgctaactcatgagagaccttgagccagaggtatctagctgtrccatgcctgaattcctgacccacagaaatgatgagataataaatgtttgttgtttttaatggtgagactttagtataatttgttatgcagcatacgataactaatacaaaatagagcctataggactgactgatctgtttggtgcaagagggtgtgaggaaaagagatggatgaaagaagatatgtagattttggacttgagcaactggatggtagtgatgccatttattgaagtgtgagtttgggcaggggggattaagagttttcctttggacacattttgaaaagactrttaaacaccccagtgggcatgtcaaccaggtagcctgctgggccctgcccaaattccttatgcactgtttatgagcataagaaaatgattgtttggtttagcagctaaccttgtgaaatatctccaatcttccattctcaccttaacccattctaatatggtttgtgttcttttgactcgtgtagaatttgttcttattaaaccacctattgtatccatgttatctaattcagtagttacttctctgccataagcatactcaactcatagccacattggacacagatcatcattccccctcttttcsaatactcttctcttttggattcattggttctacttcttaggtagattcttctgctccacctggtgttaaccagggtggcttagccagtggtattcagttggtggccaggctgtggtggctgggcttgtctaatagcccacttcattcatttctgcttccttggtgccgatggttaagaggttggcttcagctgaccactttccctctccatatgttcatggcctttcatgtgaatgctccagtggagtggtcaggttttttacatagtagctcaaggcttaagagcaagtgttcagaaggagcagagagagagggcagtagttacaatgtgaggccaaagaagcttccccccagaaarctaaaggtgataagtaaagcatgttggtattggctggcaatattccacaagagatgaaaggacagatattgcagaagagagaaggtataactgggaccaaaagccttgagaaggaaagagacatggagcaaatcattcacagtaacagcagacagcagagaagagasacatggttgtacagaggcacctcctttgggtctttactcaaatgccccattatcagtgagaacttctctgactgctrttcttcagcagagggtattccttatcccctttcttgctttatgtgttttctccataacatatgtgcatatccataacacacacatgcatcacctagagcattatatatgccacagtgacatgttttgctgatttctcaattgactccccccattggaatgaacgtaagcttgaggaagacgttttgtcctgttctgtagcatctagaacagcgcctggcacatagtaggtactcaataaatgccagctgcatgaggaaatgaatgagctgtgtgggggatgtacttgagtgaactctaaagtcagagtggtgttgagagaaaaatgcttgaaatccagatgttggaaggtgacacagagtagtagcctggtgagaacagttagatcttaggggttcctactacagccctcccttccgcacctttttggctgtcaccatgatcaagctactgaatctctctgagacgcaaggaccgggatggcacaaagtgagtgctcaccaaagcttgactgtcctttcccatggcaatttacttcagcttgtttgatttcccctccccgactggactaggcacctattctctgtcttctctctttacagttggaaggagcaaaatgggacttttggctgaaagtgctgagctcctgcggtgggggctgaccgcaagccrcgccttctgtgcacctggtcggcccagctagctgcsgacccggcggggaggggyggggcgggccaatcggcgctgccccagcagggctgcggctgcaggcaggcagagcctcctagcccgtcggtgtctgcgcccatcgatccctttgtctatccccgaccatggcgaagctgattgcgctcaccctcttggggatgggactggcactcttcaggaaccaccagtcttcttaccagtaagttgggttgtggtgagggctgcagccttcgtcctcctcactccctgccagctccacgagcccccagaaagttgggtccaggctgttaacagaacatttacaagcaggtgctagatgcacactctgcgggggtttcataaatgtttgtccagccgtcatgtgtcacttgaaaacaaactcttgctcatggcctgagacatgggataaggaggcaattgccaggggtgtgagtgcccaggttgtcagcatacacgaattaatttttcatgaagatttgtgtgccctggctacagattcacttctcaacctggaaagaaacaaactaacctggctgggggttctcctgatattttgtgtattagagaaaggagcccctgtcgcttctgcgccttgactgcctggccatggcaaaccttccaggcttgaagattctcaaattgaggctactgagggccacagcaaaactgcgtgtggacccgagcaggtggagctaacgtgtgctgtgatggttcgcttcagtgggggcaggcggggaagagggaaccctggagccagcatctgatgtcctggggtttagctctgccccatgagtatgcgatttgggcaaatcactttacatctctaaccttagctgcttcagtaaactggaaatagtaatacacactgcctgcgacagagtagctattcaataaatgttagttccctgcttccctttaaagtatttaataaagggttaagtgctatacaaggggggtggggatattttaagaatgtatcaaaagtttcataacttttaacaggagttcaaagtctacagatcatcctagtctctaaggcttagtcaacaatgccttatttactttaaagtaaaacctaataaaaattaaatataaaaaaattatatgagcttatggactaattagaagcttacattcagaatgggtttttactatttattgtggatgtttttctaatttttttaagttacagagtgcagaaaaaaagtaagaagcagttgktattcttggcttttaaatcatgtaaaaattacagtttgtgagtttttattaatcacagtgctggtggctgccaaaggagattataggtatagataaaaatatatagataaaggatgggttgctgagcctcctggagtgacccagacagaggaaggaagggaaattttacccactgttggaaacccctaaaacctagctactcaactgggtctggggaccagatgcctgagcatcacctaggggctccctgtacaggcagaatctcaagccctaccccacactattgaatcagaaccagcgtcatggaacaaactccctgggggattagagatcatgaatctgccccagggagagaaggcaagagatgatatcatgaggyctgcatcaggagcaagccaaatccccaggatagatgcatccttttttcttcagacttggagtgtatgtgtgtgcggctcacaggaagctatatatgcctgggctggagggaacttaaggaagcacacaagggatgcctcaagagatttctgagtttcccaggtgggagcagtacagagaaaagaactgagagagttcccctagaccacgagtctcccacccacgagtctcccacctttgtagtcggctgtatgtgccgcacaagtccagggaatgccttggatgatggtagaaacagctcccctcccctaccccaacttgggctatggaatgttgcagcatctgtatggcaacttccttgtccctacattgctaattgcaatacgtgagtccactgagtttcccttctcagaaggaaaccacaaagctaacgttgggcctctcgatgcatttctgccattccatgcttactgtaggcaacacacagttgtgggaagagagtagttgtggattcctgatgacctgggttagatatcatttctgcaactttcaagttattttaccactttattccagaaaagttccagccagtttctccacccgaaaattaggggataataatacatattacagcatatatatatatatayacacacacacacacacacatacatatatttatatttatataaaacatataaataaaactaagwatatatatatatataaaaatcaggcatatagcagatgtcctgtaaacgttagcttttatagctgtcatatgtgatctcaaaaatatagagtgatacttgaatatgtattataatcatacttcattgaaagtctgagataaggacaaataatcctccaaccctccagtctcccctatgaatgcaaccaacaccatcttctcagtctgatgtacttgcctagtatctccacaaaacacttcagtggacatctgcagagtaccttctctttgcaaacgttgtgtttctgctggaggttataggaatgaataggttgcagtattcactcaccaattttaaagtctactgggagcaaaagaacaaaaactgacagctgtgaaactgacaactatgacaactatggtaagaaagttgacagatgtatatgtgaaggttcctgagggtaaastaaggagttattaatcccaatgcagaagactggagaagctacaaagcatcatgagtaggggtctttccagtgggtaaygggctaaagagcattctaggtgaagggaaaagtgtgagcaaataaaaagaggtatgaaagaaatacagggaagagtccttagtatcatgacacttgatttcaaatcccaactctaccctcttaaataagcaaccacatgcaatttactcagcctctcagtgcctccatttccttacctacaaaacagggtaaatattcatctttttctcaaagrtggctaaaaagattaaatgaggaartatgtgtgagagcccttattggagcttggcacatagtaggccatgaaaagcaatttgaatgaatgaggcgtgtgtagtagcagaaaatagaytgattagagtgaatttggccccaagaagagtttgagaatcgatacggatttcttaatgcctaggcaaagatctctgcttttttctgcgagcagccagcatgtattttcaccgaatacttctgccttggtttggatgttcgtcctctccaaacctcgtatttgatctctaatgttggaggtggggcccaatgggaggtgtttgggtcatgaagatggatccctcatgaatagattaatgacctccttgggagtgagtgaattctcactctattcatttcgagagagctggttgattgaaaagagcctggtacctctcccctctcttacattctctctcatcccatgatctctgtgagtactggcttctcttcatcttctgcaatgagtggaagcagccagagcccctcaccagatgcagatacccaatcctgaactttctaaccatccagaatcataagccaaataaaccttttttctttatcagttgcttagcctcagatgttcctttagagtgacacaaagcagactcagacaagttcacagcaaaggctgtatggtttctgcgcaragttcagagtctagtgaatcagagatatatctcagacattgacccttatctcttaggcccagaacatttggacttaagcctttgacaagatatttcctaataaattgaaaatgaggtagaamaaatatgagttggatgataataacacaggtgggtcaattttcaggtgcatcttccagcttttaagcagtgttctctgtagattttgcctggtcagagagctaaatgtgagctttgtgttcatacttraattccaatccctgctcagccactttataactctgtggccttagaaagccacttaatcttggtcaactataacttagggaaaataacacctcacggaggtgtttgaggattaaacgcgggcatatayggtacctgaactatagtagtaatgattatcctgttgagatatgacatgtttgggccacaaattggaacccaaatcaacaagtgctgacttaatgcccccttgcccaccctgggctccctttaactgtgattattctaygttttccaggctagagatcatcttctatgagagagaagcctgaattagaataggagctgaccagttctgcctttctccatcttttgtgaacccatatgtttagtgacccttgtgagtcaggcagcrtgagtattcttcccattggttttgagtctaagaaaagtgaatttgactatccttggtgtttttcacaagtcttggcccattcagtgattttatgtccttgaatctctccttccatgccagtctttgtgttgtcctcggttatgaccatcacccttaacatcttgtacctgccctttggttccttgagggcatgctacaaatattcacyacactttccctagaccagagttttttcaaatggtgggtaacaaagtcaatttagtaaataattaccaacatttaaaaataaataaaacagaattgaacagaaaagttatgaatgtatgacacagattaggatgagtattgttttgtgaagcttgattcagatgtgtatgtgtatgtgtgtgcatgtgctgggtgttcgcaccatataaaatacttttcctactgtgagtctctgtctgaaaagtttgtaagccactgctttatcacttccccttttatttccttattgtcaatatttgcaattataatgtcagattttcattttgaaaatacctttccctttcttaggttatgggacagattccaactttcctttgaagcctgctttctaagttcacatctatcaatcaggaaaccacagtctcctcacagtccaagccttcatcatctattcattcatctctgtatttctagtacctagactggtgrctctttactctggttatacgttgggacaaactgtggcacttttacaaagcagattaytaagaggcactccttgcctcttacgtcagattttyttagacagcgaaaatgatagccagtggcctgatggtaggaatgtactcatttttttctgaatgaataaatgaaagatcaatcacccccaaattcctatcattttgtaccacgtcggtaagaaktttatctagcgtgtctgttccgcctgtagcccatccgcctcctgtgagttcaagtcatcaggaggacaagtaaatttcttagcctatctgaagccaaataagatttctagggatatttggataattgtcactacttgctatgacaatactgtatcactagttctctaaaaaaaaaaaaaaaaaaaagtttattgtttaaatctcttggttgtgctaacgtcgtctgtttctttcaaatgcagcatcagtagcttcgctctgctcaggcagccggctggcacttccytctcacatctgttcatttttcctttgtcctttactcagacattttctatggtgtttatgcactcatatctaataagtcgctcctgtgtatgtgtgtgagtgcacctgtgtgtgtgaaatgcctttttacatgcaggccttgtgtatgattttctgaagttamaaatcctttcaacgtacctgtatttttcaagcactacatcacaaagcagatgcccagtccaggctgcggagtcagattgggcagatgagtaggaggctgcccatctgtcagcaactctaaaacatcaatggaataaactggaaccatgttgccrtttacccggactttccacytaggagtccttacacactgatgaaattgctcctgttcctrccaaagtacacagagccctagagaggatattatgtatctcttatgtgtacctatccacctctgctaaataaaaactaaatattgtacccagagttccccacttgtcttgccctggccttgcctggaaaaattgcaggaaaaactctggagttgaaactcaggcaaagtayagtgaaggagaacttttgtggactgcctacctttgcaacttattataatttctgaatagttttgtgtgtgttttatttctttctcccccacagaacacgacttaatgctctccgagaggtacaacccgtagaacttcctaactgtaatttagttaaaggaatcggtatgtatgtgagaggaagaagggtctcatttgaacttccggtatttttttgctctttgtgtgattaatgtgcctgttcaattctgtccaaaaataaaattttgaatcaggagagtcagtggtagttaatgataaataccatgttgtttgacttttgacttcaccaacatactgccaaggtgttgggagttttggttgtttgtttttgtttgatcaatagagcaaaaaaaaaaaaaagaaaaaaagaaaaaagaaaaatagaataatgtttgattccatggcaatctaacctgaggagatggcagaagaggggagggagagccagataaagcattgaataaaggtaacttttttttagaaaggctctgacaggactttgcaattaccacaaggcttctccttatgcatctctcttttgatattggacaggaaaattttttccagaagctctcagcagatttccccttagatcttatttgtcagagctggaggacaggctggtgccctagttgcaaaggatgctgggaaagtaattatcaagcctccaatgtgggaggcaggccctgtcagcaaagataaaacggtaggagaatagcagctgggaggcaaccaacaagragagtccccgggctcaactctccagctggttccaaccaaccagctttgttatttgaagacaattggtttgagatcatgcttttgtgtgctttgggtgtttctttttctttyttttttttttttttttttttgttcttttagaattattcatctcagttgattaaggctcaggaggctagatcagatgacttagtaccactaaatttcactagatatcttatggtgcgattgttttctagaaaaatatgatattgatatcaaatatcactgggtttttgaaaagcaaactttccactaagtgtagaaatacctatcaaatagttcatttttctctagataaattgaaatgttaaaaatttacatgtacttaaagtataactaacttgaagacagtaatatttaaccgatgtttataattagtagtaaaaattcatattcttgatcamctaaaatgtatccccattttaactcaactatttggaatttgcttatatcttcaatatggctttccaagggtttaattgatttggaagtattaagtatcaacatatatttgtaatttaccttgtatctttagaaaacaagttcttttcaaataatcatggcttttgtacgttttgtgaatttccatgaactttaagaggattcagtctttgaggaaaaagctctagtccatcaatttaaaacaaatatactaagtgtaaattttaattaaacttgttaatgaattaatatatttttaatttccatataatcgcattmatcaatttgaataaatgaaagaatgaattattctgaacctattaaagaagagtgatgtatagccccagtttcaagtgaggtgtgataaagaaatggatccacatcctgcaataatatgaaacaacctgtactttctgttctcttttctggcagaaactggctctgaagacwtggagatactgcctaatggactggctttcattagctctgtgagtgttttctttcacttttctgtgttctagaacgttttctaggactggcagtttaagtctttcacttaggctttctgtatacccatgcccactttcaaataaaatgaacagtcatggtttaaaagacaaattgtgtatgcatttacacttgtgctataattatgatcatgygtgttctatgcatatttgtgttcttcggtctacattgaaccatattacgttagcttctattgcagcaatttttttgtgagttcagtgtattcaagaattgttttcctctcaattgtctattccctaagcacttaaaattgccatattcaaatatttgctaaattaaatatacatttaatgtatactacttcacaggtcatttcaactttcacrtttttaaacaaatttcagaataagccctttaatttaaaattgttgataggtcccaattcccaattcccaagctttgaagacagaatccaccatatttgctgaaactgtcctgcatatagatcgctatggtagctgatatagtgcaaaacaaaagaagtccaccatctggcctagggatcataacataacagagttgataggaaacgacagacaatcatccagccatttaaaaacctttgctaccccttgtaatttacttagtccagttttctcttacaaagatgrtagactagtcatcctgcaaagcaatgtcttgcaaactttcttgagcaacataaggtgtatttcaagcaaaatcttatatgggaacacaatatataaaacaacagctttattgttttgattgaaggctaagaaaggagtagttcctctggcccaccaaamctctgtctttgagatgcttccaaggacctaccagggaacagtttaaaagccataagcaatattctctctgtattccttgcttatatcattgaagactattattaattgcctttttggtctgctcttccatttttgatctttctcatgggctggaagctgtagtgtcgtgcacatatgactttgctgcaggggatgaaagggtttgtgtggggtggcctagtggagcatgtggcttccagaagacttctcctggggacccattacagaagctaactaagaggcttcctatgtrgccatctggctagccctgtggtttggagcagtcaacatgaacccatgggccatgcagcgcctctattagcatttgaagtactggtattgtgcttgatttttctcctccatggtttataagggattaaagtatcctggaataaagagcttcaaccccaacagtcctggaaaaatacttctgatggacctgaatgaagaagatccaacagtgttggaattggggatcactggaagtaaatttgatrtatcttcatttaaccctcatgggattagcacattcacagatgaaggtaacaatatttactatttattaaaaccaaaaccaaacttaaaacaaaaacagaaaaacatgccaataaatgaattattttttctcattcaaacaaagcatagtcatgaataatgttcttactctgggttttaaacttaccctctatgttaattgaactttatagtaaaaccacttaaatacttgagaatgctaaaatatttaagatttgtaaagcatctaattttgtaaaatactaacattcacattatccctataattaccataataataatatccagccctgatcattatagcttttccattttaaacgattttcaagactcgggcatttacaggaacagatttttctaacccaaggcatctgtaagctataggtccagtgacagaaagtcaccatggtcagctttctgccggtcccattatcttcaatgcctcctgtccgctggttcctctgttctgtgttcaaaatgctcctctgcatgttggtccctttcaacataacttggtgtcatcctttatgtctttactccctttctccctttccatttgctgtcacttccttgtctctgtattaattttcagccccagttgcacaatggtagcacctgaagagtttaaaaagactcgatgcccagcccccagcttgacagattccaattccgttagtctgagggaggcctggatcacagtagttgttaaaagtttttcagttgataaaaatgtcaggctagggttaagaaccacgtttatacccattacctccatttcatcatcagacgatccctcattcagttcctcttctggactttccccactgtgggtggctaaaattgctaccttgagaatcatcagtgatgttcctactaacaaatctcctctcttcccttcctccctctccttccttccctcttcccttccttccttccttcacctccttttgttttttgttttgttttgtttttgagatggagtcttgctctctcccaggctggagtgcagtggcgcaatcttggctcactgaaaacttcacctcccgggttcaagcaattctcctgcctcagcctcctgagtagcggggaccacaggtgcatgccgccatgcctggctgatttttcgtattttagtagagacgggggtttcaccatgttgcccaggctggtctcgaactcctgagctcaggcaatcctcccatctcggcctcccaaagtgctgggattacagttgtgagccaccgygcccagcctacttcacctgcttttatgctgtttaccattttctcattcacaaaacttgctcttccctgatactgcagtgcacctagctgttccagttctcatcctactacaggttttctccccaattcattgttttgtcactcattgctacttccctgagcactaccccagaggtttgatcttttacttcctctatattttctctattttagaactttcaaaccagtgtcacactgcctgctttctaggaggacatccccaaataggggtattattattcttcttcttttcattagcccttcacttttaatgccgcaggtgcttactggacacttctatttggattcctttcctatagacactttaaactcaaaatgttgaaagtgattttccatccttttatctttccttctcttccccatgtgagacacacacacacacacacacacacacacacacacacacacatatacatatatatycctttcaatggactttccactcatccacccattcatcaccattatgttttattttaaaaatatttttaagtacaaagaaatatagtgtttgatgtgtggatactttttaaaataaaaatgaggtaatattacacaaccccttctataaattkcttctgcattaaacactacatcatggactcctttatatatagcacatttgcagttgctttgccaaggcagttcgggattcagttgtgtgggagcactgtaatatagctcatctgctaacaaatatttaggttgttcccacctttatgctcattgcaaacaatgccaaaataaactttctcgcacatgtattttctgagactatatccttaggatacatttctagaagtagaatccactgcacaaaatgtgaattcaggttttaatcctcacttgaatttgatttccaacaccctccttcctcagctgtattcagggcctttggattcttcctgtcaaatgcctctcatgacctttcctgccttttattgccagtggcatcctcttggtccagtcctttctctccacattgctggattactgctgtagcctcagctcatgttactccttggttcaaataccccagtgagcaaagcttggatcttcatcttaagccctaacaagactgattctggctccctgtggtttcagccctctcactctcccactctctcttgccttcactctgctcccagcacaacctcacaattaagtgaatatgtccaggaagttctgccccggggcctttgcacactcccagcacaacctcactattaagtgaatatgtcccggaagttctgccccggggcctttgcacactcccagcacaacctcactattaagtgaatatgtccaggaagttctgccccagggcctttgcacactttctcccctcaacctggaatgctctttccctagatatccacattattcgttctcttatttcacttargtttttgctctaacatcccctcatcagagagaacatgcctgactcccatgaagataatacttcgttactctctattcttttatcctgttgtatttttcctttgtagcatttaacgccaactaaaataaattaaacacttgtttgctgaatggggtaatgaaaatcattttagcagctttctctgttcaaatcttctcaattcaacctgccaaattttgcatcttaacatggtgaaaccccatctctactaaaaacacaaaaattagccaggcatggtggtgggcacctgtaatcccagctacttgggaggctgaggcaggagaatcgcttgaacctgggaggcggaggttgcagtgagccgagatggcgccattgcactccagcctgggcaacaggagtgaaactccgtctcaaaaacaaaacaaaacaaaacaaaaacgccaatttgatcatgtcagaggtttcaaaagacctactctttcttaaggcaaagaccataatctaacttttacttgccagctctgatcacacattcttgaccgcttagactggtcacctttgtgttcttaaagtcccacttatccaaggaagctgcttctgtttgtttgctactatttctcagatgttcttctatggaatgtatcatctcacactgtgtaaattacacctgatcacaccttctcatattgggagttcccatggtttttatccctttcatcgcaactgtgcatttcgtggagaccatttgaactggaaaacttaaaggattctttggagttttagtgtcagtgatactcattcttgagaatttttttttctcctgtggagttttgagttttcagagactgtcactggttcttccttgagccacttttgtttggaacaggagcaatcacmaatgcttctctctacaaagagatgaaaatattccatctgcctgacatcctaactactagctggaggtgggttgaaattggtttttggagagagggctgacagtgagagcttagttaatgtttcatttttgtttttaatctcctctcagataatgccatgtacctcctggtggtgaaccatccagatgccaagtccacagtggagttgtttaaatttcaagaagaagaaaaatcgcttttgcatctaaaaaccatcagacataaacttctgcctaagtactgagatatatcacatttctattttcctttagctgtagcggatagttaatccacttttagtttttccttttggccagagtaggtatggctgttcaactctcatttctaatgatcacaaactcctccacatgctcttctgaagaaccttctgaggactcaagmccctcagagayggcccattcttttcctctcttgtttctcgagctgattggatgctggctcctggcctcaggatctccattcaagttattaccaggaaaaaaatcctcttcttcagaaccagacttagtatttcaaacccaaaccggcttcatagataaatttgacatcatgagcttatttatttatattaaaaagtagactcttagatgtttccatgaattagaaacacagacccaagaggagaccctgaatcaagtgcatctaagacctccttatactgcctccgctgctgtttgattgcacaaaatttatgcaatagcagatctgtggtaacactcarttccccctaggcaccttgttcatgtaacatatggtgaaataaaacactcaagaatctccaatctcagtcaacttcctcacatgccctgtgaagatttggcttgtaaggccagtgatggatttaggagaacaatccgacwctatcttctgaaacatttacctccaactgattacgattttctagaatcccaacctatttttatataatttatgtacagcatttgactacctccatatctgtaaatctagatttgtactctttgcaggtacctagctaagggcctggtatgtagtgtgcactctgtgttaccaggaccccttcctcttctttcttatctggtggtttgaggatgaggaaaatgagattggagagaaattgagttactggatgaaggccaatcaactcactagtggccaagtaggaaccccagctcaggtcatcttctgccccatcaagatgartaaaagttcagagaacagcttttggtggaagagtttattcgtgcatttatttaacaaatatattttggagagagaataaggtcactgagtggagaatgtgaggaacaccaagatttaaagtagagaacagtatgtagaatggagaagctgggcaaatgataacactaataaatgagctttctctgtaagtcaggtgctacactaactaattcaaacagattattttattgatgttttacaaataccttctgaattaggtgttattattatatccattttggatttttaaaaagttgaggcctggactaattgttaagtttccccagatgacatcatcagtaaatggtgcagctgtgattctaatcctggtaacatgagttcagagctggtgctttaaacctctacaaaatagtgaaaaaaattatgtgttttaacatttaatcttggaaatctcagattggtctacgttaccggattggagtatttttttcttgagccagttgcaaaaatattggtcttaggcagcattggagactgaaaataaccacggtgccgtaattaactagagttctgctctctcaatccaaggattagctgtgtgtattttcttctttgtattttatggttttttataacattaatattccaataactaaatctattataatttaaacttgttattattcatatatcacaactgttattattggtcatttactgtatgccaggcatggtgtgaaggcctttgcattcattatttcattktattcttactctagcctttcaaggtatacagagaaaacagaggttcagaatagtggctcaaaatttagtgacaatgctgtggccccacattataaggatagcaagcagtgtcaggatgcaaatgaagtccatcagatttcaaagctattactctattaccctttaaaaatttgttatttatttacttattttactacacctgggggtagtaaattttcagcaataaaaagctattgctctaaaccrttccactctgcccctttctgtgaaaaacagacaaatgatagtccagcatactaatttaagaaatttacttttaaaaaagagagagtaaaatcagattgtagatttatgtctggagcccatccagactaatcctaaattccgagacctttttttttttttcatgttgtaatagtggctagcattgattgagggtttattgaatgtcatgctccctgcaaagcacacaacaggcattgtctcattgtaattcccactgcaactccacaaattaagatcctgacccttagttttctactaatgagctgtatgattttgagaatatcatttaacctctctttacagatgagaaaactgaggctctgcatgcctgtctaacttgcctgagagctcaragctgcgtcagagctgatgcgctggccatgacgcctctgcaatagagcagagataattttctcccagatcatgccctggggaacttccatcacctcaatcagcaaagaatgactcacttatgtgttccctattgtayccattaaagcagaaaaatagactcatatatcttacattttcagtaacagagaatcctaatcagaaaggaaaaaaaaaaagycatagcattctatttctgagcattcttgttcatggacatttcattcagtttagaatcacgaaatcttaaggctggaagatcaaccagtctatcatcctgctttcacagataagaaaactgaggtcctgacatgtgaaaagattgatttttcttagatcacacagctaatagtagcagagcttaaactaaaatgcaagtatccaggctgctggttcagcattttttcaatttcttatgggagttagttctatgtgagcccagatatgtgagcacatttttgccctgacaatgatttctggcttaatttaatttctactgaatttagtgtatttacacacagacacacacagatacmcacacacacacacacacacacacacacacacacgacgtaacactattttaagatacatataataggatttttatgttacagtgctataatcacctcctcagatttcttagaccaatgattgtctttaaggattgtatcggcaggactaatttcatattaattgtgttccattatagctagcacgaaggctccatcccayatcttgattttaggaatagacagtgaggaatgccagttaataatcctgtaatgttcaataccttcaccttatatattatgtgtgtatgttttaattgcagtttgaatgatattgttgctgtgggacctgagcacttttatggcacaaatgatcactattttcttgacccctacttacratcctgggagatgtatttgggtttagcgtggtcgtatgttgtctactatagtccaagtgaagttcgagtggtggcagaaggatttgattttgctaatggaatcaacatttcacccgatggcaagtatgtgaactctctgaaatgtagtggatttactcagattctcaggagatatcttggaatatattctttttttaagtaatatgatacattttaacatgttaccctagtgagataaaattaggaaaaatgtaaaatgtcttaatttttcagggggtgaaatttatcaaatcaaaaatttcattgtgaaggcatactggttttatttcctttttggaaagaaagtacattttaagagggggaactgtgatgaagatttgatatgtctgaatagctttgttttgagtaaagatgtgagtgtataatgagttgaatagtatgcaggtatagatacgtcagtagtgcaggtttatgacaagatgaggaatttgtaccaaaatgtaaatcaaggcaatacttccttcatcaagaaagtattactgtgaaaaacaagtcagtttaactaagcagtgtgcttagtgatgtatttgatttataatgttatctcatggtgagctataacaaacaatttgcaaaccaacattggtctggagactgcattttgggtagcattggtatatacatgaaatatctatatccatccacatatatgccctttctcatcttgtgtcatcatcaaggattttagagtccgtaacatatgcttagagaaagcaacaggggccaggtgtggtggttcatgcctgtaatcctagcacttcgggaggccaaggtgggtggatcacctgaggtcatagaccagcctggccatcatggcgaaaccccatctctactaaaaatacaaaaattagccaggcgtggtggcgcactcctgtaatcccagctaccagggaggccaggcaggagaattgcttgaacctgggaggtggaggttgcagtgagctgagattgcaccactgcactccagcgtgggtgacagagcaagactctgtttttttttaaaaaaaaaaaaaagaaagaaagaaagaaaagaaaaagcaagcaagcaagcaagtgagagcaacagggacagggacagcttttaattattcatatcatagaccagttttcaaaaaatagaagataattgagcagtaatttcttttttttgttggggggatgcacagtgcttagactaaccccagatctttgtggggtatgactaaagccacagggtcaggaccacactcagggcagaagaggaggaagacttctctygatccaagccaagcagcttttcttctctcatattttctctggattaaaacaaggggctgttgtccaagggctttcctgcaactttcccgagagagaactcactagcccctgaaatgcagaacctgggccttgacactaaattgtcaaaccaaaagagaaacgctgtaatgcattttactcccagatactaaaagttagtgttagggctaagttcctcccatacygataaggacaactatgtcccctccttcagaaacaacttttcagagattaaacccctctgtcactgtaaactcactgagttctttcagaatttggtgtgtttgaggtgggttccattttccattccttaagcaaagttcttccctatgaataggtattacaacttcatcttaatctctcaagttgtgttacttctagtactttgatgtagctctttcttctttgaaggtatgtctatatagctgagttgctggctcataagattcatgtgtatgaaaagcatgctaattggactttaactccattgaaggtaagacgtattaacactgtaagtctgcagagtgataattagattctaattgatttgtgaaattaaatgtgaagaaaaaaggactgcttaattggggtgggtgagaaccaatttttcactcctttattaagagtcattagcttggttatgtgtttgttgttcatttttactcaactgcagagtggcaaacagcaaaccccacctcttacccgtgaaccttgcattctttctgctctagcaaattttaagcttggcattgtgttcccagatcctccttccatccctcccttcctgcctttcttctgatctccctctcctccaccttccttccctctcctcccttttctttctcttttttcctctatgttgatggaacagccaagaaatagcctcaaattgtactttatgcagggctgctctccacaatgtttatgaagtccacgtgctcacgatggctgctaggtgacctggctgcccctcacctctctgcctttacctccaaccattgtgtccctgccccacgtctcctgccactgtctcagaacggggcaccattccctctgctaggaggagaaaccttcctccagatctccatgaccccctccttcatctcctttcatttttactaaaacgtcacctcgatcttcaaaacctggaactgctccctcccgctacgtattttccctcgcctttcctgctttatttttccattcagcacgtattgctaacatactatatattttattcataccctttattacctgattccccaactagggtgtaagctccacaaggacaggctgtttttctatttgcttctggtacaattcacattgactagttggcacttaacaaatacttgttaaattactgcggtggggctgggcatgcttcagggattcacctgctgcccccaccaattctggtcatctgaaggttggagtcaaaatgggtgaaaacacaaaggagaggaaaaagagaccaagagcaaactagagccctaagaaagcagccctctacctccgaaaaacagcaagacgttgctttcctgccataaacgcccactgcaggaagcactgtcagcgccaattgtatgactgttcctgtcagcacatctgagagactgtcatgaggggcctcaytcagagaaaattaccttaaagcaacatcaaatgtaacatcgtgtttgacattaaaaatcactggcagggctagtttggtattagctcaagtaaaatggaatttcacacgctcatactggctaagggaataaaaaacaagctgcggttttaacaacaggtatttctgtaaaacaaaagttaaagaattttatgagaatagaacccaatgtaacagacattcaccacagaatgtcaaggctctgctctcaccagggygagactgagggcaaggccagtttcagcaacagaccaggcctgtctcccatcatgaaaaccccaaaaaggttctccatcaattgtcacattattctttcttttgaaagaccgtattaattaatatcagttaattaatgcccgagagtgccaagtaatttgataaactagctgaggctattcttaaatttgtgatgaggtgtggatgggtttatgtccaattggatattgttcagccttaaaaaggaatgaagttcttggccgggtgcggtggctcacacctgtaatcccagcactgtgggaggctgaggtgggtggatcacgaggtcaagagttcaagaccagcctggccaatatggtgaaaccccgyctctactaaaggtacaaaaaattagccagacatggtggcacatgcctataatcccagctacctgggagactgaggcaggagaatcacttgaacctgggaggcggaggttgcagtgagctgagatcacaccattgtactccagtctgggcaacaagagcaaaacgccatctaaaaaaaaaaaaaaaaaaaaaaaggaatgaagttctgatacctgctacaacatggataagccttgaaaaacatgatgctaaatgacataagccagcaacaaaaggataaatattgtacgatttactaataggaagtacctagaacaggcaaattcatggagacagaaaatagaatagaatggtgattgctaggaacttgggggagagaagaatagggagctattgtttaatgggtacaggatttctatttggggctgattaaaagttctggagagggatggtgatgatggttgcacaacattgtgaatatacttaatgccactgagttttacacttaaaaatggttaaaatgtcaaatttttatatattttaccacgatagaaataattctctcctctctccaaaaaaagattccaggacttagtcaatgaattagtcacacttcaatgaacctcaatgcgcaaaaacctggagtatttgttaacagagaatactctgtttttcccaaagagaataatttattatgttttcttgaccaaggaatgcgaatttttcgagttgcctttgtgggagtgtgagatgtgatacgcaggggtcttgcatgagttagcatggagaggaattatttatttgcaaggcaaagagttcattgctggactcagaacaggctccctgctagactgtcagcacttccatggcatgagctgtgtctgctgggtacctggtgctctccaggtgttgcgttccttgcagagctcrtgtaggagctcagtaattgtgtcttgaatgaatgggaccccaggtttctgtgtccttctcccactcccactctcatctcaggtttcatctgccgtggaattcaccaattggctgtactgcttccaaagataagagcaaagccctgaaacaaacattttcctcattcaaagacattatggtatcagagtggtgtgctgacactgggatggacaggggtttagggatggagaaagcaagcatggagccgcctgtcttgcctgtctctggggtaagaaagactgatggctctgcatggtggcgagactgaggctctgccatgatgcttgagccctctaatccctccttgggcatgtgaggaacagctctcattttgagtaggaggcacagggaaacgttggttttctgcagctgtctgcttatgccctggctttttcaatgagtcatgaccagttatttacaggttctctgggcactgaggtatgctggcctctgaggtacatggtagatattatttctccaactgagaattagaggtaaacaaatagatgggatttctccccagtagaaggcagccaagatgatgaatggtggaattaagaatcattggtattatttatgatccttgtacaaagcctcgacagcaatctgtgcagtcatcaaatgcttgcaacttatatttagagaataaacagcagaagaacggggagttgaacaacatcaggaaactaaagaacaaacttttcctcaactacaaggcaaaaatgagaccctgggtgatcatttcttctctggctgcacagcctatgattagccattaaagagtccacatttcattgatattcttctgagaaagaatctacatttcctggttgttttctgaatgcttataaaaatatcattaccacatgccattttagaaggagatgttttatgatgcaccgaaaacttcttttttttttcagttttaggttcatgcacagatgttggtacaaatgattttgtctaacttttaacagtctttcttggctttctgtatcttcaccctacccaattctgccctggaaactgacaaaatactagcatagatgaaaggtcagagaaattttgtgagtcttattgaaatggggcagaattgtatccttggaagcagcagcgtggtgaccaaggacaagaggcaacttttctctgatayattttgctccatcacaattgtgttttactttatgtcttgttcttttcttgtttttaatcttttaagtcccttgactttaataccctcgtggataacatatctgtggatcctgagacaggagacctttgggttggatgccatcccaatggcatgaaaatcttcttctatgactcagagaatcctcctgcatcagaggtaagttttaaaaatgaaccagataagtgactttattcccagctactgttttttcagttgacaacataattctcaattcttggtttttttttttttttttttttttttttgkgacagagtatcgctctgtcgcccaggctggagtgcagtggcgcaatcttggctcactgcaagctccgcctcccgggttcacaccattctcctgcctcagcctcccaagtagttgggaccacaggcgcatgccaccatgcctggctaattttttgtattttttttttttttttagtagagacagggtttcatcctgttggccaggatggtcttgatctgctgaccttgtgatccacccgcctcggcctcccaaagtgccgggattacaggcgtgagccaccgtgcccggccaattctcaattctatgtgcaaataaaaggggggacatggatagatgatccaaatgatcagaaatgaaggcttttggaggtgctttagtcagagtctaggcaagaaacacatggcacacttaaattggataatttgaggggagtttaatcaacggactatacacaaaatgtgtggacacagtgtagggtaatcaacagagttataatgcagtaccccagggctagcaagggagggaggaaatgaataccagaagccagaacaggtagacggtggtgggtggagagggttgcctgacaggaacttggcctctggttaagggatcctcaaagaacataatgatgccatactgctatggtttaatcattcattacctgccttcctattcaactcccccttcctgtgtggcggtatacgcacaggtccatgcaatggaccagtcctggagcacactggccagcctctctagatcttcctgcaggtggcaagataaatagctggaattattctggcttagaagatctcatcttccaccttagttacagtactcaaaggtcccattttttgtccacggtctttattcagtgaactattttgggtacaagtaagaatttgcaacctacttcaatataggtatttgcacatttactgagttttcagtatctactaaggatacttattacttacatcatatatatgatatcatcttgacatatttgtctactgctgkgtattgttaaagctcagttttaagagtccatttcacctgcccaacaggaaaaaaaaaagtgttaaagcccgtatctcttgggttaaaaaaaaaagaaacaaatgtgtatttccatttacattatggctctcttaccttttatctctaggtttgcaggacaattgtgatcatgtttaatggcaaccctttgtgccttttgctagtttttagctattagggttgctgaatggtatgtttaatagaattgaagaaatgtatgctgtggagtgttcagtgctcagamctgagcagaatgttagattctaatttgttcttgcttgttagctcatttagtaaccttgggtcatttgctatagcatggacttggtttgttgttctggagaaaatacttcatttctaatgattgatctgcaaaggagtagcaaaaagtagtaacaattccttatccaatgcactgcccctagatgagtgatttagttttattaacaagaagcttagctaagccaaggtgtaccatcaactatttccctgtaactactacatgttaatgctatggcaacttcctaagacatctgtctttggtgccagctgtttttaagaggtcattttgaacgttcccacagacccttttatatccacgcagtggccttcaccgtctgccacatttgtgatgtagatatcctttcttcaagtcattatatattatcataaaggcttaataatagaaagctagagctgaaggggaatttagagataatctagtcccacccatttcattctacagatgagaaacaaatgtgagtggaagatccaagacatgacccaggtctcccacctcagtgtagtgcttttcatactaagttgaatcacacgctattgctattttttacagtcagaatgatcagatattggctatttcatatggttggcttaacatgatactacactgttattattgatacaatcacatttctcctcaattaagtgaaggaaactgaacttacaaaatcttatacatttagagacaggaggttaagttcagaacacatgagtatggkacacagatatggttttttgagggccacattttttttcttgtctgcattttaaaaaccaggaattaagtgtaaacatccagttagttccctggcttacctgaaaatacatgaaaacggaccttaattactgcatggcaacagtttggctattgctgagtgtattagtcaaggttccctagagggacagaactaataggatatatatatatgtaaagggggtttattaagtattaacttacctgatcacaagatcccacagtaggcggtctgcaagcctgaggagcaaggagagccagtctgagtctcaaaactgaagaatttggagtctgatgtttgagggcaggaagcatcagcaygggagaaagatgtaggctgggagggtaggccagtctctcctcttcatgtttttctgcctgctttatattcgctggcagctgattagattgtgcccacccagattaagggtgggtctgccttttgcagcccactgactcaaatgttaatctcctttggcaacacgctcacagacacccaggatcaatactttgcatccttcaatccaatcaagttgactctcagtattaacyatcatactgagtaacagcttcctccctccacatttactgaaatccccactgctccctaatgtcccacatccaggatgcgctgctcatttgcatttcctgcctcatccctgtaggtctagatactctccacctctgctaaagatcacttgagatcagtacccacctgttcccaaatgaagaaacaggtgtgttaagtgtaattttggaacaaaataggatttatctcattgtataagattatatggcttcttatggaggatgaccctattatgcataaggttgttttaagtgacttaacaaaaatattaacccaatgttatttcttccacaggtgcttcgaatccagaacattctaacagaagaacctaaagtgacacaggtttatgcagaaaatggcacagtgttgcaaggcagtacagttgcctctgtgtacaaagggaaactgctgattggcacagtgtttcacaaagctctttactgtgagctctaacagaccgatttgcacccatgccatagaaactgaggccattatttcaaccgcttgccatattccgaggacccagtgttcttagctgaacaatgaatgctgaccctaaatgtggacatcatgaagcatcaaagcactgtttaactgggagtgatatgatgtgtagggcttttttttgagaatacactatcaaatcagtcttggaatacttgaaaacctcatttaccataaaaatccttctcactaaaatggataaatcagttatgtcaattgtcagatattaaataacagtgtgtgaccccaaaagtacttaccctaaaacatgtgttgcctgraagcacatgtgtgtatcgctgccttgccatgtcttgttcagaagacacaggggagcagggttagctcacgtgtctttagaactccagtactcacccagggactccagttcacaggccagaaaacatatgcattatgaagttcccctctactccatgcacatagtaagtctgactatggcagtcagacttacttactcccattttcccttcgatatatgactttttctcagtaaatattaacctgaaytattccaactccccttgtactcttgctttttcaattctcctgttgcaatgacacataggaaaatcttaaaattcttgggagtgttgtcacacctgaaaattatgagtctctatgatcttggcacaaattgtacatttgagtgtctttgacttggttaaaggaagtttgttcacttcgatgaytggatacagaatgaatcccataattgacatgggcgaagctaaaagtgtccccaaagactacactgttgttgaggtggtggtagtgctggtgggtttttgtttaatatttaaacttcttgttgtggaggctgaaaagaaaaaaaataatagaaaggtaaacaaacaaataaatagaaaagatcaacaacccctttggctatctactgagacatgactaggaagaaaacatgactttatcattttgttatagaarctgatatataaaggttacacattttcatttatttgtttttctgatttgaaggtataaccttcatgatgaattacttcttcagggtgttaaggcagtgactttagaaacaaatttttttcttgtttttgttttgtttttgagaccgaatctcactctgttgcccaggctggagtgcagtggtgcgatcttggctcactgcaacttctacctccgaggttcaagagattcttgtgcctcagcctcccggatagctgggactacaggcacacaccaccatgcccggctaatttttgtatttttagtagagacggggtttcaccatgttggccagcctggtctcgaacacctgacctcaggtgatccacccgccttggccttccaaagtgctgggattacaggtgcgagccaccacacccagccagaaacgaagtttttctaaggcacttgttatgatgatagtctggcatttccgggaaaatgttttgccaataaattgagaaccaccaacagttgtttaagaatcactgacttgaagtaataaacaggaacattttgtttgggtcaaaaaaccactttattcacagcaagattggagttactcatgattccagtgacataatatcccgtgccctacatgggctcaatttttctgagatgctgctcacagcccaggatgctgggttctctgaaagactgtcttgaaattatcaatgagtgtgatgcttagggaacacccccaacatatttcattatttagaaagaaagaatttcctgagtagttaggctccctaacatcttcaataaaatgaccacattctgttctttcttgttcttgatgatagataagcaaattccactgaagaaacaaaagcctatccaatttgacacagcacatactcaagatcactcaaaaagggacatggcttggttagaaatttcataacatacattgtgaaaaagaggaaaacagcttaattcatgtattctgtgattcccagatctaaattttcgcactgacataggcttagtcacatataaattatagtttgcgtgtgtaagaatgaatgaaattaatagccctcacttatttttaaggctttagaaagaatattgtttaaaataaccccatactctacgatggtcctgattcttccttagcttgcccctcgctatgtgagactghctacttaatggatttgtcacagaggttttcctggctgagagatatcagagactttgatggtgaagcagcgacaggggaacaaaatgacgggcgaggaagcttcgagtgcaggctttgctcttttaactttatgcccagttccataattgtgctttcaaatgtaatttctagctgccaatttacactttaccacagttaagacttagtttcatttccatgaaaaatgtgcactttgctcytgattgacagatatatgctttgacaattgatacaggtttacccagtcaaggcttgttttagttgaaggtgaaaatggaagagggaaaaaaaattgcttcaacagacctcagtatttctttttattgcattcgttgtctaacaacaataatactcattggcaagaaatttatttacactaacaaattaaatttaatcacaggtattkttagattggtcagaaaacaaaagaccactgtgatattttgcttgaatgcctctgaaaaccaaagagtaaggaatgtcatttgaaactttttgaacaatctagagaagtacatattaaccaagcacaagagaacaattcagacgtggcactattgtctcttccatgcaaatgatcagacatcaaaatgtacaaattaaaagcttaggtaacatgctatccatacttatcagacttaaaattattttcaaacaattcgtgttctttactgatatacaaagaaagctgaaaagaaatcaacttcttacagtggaatagaatttattctcttttattttcagctgcccagttttgtcagtaaggtgtagcaggtgtacaagtggttgcaacaccattaaaaaatataaaagcagtagttatattaaataatgttgaagaaaacatatacatatatatttaaggaatttcactaagcactaactaaatttcatgttgttgggaggtgttatctggctggagtgcctcttaattctttttaaggtaatttaattatttcttgccaattgttctttcttgaatgaatgattacatccttaacagaaaacctgggtgtataaataatacagctgaaagaaacagaagtgtacaccttccaacaacatacactcccaaccacttgtgttgtttttggcaacaaccaaaatgccattgcttgcacaaaaagtaaataaatgatcatatgatggcaacattcatcataagagagccagtaggcagtgactgtaagcatcacagccaccaattatgtcattttagaattgtgagcaaattcacaagaacacacagtgcaatttttagctgcatacatttcttctgagctccaactcagcaatatgcaatcttgacatcaaagcattagccaaatatttgaggaaattttcttactaaaataccaagtatctgataaatcaattttaccaaaatatataaacatatagaaggataagtgcatttagtagaaatacttacaataaaaaaatctcttaaaatctatgagccattcaatgtatacacaacgmaagaagtggcaataaggctatgattacagctccaggtcctgactgacctcgccaagttccatacacaatatattttttaatgccatgtgattgcagtgtgtgtgcgtgtgtaaggtgggagtgatattcacacatatgtagttctgaacatctacacaaacggcatgcacattgttgagaagttatctgttctcttattgcatacatcttactcactgttgaatccctagcagttttggggttgggttagggtcaagcataggaaatcatcatatttctttccttctccactcttgaggatctggaatcaggtcacagactgtgctgggtccacacgcttacatatgtgaaccttcaagtaactaccattccctcaataggcccacatagacaccacggacaagcaaataaggaccctctgtctaccataaatagaacttgatgctttcactttccaggagaagctgattctgtcggctttctctttgcccctccaacttcttagttgggcctattctatgctgctacttcaagttactcaaatgtgttttgtctggtgttatttttttctccagtgttttggaccaagactagatttcctgagactttaaatacgcaagacaaatgcaaacaaaatctgccaacatacccaggctgcttttcaggagtgaatcactgaagtgcatttggatttcctataacactactttcttttgggaatgtacagccctcccccagctccccatcccccatcataatgtaaaccattctaagagaaaatatggatgttttggctgggggtggtggcacatgcctgtagtcccagctacttgggaagctgaagcaggaggaccacttgagcccaggagtttgaggctgcagtaagacatgatggcaccactgcagtccagtctgggtgacagatgacagaaaaaaaaaaaaaaaaaaaaaagaaaagaaaatatggacattttatttctggactttatccttaaatgcttagctttagaatagtgcacaggtacatccttaataaaaagtaaatttgaaaagacaggaaaggactgtgcttttctcttccattttaccttttcattctgagaccactaaggtctttgcattaagtaggtgacgtgaaccctagtggccactgcccaccaaaatgcccctcatctccagctctgtcaggagtacctttagttactcaaatggaaatatctcagtgtaatgatggggctacaacatatccaaagtatagatggttctctcagggctgctggggcagcttcctttagaatcctctagaacactattgttaaacactggatctcctcttgaagtttagtctgcataacctttaacacttaaacatgaatcagagtatctatataaatgcaaattttcatttcccttttataaaatgcaattttcaagcacatgctaattctggtgcacaatgaacccagacaaatttgtcttcagcacaaactctaacggccgaggtgctagatcaaaccacctgtgaccatttttgtagcttgggactgggatattttaagatttcaggctagtgatgattacagggtcacagatagtggcaaaggtaaatctggttcctcattttccctcttgccactttgtttccaacaacaatggagcaaaaggtgacagtcccattttgtgccagttgaaagctgagtttggctttagtacctatcatactgcaatcatgaactgctgtgggttaaaaaaagcttgtgatgttgagggtgtgaaatcaattgtcaatcccagctaaaggatgatagccacagaacagctttattgtcatgaaactaaagggggacttcatcaggagtgttagaatggatgaaatgaggtttcttccctaacttaacattctgcagaaaattcctgattcaggtaaaaaaagaatgagattagtattacataaactgtgagttacttgaagggagatggtcttaaacaaagtaatctgttataaaactaacatcctttaatgggaaaccctgacccagatacagctcatacaatgctttctgtctgcagcttggcctcctcaccacacattccctcccaacaaagcataacctataccccaaaacacttttggctattgttagaatcatactgagctctcctttagggaatcagttcatagcaaccagatattccctttttgttcattttctgataataaaaactgcagtttttaaggttgatgaaataacaattctgtgttaaattgtaaggacactgaaaaccactagcattaaagtaggaattgtgcaagacattggagccttgattaggtatcatgcactacagtcaataaaagaaataatrrgaaaacaaaatgtkcacaagatctgaggtctttcactttgctttcatacccttaatcagtttacatcttatgctttgtggggcaatcaaaccaaatgacttttacaatttcatccgttttaagtggtaatgttaaaataactcacttcggcctaaaattactataatttaacttaaaaaatcaaaatacttataatactaaatgattttaggaataagaatttgatttataacattgtcagttggacatttatctaaacattcaatatacaaagttataaagaaaaatacttctaagatatttaagaaaatgcaatataatagatcataaattaggtgcaaaaacaagacacttacagacatttccagtatatacatccattttcaaatattaccaaagtgtaaacataacttaagataatcatccttctatttctactcttgaatacagtgaaacttccagtgtgatccaggtcacttttttcccaaagataagcaaaaatggcaaaaatttacaatagcaagcactaatattaccagatttttactaatttagtgttttagtatttgaaaagttttgccaaattgtatcactcattaatagtggcttcttatttctcatgatgttaaaaaataacaaagcaccagacatctcaagacattaatagagtatccaatatggcagtttcattatcatacccctaatgaagacagacagaaaaacataatggtgactttgataactgtaaaacacaatgttacttcatgtcaacgtttctgaggattgaatgaagggtctgtacctaatgacaaaagagctgacgcataaccgacaatactctggcaatgaaaagaaaacaggccttgggggtaaaacagaattaaaaatgtccagtttagataatttctgaattcagattttcagataaaaaaaaatcacactgttattaaaatacaagatggggctacaagggagttcccttaatctgttacactcaaaagccttgccgaggctctaaatatggaatacttctagtggaagatacgagatgctgggaacagagcagagattcccataaagtaaaagaagtaaaatactgtccaagaattcatgtggcctcaagtcttattctgaaacttgtcctttggaaagtggataacctcatttttagagtcaacgcagca

SEQ ID NO: 17657 - DNA, 36805 bp, Homo sapiens
  misc_feature (1)...(36805): n = A,T,C or G, or insertion/deletion polymorphism (see Tables 1-2)
agctgaacaaaggcaactcatggctttattccttttaggaaacaaggcatcagtttatcaccagggcaacaggccatgcaaaagttcagacttggccgggcgcggtggatcacgaggtcaggagatcgagaccatcctggctaacacaatgaaaccctgtttctactaaaaaaatacaaaaaattagctgggcatggtggtgggcgcctgtagtcccagctactcgggaggctgaggcaggagaatggtgtgaacccgggaggcggagcttgcagtgagccgagatcatgccactgccctccagcctgggtgacagagcaagattccgtctcaaaaaaaaaaaaaaagttccgactttttagagatgaaagcccctttcacctgtttcacaggaaataaccgtttaagtccgggcatcttacaagactgctgtgttagaaactggatagagatcagggtgagatgaaggggctcttagcttaggtgcagaaccgaaggaggcaccgaaaagctcagtaatcgagatagaaaacatgttttcatatttgagatactggggaggccagggatgctactcaatatcccacagtacacagaacagccacctagtctcgctctgttgcccaggctggagtgcaatggcatgatctcagctcactgcaacctgtgtctcccatgttcaagcgattctcatgcctcagcctcccgagtagctgggattacaggcgcccaccaccacacctggctaattaaagacagggtatcaccatgttggccaggcttatcttgaactcctgacctcaggtgatccacccgtcttggcctcccaaagtgctgggattataggtgtgagccagtgcacccagccctttttgcttttttagagacgaggtcttactgtgttgccaaggctggagtgcagtgccatcacagctcactacaacctcgacctgtgattctcctgcctcagcctcctgagtatctgggactacaggtgcatgccaccacacttggctaattatttgtagaggtggcaacataacatttgctatgttgcccaggctggtctcaaactcctgggctcaagtgacccttccgccatggcctcccaaattgttgggattacaggcatgagccaccgtacctggccttagttttctttccgatgccacaccaaatggctagagggtgtgtttgggatgacctgagtctggtaggcaacttccagtggaccccacagtgcgaccacctccctttgagtgtgggggagatgtagcgactggcttctagcagtaggatagggcagaagtgacagtaggttagtcttgtggttaggttacaaaactgacctctgtgatggtagcgtccctcgtcagccctcttgtcttgccctctcgctggctggcggtgatggagccggctgccatggtgagcggccctgtggagaagccagggaggaatggagacaatctggagaaacagaatcacaccaacaaccacgtgcgtgagcttgctgtgtgctcttgcttgggagcaagttacaggttcagcccaagaggagcggaccactccagggtgtaaataccaggagggggaattggaagactaccctaagcatgccgaccggagactgtgtgtgtgtagtaggtatttcttactgggagatcacggaaaagcaagtttgagaaacactcccatcagatgggtgggccgaggataacctcaaagcctttggttctccgaataggtgcgtaggactcacccaggcactctttccttttttaaattgtggtaaaaactacataacagtggccaggcgtgatggtgcacgcctgtaatcccagctattagggaggctgaggcagaagaactgcttgaaccaagggggcaccgctcctggctgtaacatgttttcaatatcccccctcttcggtggcacaggggctggccccatatacatgtgcgatggcaactgacagggtccctgatacaccggagtgctccagaaacaccccattgcgtgggacggaggatgttaggtggccctcctagcgtttgagtttgataaatgagcaaaggaagtggtttttactagaaagccagctttcctttttttttttttttttttccagccagcaaaccccaaacaggaacctatggttggtgatggatgtgcgttcagaaagcagggagggagggggagtcagaggtgagggggtcatcagccatagctgtccgctgcatcaccccctcgctatctccaggaagcgttctgggcttttcctgttgtgcagtgtggaagtgctctatcttcattcatatcaaggaaagtcaaaggacaaactaaagccggcagcgtctttctggcttcctagtcaggctgttcggtagcggagtgtcaccctgatttccagccccgcagcacacacagtgagagcctgcctggcgtgattcagaggcaacgtatttcccaaggtggctgtgaaggaaccagggggataaacacagcccgtgaaccgcacgccagaggacaggtccggctgcctgccgcggagtcgtcacggcgtgtcgcgtctgagcgcttctccaaagcacccaagtggcacccggggtgacatttacatcatcttgagtacagttctctcaaggaaaaagcaagcccagcatcttctgccatggcaaccctggcttggagcctccataagagagaaggccctaagaataccattttcttgctctaagttgctcttacgggaaagaagtgataatattcttcctaaacgccatcattcgtgcatccttcccacctacatgtgtcaccggatcattctccgcctgggcggggccgtcctgtgcactgcagaatgctgagcagtgtccttggcttcgaccgaccacatgccaggagcaccccaatttctgccatcgggtgattgacttcactgttgcatttgattttttatgtatcttttaaaaggacccaatagggccaggcacagtggctcacacttgtaatcccagcactttgggaggctgaggtcggtggattgcttgagcccaggaggagttcaagaccagcctgggcaacatagtgaaaccccaactctacaaaaaacaaatgttttatttttatttattttagatggagtttcactcttgttgcccaggctggagtgcagtggcgcaatctcggctcattgcaacttctgcctcccgggttcaagcgattctcctgcctcagcctcctgagtatctgggattacaggcatgcgccaccacacccagctaattttgtatttttagtagagatggcgtttctccatgttggtcaggctggtctcaaactcccgacctcaggtgatctgcctgcctcggcctcccagagtgttgggattacaggcgtgagccaccacgcctagccgggtttatagttttataacccttatgacaaatctcatagtattctgcagggataagcatgaaaccacttgttcaataagtgcaaacaaaaacgccaacaattcttaagacatttctaatcttattttaccaataattttaaagccagcttatgtattaaagatttataactacttttattaacacgtttaaaattctatgcagcttaaagcatttataatggataaaactgccaatactgagtgcctgacataatatttgaaaggtggcaggcattcaaccatggtcactgaatgagagatgtagggaagatgatggcagggaggtttttagatatcaacaccctgatagttctcattttaaccacctgtaagtgcacatacaagtcaacggcactggccgggcgcggtggctcatgcctgtattcccagcactttgggaggccaaatcacaaggtcaggagatcgagaccatcctggctaacacggtgaaaccccgtctctactaaaaatacaaaaaatcaactaggcatggtggcacgcacctgtagtcccagctactcaggaggctgaggcaggagaatcgcttgaacccgggaggcggaggttgcggtgagccaagatcgcgccactgcactccagcctcggcgacagagtgagactccgtctcaaaaaaccaaaaaacaaaaaacagtcaatggcattaaatataaatacatttacagtgttgtgtaaccatcaccactatggatcccccagactttgtcatcatcttcaacctaagcgctccctattaaatagtaactccccacttttcccaggccttggcaaccaccattctaatccctgtctctatgaatttgactcctctcgatacctcagataagcggcacaatgcagtatttatctgtcaagtccggaatatttcctttagcataatgtcttcaaggtccatcacgttgtagcatgtatctgaatttattcttttataatattttttattttttggagacagaatctcgctctgtcacccaggctggagtgcagtggcgtgatctcggctcaccgcaacttccgcgtcccgggttcaagccattctcctgtctcagcctccggagtagctgggactacaggtgcctgccgccatgcccggctattttttttttgtattttttgggggttttactgtgttgcccaggctggtcttgaactgctgagctcaggcaatctgcctgcctcagcctcctaaagtactaggattacaggcatgggccaccacgcccggccttatttttatttttgagacagtctcactctgccgcccaggctggagtgcagtggtgcgatctcggcttaccgcaatctctgcctcccaggttcaagcgattctcatgcctccgtctcccaagtagctgggattacaggcacctgccaccatgcccggctaatttaacgcccagctaatttttgtatttttagtagagatggggtttcaccatgttaaccaggctggtctcggactcctgacctcaggtgatccgcccgcctcggcctcccaaagtgctgggattacaggcgtgagccactgtgcctggctgatttttattcttttagttaaggctggttgatattaccttgtgtgtatataccacatgttgtttatccattgttgttgatggacatgtgggtggtttcaccttttggctattgtgaataaagctgctatgaacactgtgtacaaatatgttagagaccctgttttcagttcttttaggtgtgtaccccgaagtggaattgctggattttatggcaatcccacgtttaacttctggaggagctgctggaactgttttccacagcaggggcgccatgttacgtccctgccagcaatgcacgcgcagtccaatttctctgcatactcaccaatatctgctattttccattaaaaaaaattatagccggtcgggtgcagtggctcatgcctgtaatcccagcactttgggagaccgaggcaggtggatcaactgaggtcaggagttcaagaccagcctggccaacacagtgaaaccccatctctactaaaaatacaaaaattagcctggtgtggtacatacctataatcccagccacttgggaggctgaggcaggagaatcgcttgaacctgggaggtggaggttgtagtgggccgagatggcgccactgcactccaacctgggcaaaaagaacgagactttgtctcaaaagaaaaaaaaaaaatacagccattccagaaggtgtgaagtcatatctcactgtggttttgatgcgtattttcctagtgacatcagggagtttatgggagcacgggaacacagaccaggccccagcaggcggacaaacggtgcaacgccaggctggccagaggagataagrgcggctccttggagcttgtgtgcaagtcactgtactgaggagcyggctacggctcgatgagtctcaattaggaaaggcyggggctggtggaggaagggaggamagcattcttcatcctcatcacatcctgagcctgtgccccaggctcccaccacttccctccctggycacagagctcaggacagggctgaggaaccatgtctccatccccgaccgccctcttctgtcttggtgagtcctgagggtcagatctgggaaatgctgaaggacaggcatggactgccagacaaaggatttttaagaawtttgcattggtgatgaatttcaggacaaaaaggaacctgtaagagccccttcatttgttgggtggggaaacggggggccagcgagctggcattttgcatgagttattccagtgtattcatggctgggtcaggaaatgaacagagtatcctagcattggtcacaactttgttctactamactgcagttgccccttttttaaaaaatgtgggccaggcacagtggctcacgcctgtaatctcaaccttgggaggccgaggtgggtggatcacctgaggtcaggagttcaagaccagcctggtcaacatggtgaaaccccatctctacaaaaattagccgggcgtgatggcgggtgcttstaatcccagctacgtgggaggctgaggtgggagaattgcttgaaactgggaggcagaagttgcagtgagctgaggtcaggcattgcactccagcctgggcaacagagagagcctccatctcaaaaaaaaaaaaaaaaaaaaaaaaaaaggctgagtgccatggcttacacactttgggaggccgaggcgggtgggccatctgaggtcgggagtttgagaccagcctgaccaacatggagaaaccccatctctactaaaaatacaaaattagccgggtgtggtggcacatgcctgtaatcccagctactctggaggctaaggcaggagaatcgcttgaacctgggaggtggaggttgcggtgagccaagatcacaccattgcactctggcctgggcaacaagagcgaaactccgtctcaaaaaaaaaaaaaaaattgtggaattgatatctggactaggtatggatttaatttgtcagtatcccctacagtagtggagtaaatagtctcctgatggatgggtggcaggtcgaatgcatttctgctgcctgatcttcacttgtgctgggcatgtcgaatgmattatttcctgatttcttcagaatttgaccactaaagggacagcatctccaaaaggctaagcaggaagaagatggttgcattactggagatgagagggttaactgtgaatataaacaacctctcattcattatccatccatggatgtattctttttttctttttgtttgttttttgagatggagtctcgctcagtcggtcgctcaggctggaatgcaatggcatgatctcagctcactgcaaactctgcctcccgggtccaagkgattctcctgcctcagcctcccgagtagttgggattacaggcatctgccaccaggtctggctaattattgtatttttagtaggggcggggtttcaccatgttggccaggctggtctcaagctccttacttcaggttccacccgcctcggcctcccaaagtgctgggattacaggcgtgagccaccgcacccagcctgttttaacttttatttatttaattttatttgagatagggcctcacttctgtcacccaggctggagggcagtggcatgatcatggctcactgcagcctcaacctcccaggctcaaccagtgcctccccatcagcctcctgagtatctggaactacagttgtacaccatcatgcctggcttgtttttgtaatttttttagttacgggggtccgctatgttgcccaggctggtcttgaactcctgggctcaagcgatccacccacctcggcctcccaaagtgttggggttacaggtgtggcctgtacaggttactgcatctggcttgttgcttcagtagcttttgggatacaagtggttcttggttacatggatgaattatattctggtgaattctgagattttagtgcacctgtcacctgactagtgtaccttgtacctaatgtgtagtttttcatccctgccccacttctgcccttcccttctgagtctctgaagtccattacatcactctgcatgcctttgcatacccacagcttagctctcacttataagtgagaatatacagatttttgttttccactcctgtattactttacttagaataatgccttccagctccatccaagttgctgcaaaagactttttttttttttttttaaagacggaatytcgctctctcaccaaggctggagtgcagtggtgtgatctcggcttactgcaaactccacctcccgggtttaagtgattctcctgcctcagcctcccgagtagctgggactacaggcacccgccaccatgcccggctaatttttgtatttttagtagagatggggtttcaccatgttgggcaggatggtcttgatctcttgacctcgtgatccacccacctcggcctcccagagtgctggcattacagatgtgagccactgtgcctggccaaaagacattatttcactccttttaatggctgagtagtattccacgctcatttatttttatttatttttattttttgacatggagtctcactctgttgcccagactggagcgcagtggcatgacgttggctcactgcaacctccacctcccaggttcaagcgattctcctgcctcagcctcccaagtagctgggattacaggctcctgccactacgccccgctaatttttgtatttttagtagagacagggtttcaccatgttggtcaggctgctctcgaactcctgacttcaggtgatccgcccaccttggcctcccaaaatgggattacaggtgtgagccagcgcgcccggccggtgagaacatttaaaatctactatcggtgatatgcaagtgtacaatatgttgttattaactacagtcaccatgatgtgcagtagatctccaagacatactcctcttgtccaactgaaactgtcctcctctgaccaacatctccccaaaccttaccccaccgccccggtaaccaccactgtgctctctactcctgtaagttcccaagtccacactctttaccactaattggtgctgctagggtttgaatctactcctgccagctgtaggactgtggataagatactgtctcactagcctgatgtataagaggggactgataatggtgggtaacccgtacgattatggcgacttggagtccatgcacagaaggcgctcagcacggcgcctggaagactcccagccatggtacagcgtcgcatggaaacctacaaagaggctgaggtgggctgtgatgcggcaggaggagggggacagagaagcggccggagcttgsgttggggtgcagagggagcctggggtggacaaagggtggtggctatgggggcgctggtgacaagttgtcactctctgagctcagagtcaagacatgakctgggttcacccacttcttgctatgtgagctacacaaggttgcttggcctctgcccagtttccttatgtttacagtgggaatgacaactatcccgcctttgtgtgtgtgtgtgtgtgtgtgtgtgtgtgtgtaagaatgagggttaccagataaaacactggatgcctggttaaattggaatttcagataattagtactttttttttcctcctcctcttcgttttctgagacagggtcttgctctgttgtcagtctggagtgcaatggggcaatatcatttttttttttcctcgagatggagtcttgctctgttgcccaggctggagtgtagtggcgtgatcttggctcactgcaacctccgcctcccgggttcaagtgattctcctgactcagcctccccagtagctaggattacaggcacgtgccaccatgcccagctaatttctggtatttttagtagagatggtgtttcaccatgttgaccaggctggtcttgaactcctgaccttgtgatccgcccaccctggcctcccaaagtgctgggattataggcatgagccaccgtgcccggccagtggtgcaatcttacctcacagcagacttgacctcctgggctcaagcaattccaggaggggatcgcttatgcacatgtatttgtatacatatgtatatatatacacacacacacatgcatacatatatacgtatacatacatatacacatatgtgtatgtacacacgtatatgtacatacacatgtatgtatagatgtaggtttacatatatgtactatatgtgtatatacatatagtaatcagatcagggtaagtagcacacccatcttctcaaacatgcatcctttctgtgttgggaactttccccatcctccttcaggctatttgaaacgattattatatatattacatcctatcatgtaatcatggaatactgattcaaccaaatgttgtaaataccgggaaacccatggccagcacatgctgagacgtcctgacttacacgctgaggctccatcctgctccatccttggagcccaatgcatcccattagtgtggggttttatcgcatatattacatagacaataaaatacaataatatacaatatgcaatagtatttacaatacttgtctacacaattgcatactattgtaatgtacttggatattatttaatattgggagactgaagggaggaaacgaaggaacagcaatgtctcaggtcccattcctcacatccactgaggaagtcaatgggcaatgtctaacacgaacgagcccaccgtgtctaacacaacacaaacgagtccacygtgtctaacacaacacgaacgagccgtgtctaacacaacacgaacaagcccaccgcgtctaacacgaacgagcccaccgcgtctaacacgaacgagcccaccgtgtctaacacaacacaaacgagtccaccgtgtctaacacaacacgaacgagtccaccgtgtctaacacaacacgaacgagtccaccgtgtctaacacaacacgaaggagyccaccgcgtctaacacgaacgaacccaccgtgtctaacacgaacgaacccaccgtgtctaacacgaacgagtccaccgtgtctaacacgaacgagtccaccgtgtctaacacaacacgaacgagtccaccgcgtctaacacgaacgagtccaccgtgtctaacacaacacgaacgagtccaccgcgtctaacacgaacgagcccaccgcgtctaacacgaacgagcccaccgcgtctaacacgaacgagcccaccgcgtctaacacgaacgagcccaccgcgtctaacaccaacgagcccaccgcgtctaacacgaacgaaccctccgcgtctaacacgaacgagcccaccgcgtctaacacgaacgagcccaccgcgtctaacacgaacgagccctccgtgtctaacacgaacgagccctccgtgtctaacacgaacgaacccaccgtgtctaacacgaacgaacccaccgtgtctaacacgaacgagtccaccgtgtctaacacgaacgagccctccgtgtctaacacgaacgaacccaccgcgtctaacacgaacgagtccaccgtgtctaacacgaacgagcccactgtgtctaacacgaacgagccctccgtgtctaacacgaacgaacccaccgcgtctaacacgaacgagtccaccgtgtctaacacgaacgagcccaccgtgtctaacacgaacaagtccacagatagcagtacgccaccatgccttgccctcctctcccaccacccccagccatggatctgctttcttctccatctcctatagatttacctattctggatatttcatgtaaatgacctcataaactatgtggctttttctgaccggtttctctcacttaaattacattcctgtgtgtcttttgaagaaatwattaggacagagtaaagcatatgcatgcaaaygtcttatcaccgcgcccagcaggcaggaatgtccataaaagcgagtcctggcatctggtccctttcttctttcctcagggctgtgtctggggcgtgtgccagcgcagagtggtgagtccttccccagaccccttccctcctgcgggatcyrccagcgcgggrgcagcggggtccaggcggggtctgcggggaggctgacccagccctgctcctcttccaggaccgctccccaagccctccctccaggctctgcccagctccctggtgcccctggagaagccagtgaccctccggtgccagggacctccgggcgtggacctgtaccgcctggagaagctgagttccagcaggtaccaggatcaggcagtcctcttcatcccggccatgaagagaagtctggctggacgctaccgctgctcctaccagaacggaagcctctggtccctgcccagcgaccagctggagctcgttgccacgggtaaaggaagggggatcrragcctgggactgcgtggtcctccgttcaggacacaaatacgggggacattgagggcagggattagggtgaggcaaacgaggcamtggcctagcgggtggtggtgccacgacatttatggatcaatgtgaataatattttgttttttggacacagggtcttgctgcgtcacccagggtggagagcagtggcgcgatcttggctcactgcagcctccacctccagggctcaagcgattctcccgcctcagccctccaagtagctaggattacaggtgtgcaccaccacgcccagctcattttttatgtttttatagagatggggtctcttgacagttttcacaaaaggcattaaaatacaaaagagagagagatagggtctcgctatgttgctcaggctggtctcgaactcctgtgggctcaagctatccttccaccttggcttcccaaagtgttgggatttcaggcgtgagccactgcatctggctgtgaataacattttcatgcaatttttwaaaaaatcaaaataaattgcaaaaacatccacaatgaaaaaaaccagaatttcaaataaaggcagaatcagccagtgcctgtgtcaagtcataccagagtctgtgccaaaaygaaaaacaggcamccctttatctgtgttttaatgcacttaaaaaaattagcgatggggtcttgctacactgcccaggcyggagtgcagtggctgttcataggagcagtcatagctcactgcagcctggagctccttgccttgagcaatcctcctgcctcagcctcatgagtagcagggactacrgtcaygggccaccgtgcttggctcgggattctttttaaaactttgttttggartaatttttagactgacagaaaagttccaaagataatattaatggaaatatttcacccaggatcccctcatgttaacatcttacatttgttacaaccaaaaaataaacgtagcactggtcccagtggtttacacctgtaatcccagcactttgggaggctgaggcgggaggattgcttgagctcaggagttcaagaccagcctgggcaacatagtgagacctcatctttaaacaaaattaaaaattagtggggcatggtggcatacacctatagtcccagctactcaggaggctgaggcaggaggatcgcttgagccagggaggccraggctgcagggagctgtgatcacgccactgcactccagcctgggtgacagagtgagaccctgtatcaaaaaacaaacaaaaaactaaccatagacacaactatrttatatcaagtaaactccaggctatttgaatttcaccagtctttccactaatatcctatttctgttcccagaccccgtccagggccccacagtgcatttagtatttatgtctccttagactcttgattggtgcaaatattctaatttcttttcttatttwtttwttttttttaagagaagaggttgggccgggcgcggcggctcacgcctgtaatcccagtactttgggaggctgaggtgggtggatcacttaaggtcaggagtttgagaccagcctggccaacatggtgaaaccccgtctctactaaaaaaaataataataattagctgggcgcggtggcgcactcctgtaatcccagctactccggaggctgaggcaggagaatcgcttaaacctgggaggcggtgagccgagattgcaccactgcagtccagcctgggcgacagagcaagactccrtcttgggaaaaaamaaaaaagagaagaggtcttactatgttgcccaggctttagtacactcgctgtattcacaggcatgatcatagctcactttagcctcaaatccctgggctcaagtggtcctccctagtagctgggactataggtgcacccagttagtgcacttttaaatggttattttctagaagtaggttttggaaatagcactgatgcgcttgcatccacaaaagcctagaatgtaaaattctaataaatctttcaggggaataaagtattcaaacagaataatgtgagttttaacgacctactcttcaaattttcaataattttttcaaataygttaattgtttgggaataattaaattttacatcccaggagagtgcctcactcacgccaccctaattcctggccagctgcactgtggtctattccgcgttataaatcctgcctccctcccctcttccctgcctcactcccctccacagcatcactggcctcctctctgctactagaatggaccagcctggctgcctcattacttctttcagggtcagactcaaatactctcttctcgctaagtatatcccccaccaccctagtcaaagtggccctcctcactatctggtatgtgaagtatacctttttttatcttggtggtggttgtctatttttaattcctggtcgggcacggtggctcacgcctgtaatgccagcactttgggaggccgaggtggacggatcacctgaggtcaggagttcgagatcagcctggctaacatggtgaaaccctgtctctactaaacatacaaaattaactgggcatggtggtgcatgcctgtagtcccagctactcgggaggctgaggcaggagaatcgcttgaacccaggaggtggaggttgcagtgagctgggatcatgccactgcactccagcctgggcaacagagtgagattctgtttcccaaaaaaaaaaaaaaaaaaaaaaaaaaaaaaaatatatatatatatatatatatatatatatatatatatatatatatatatatatatatatgccattgcactccagcctgggtgacagagcgagactccgtctcaaaacaaaacaaaacaaaacaaaacaaatgaaacaacaaaaaaagaatacagacagacacataatagttgcttaagtgaaaattaagagaaaatattgctgagtgaatgttacagttatcaggcagcttatatatttccttccttccttcctccctccctcccttccttcctctttctttctttttcttcttgttgagtgaatgccataattattaggcagcttatatttttatcttccttacttcctttcttttgctttctctctctgtctttttttgagacaaggtctcactctgtcacccaggctagtgtacagtgatcatagctcactgcagcctcgccttcctgggctcaagcgatcctcccaccttggcctcccaaagtgctgggatgaccggtgtgagccgccgcacccagcctcaacctttgtttttctgactcctgtgtgcaggcatgcatcaccacaccggtctatgacaacaacctcacatcagagtagtgtaggttcgtgtttaggagcggagaccctggaatcaaactctgtgagtgcagatttcaactctgccacttatgatcttggacaagttttttatttatttttaaattaaaatatgtccagctttgttgaggtataattgaaaaacaaaaatggaatatatccaaggtgtacaagttgatgttttgatatacgaatccactgtgagacagttactactagcaagctaattaacatacatcacctgacacagttaacttttttgtgtgtgagaayacttataatctaccctcttagcaaatttcagctrtacactgcagtattgttacctagagttggacaaattatttaatgccatgtgccttagtttcatttataaaatagggacattaagagtgaggactccataggtctctgaggattcactgaactgatayacatcataagtttggaaggcacccggaagctagcactgtcagccacatttacaacgtaacaattgtatgtggcaatacaagcttacagcacagtataagcttaagctatttacttactccagcgcttgctaggcaacaggcactctgcaaattactgtrtactgtctcattcagtcatccccattttaacagaacaaggcagtgaggctcagatacagagggagatttgtctccagggccaccaggcccctgaaggcagaactaggatttgcacccaagcactaggacgtgagcacagcctccttcctcaaccactgggtgactcgacctctctgtgagcttgggtgggggagtgcgctctctgggagggatacagccaaaaagctccccagctcttaggcaggtgtggggacctccccagtctcagctgagatgctggctcctgccttcaacatcagactttctttttctcccaggagtttttgccaaaccctcgctctcagcccagcccggcccggcggtgtcgtcaggaggggacgtaaccctacagtgtcagactcggtatggctttgaccaatttgctctgtacaaggaaggggaccctgcgccctacaagaatcccgagagatggtacmgggctagtttncccatcatcacrgtgaccgccgcccacagcggaacctaccgatgctacagcttctccagcagggacccatacctgtggtcrgcccccagcgaccccctggagcttgtggtcacaggtaggggtagtgcagaccaaacctttcttcctcagcctttataggtcctgatggccattccaagggaggggccataagtgggaaggaagtgggagggcaggaagccctgggctgcaggggcggggccgtaggtgggaaggaagtgggagggcaggaagccctgggctgcaggggcggggccgtaggtgggaaggaagtgggagggcaggaagccctgggctgcaggggcggggccgtaggtgggaaggaagtgggagggcaggaagccctgggctgcaggggcggggccgtaggtgggaaggaagtgggagggcaggaagccctgggctgcaggggcggggccgtaggtgggaaggaagtgggagggcaggaagccctgggctgcaggggcggggccgtaggtgggaaggaagtgggagggcaggaagccctgggctgcaggggcggggccgtaggtgggaargaagtgggagggcaggaagccctgggctgyaggggcgsmgccrtaggtgggaaggaagtgggagggcaggaagccctgggctgcaggggcggggccgtaggtgggaaggaagtgggagggcaggaagccctgggctgcaggggcggggccagaggtgggaaggaagtgggagggcaggaagccctgggctacaggcagctgggagaatggaggtttcttttttttttttttgacgaagtctcactctgtcacccaggctggagtgcagtggcgcgatctcagctcactgcaacttccgccttccgggttcaagcgattctgctgcctcagcctctcgagtagctggaattacaggtgcctgccacgatgcctggccaatttttgtatttttagtagagacggggtttcactatgttggtcaggctggtcttgaactgacctcatgatctgcccgcctcggcctcccaaagtgctgggattacaggcgtgagccaccgcgtcggacttgactaccattcttaaagggggtttctttcaaaaragagcagcatacctcataatgtggttatatacatgcaatggaatattatgcagccttaaaaaagaaggaaattctgacacatactacaacatggatataccttgaggacattatgctaagtcagtcagtcacaaaaggacaactactgtatgattctastcaaaggaggtatctaatgtcaacactgtagaaacacaaagtacaatggtggttgttaagggccagaaagaggagagagaaggaattagtgtttaatgggcacagaatttcagttttgcaagaaaaataagttctagaggtcaacatattgtaccacaatgtgaacatacccaacgccactgatcagtacatttaacaatgtcatattaaatcaaacaaaatacatcatttagtttttggtagaaaaatctgttttgcccccagggtcacagtgaggggtaggacacaggaatccagaagaaatagaactgaggttgaaaaaggyggacgggagctgcatgcatttccttgttaatagcccagaatgtgccaggtgtgctttacaaatgctgctgcttttttttttttttttttkkrgrgagtctcactttgtcacccaggctggagtgcagtggagtgatctcagttcactgcaacctccacctcctgggtttaagcgattctcctgcctcagcctcctgagtagatgggattacaggcacctgccatcatgcccagctaatttttgtatttttcgtagagacagggtttcaccatgttggccaggctggtcttgaactcttgacctcaggtgatctgcctgcctcggcctctcaaagtgctgggattacaggtgtgagccaccacgccyggctaagcctktttttttcagatggagtcttactgcgtcacccaggctggagtgcagtggtgcgatctcagatcactgcaacctctgcctcctaggttcaagtgattctcctgcctcagcctcccgagcagctgggattacaggtgcacaccaccacgcctggctaatttttgtatttttagtggagacggggtttcaccatactggycaggctgggcttgaactcctgacctcaagtgatctgccctcctcagcctcccaaagtgctgggattacaggcatgaggcactgcacccagctcaaatgcttattaacatccacaacagtccagtgatgtaagctactttaggctcatttttccggtgaggaaactcagtcacggagatgtttcgttatttgttcaggacccacagcgacagagcacagatttatctcattttctgatttcccaggaacctctgtgacccccagccggttaccaacagaaccaccttccycggtagcaggtaggttctgcagggtccattctggtgcacagcgtatgaggtacacggaccccttctctctctcctctctgcctagacttctcgatttaattcagttggttctttcacagatttgctttgttttaaaaatcctttatttctgcctgtaaacagggtgggtgtcctaagtagttagatgttaagatgctgcccccaatcctactctaggtggatggtttatcacatataacatgcagaagaataatcggagtggcttgctatactgtggagtccagctggttgaatatgggtgacaaaaacaaacaaactaaccaaccaaccaaccaaccaaccaaccaacaaacctgtagagtccgggactctgtttctgagtcactgawtgcattgatcagcggttctcaaacttccatgagcataagaatcacctggaggcttaaagaatagatttctgagcccccagggcttctgcttcagtaggtctggggtgaatccagtcattttcattcctagtaagttcccaggtgatgctgatgctatggctccagaatgctgctttgagaaccactgcggtaagttttgtgtgaggcgtgttatcccctccactttcacaaacrtctcagctgaatacggtgtaccagactacggcctgcactttaagaatatcatacgctaggctggaggctgggcgtgtctaacattccctgygtctcagagtgaagcaccaaggcaggagaaacatgctggaaagagccgaggttgataaggatgagatttgcggggttgagggcagagtgagggctattatgcctagtgggcagggacatggaagatggtcacatactgtgtgcgtgcatrtgygtgtgtgcgtgcatgtgcgtgtgtgcgtgcatatgtgtgtgtgcgtgcatatgtgtgtgcatgcgtgcatatgtgtgtgtgtgcatgcgtgcatatgtgtgcgtgtgcttctgactgaatttttgaactttctcttttgaaatggttctagagtcacaggaagtctacaatgatagaacagaagaatcccatgtgctctttttccagtttcctctaatggttacatcttacgtaattagagtacaacataaaaaccaggaatttgacattggcataaagtaggtgtctagttctatgccaatttgtcacagttgtagattcgcgtcaccatcaccgcagtcactgtacagaactcttccgtctcacaagggcctcccttgggctacccttttatattcacacctacacccttctccttcccttgccatccctaactcctggtatccattaatttgttctccatctctataatcttccatttctagaatctgatgtaaatgggatcatccagtatgcaaccgtttgagatatccttttgtcactcagtgcaatgcccctgaggcccatccaagctgctgtatgtatcaatgatgtgttccttttgattgctgagcartatttcatgctatattaggccgattttgtgctgctataaatayctgagactggatcattgataagaaaagaggtttaattggttcatggttctgaaggccgtataggaagcagaaggctggcttctgcttttggggaggcctcaggaagcttacagtcatggcagaaggcaaagagggggtagctgtctcatgtggtgggagcaggagcaagagagagagagagttgggactgggggacatgccacactttgcaatagccagatcttgtgagaattcacttactattgcaaggaaagcaccaagcaatgagggatccacccctatgatccaaacacctcccaccaggcccccacctccaacattggggatcataatccagtatgagatttggtgggaacacatattcaaactgtatcacatggcatgcaaataccacacgctgtgttgaaatcaaaatcaaaacaaggtgtattaaatagggaatcctttccccattgcttgtttttgtcaggtttgttgaagatcagatggttgtagatgtgtggtcttatttctgagatctctattctgttccattggtctatgtgtctgtttttgtaccagtaccatgctgttttggttactatcaccttgtaatatagtctgaagtctgagcctgaggcctccagctttgttctttttgcttagtattgtcttggctatatgggcccttttttggttccatatgaattttatagttttttctaattgtgtgaggaatgtcaatgatagttcaatgggaatagcaatgaatctataaattactttgggcagtatggccattttcacgatattgattcatcctatccatgagcatggaatgtttttccatttgtttgtgtccgctctgattttcttgagcagtgaattgtagttctccttgaagatgtccttcactttccttgttagctgtattcctaggtattttattctctttgtagcaattgtgaatgggagttccttcatgatttggctctctgcctgtctattgttggtgtataggaatgcttgtgatttttgcacattgattttgtatcctgagactttgctgaagttgcttatcagcttaagaaacttttgggctgagatgatggggttttctagatataggatcatgtcatctgcaaacagagatagtttgatttcctctcttcctatttgagtatcctttatttctttctcttgcctgattatcctggccagaacttccaatactatgttgaatasgagtggtgaaagagggcatccttgtcttgtgctggttttcaagggaaatgcccatttagtatgaaattggctgtgggttaataaatggtgctgggagaattggctagccatatgcagaaaatagaaactggacccgttccttacaccttgtacaaaaattaactcaagatggatgaaagacttggatgcaaaacccgaaaactataaaaaccctagaagaaaatctaggtaataccattcaggacacaggcatgggcaaagatttcatgacaaaaacgtcaaaagcaattgtaacaaaagcaaaaactgacaaatgggatctaactaaactaaagagcttctgctcagcaaaagaaagtatcatcrsagtgaacagacaacctacagaatgggagaaaatgtttgcaatctatcaattcacaaaagtctaatatccagaatctacaaggaagttaaacaaatttacaagaaaaaaaaaaccattaaaaagtgggtaaaggacatgaacagtcacttctcaaaagaagacgtttatgcagccagtaaacatacaaaaaaaagctcaacatcaccaatcattagagaaatgcaaatcaaaaccacatttagacaccatctcacaccagtcaaaatggcgattattaaaaagtcaagaaacgccgggcgcggtggctcacgccggtaatcccagcactttgggaggccgaggcaggcggatcacaaggtcaggagatcgagaccatcctggctaacacggtgaaaccccgtctctattaaaaatacaaaaaattagccgggcgtggtggcgggcgcctgtagtcccagctattcgggaggctgaggcaggagaatggcgtgaacccgggaggcggaggttgcagtgagccaagattgtgccactgcactccagcctgggcgacagagcgagactccatctcaaaaaaaaaaaaaaaaaaaccaacaaaagtcaagaaacaacaagtgctggcgaggctgtggagaaataggaatgcttttacactgttgggaatgtaaattagttcattgtggaagacagtgtggtgattcctcaaagacccagaaccagaaatcctttttcctttttttttttttgagatgtagtattgctcaatagcccatgctggagtgcagtggtgcgatctcggctcactgcaacctccacctcccaggttcaagcaattatcctgtctcagcctcctaagtaactgggactacaggcgcctgccaccatgcctggcttttttttttttttttcttttagtagagatggggttttaccttgttggtcatgctggtctcaaacttctgacctcaggtgatccacctgcctcggcctcccaaagtgctgggattacaggcgtgagccaccgcaccagggccaccttttttttttttttttttttttaaacagagtctcactctgtcacccaggctggattgcaggggcatgatctcggctcactgcagcctctgcctccagggttcaagtgattctcctgcctcagcctcccgagtagctgggactgcaggtgcatgccacaacgcctggctaatttttggatttttgctagagacgggagtttcaccatgttggccagggtggtcttgagctcctgacctcaggtgatctgcccacctcggcctcccaaagtgctgggattacatgtgtgagccactgcgcctggccagaaataccatttgacccagcaatcccattactggttatatacccaaaggaatataaatcattgtattataaagatacatgcacacatatgttcattgcagcactattcacaatagcaaagacaaggaatcaacccaaatgcccatcaatgatagaaaggataaagcaaatacagtacatatacaccatggaatactatgcagccataaaaaggaatgagatcatgtcctttgcagggacatggatggagctggaaaacattatcctcagcaaactaacacaggaactgaaaaccaaacactgcatgttctcacttgtaagtggcagctgaacaatgagatcacatggacacagggaggggaacaccacacactggggcctgtagggggaattgggggagggagaggatcaggataaatagctgatgcgtgtggggcttaatacctaggtgatgggttgatgggtgcagcaaaccaccatggcacacgtttacctatgtaacaaacctgcacgtcctgcacatggattctggaactgaaattttaattgaaaaaaaaaaaggtttattaatgcatctcacacgaagagaaataacaaagaccaaataatacccacactctcattatgccaccgagagctgagcataaactagttttttccaagctggttccaccataaaaagactcccaggatagtacccactgcaacaagagcttcgtatttatcagctgaggcagttcaggaatattttggtggcctcaggaggcccctggttaagaaaatggcctggccgggcgcggtggctcacgcctgtattcccagcactttgggaggctgaggcgggtggatcacaaggtcaggagatcgagaccatcctggctaacacggtgaaaccccatctctactgaaaatacaaaaaaattagccaggcgtggtggcgggtgcctgtagtcccagctactcgggaggctgaggcaggataatggtgtgaacccgggaggcagagcttgcagtgagccgagattgcaccactgcactccagcctggacgacagagtaagactctgtctcaaaaaaaaaaaaaaaaagaaaaaaagaaaatggcctaagttggaaggtggagatcccgtgttctgaggctaacacgagctcattcttcctctaggctcacgaagacatggatccacatcttattattcaaactgagatataattcacataccataaaattcaccatgccaactaggatgactatgatttttaaaacaaaacaaacggacaagaagtattggtgaggatttggaagaaccttcttatattgctggtgggaatataaaatggtgcagctgctttgaaaaacagtctgtggccaggcgcagcctgtaatcccagcactttgagaggccaaggagggtggatcacgaggtcaggagatcgagaccatcctggccaacatggtgaaacccygcctctactaaagtacaaaaaaaaaagttggccaggcgtgatggcaggtgcctgtaatcccagctactcgggaggctgagggaggagaatcgcttgaacccaggaggtggaggttgcagtgagctgagatcgcgccactgcactccagcctgggcaacagaatgagactctgtctcaaaaaaaaaaaaaaaagaaaaaaaagaaagaagtctggtagttcttcaaaaagtaaaacacagagttactgtatgacccagtgattccaccacccctgggtgtgtacccaagagaacagaaaacttatgttcacacaaaaacctgtacgtcaatgttcacagcagcaatattcataacagcaaaacgtggaaaaaaaaccaagtgtctatcaattgctgaacggatctgcttcttactaagccggtcatggaagataagtcttacacctttcgaatttgtctgtcttcagtgtctgtgcagtgtgtcagagaaaggggtttcagggagcctagatatctcaaaaggggaatggagatatctagaggatatagggaaccacggggaagacctaacattgttttgctttcttagaattctcagaagccaccgctgaactgaccgtctcattcacaaacraagtcttcacaactggtgagtaaccaggcatttcatgctcagcagaaaggagtgtgaggacggagctctctcttccattatctaagcctgtaggctttyaaycacttcaccgaactgtccgtctcttaccaagaaagtccttggtgtgaggctagagcatgggtgcagagtggagctctggggttcagaaggaggagcrttttgggtgatggggccatttcaaagatggcggagccaaggctgtggcgggacgaccgccatccctacgcactgctcccaggatgaagtcctaggctttggactcggctgtgatccaggtatttaatctcgctcctcactgtgtccaggtagagcccatgctcggacgcacacagactgtaggcacctggacayagcacatcttctaaccgctccaggcctctgcagatacgctttcctcagtctctttccccttgcctgtcctggaaaatctccatttccttccagactaaacaccttcacagattccctgataataggttagatacttccactgggcccacatgactctggctttcatgaggcacctgatcccacgtagttctatttttattttttatttttttgaggtggagtcttgctctgtcgcccaggctggagtgcagtggtgcgatctcggctcactgtaacctctgctgcccgggttcaagcgattctcctgcctcagcctcccgagtagctgggattataggtgcatgccaccacacctggctaatttttgtattttagtagagacggggtttcagcatcttgggaaggctggtcttgaactcctgacctcatgatccacctgtctcggcctcccaaagtgctgggattggaggcatgagccaccgcgcccggcatatcccagggagttctgtgatggaagccttccctatcttcagttcggaacctcccaatcaccctcagsatgcagttccaattcctcagcttgctattctgtgagcttagatatccagcccctgttgatccctccaattttgtctgcataccttccacgcattcccatgctgttctcagccacacacagtcacttgaagctctcctggaggcttcctaacctctcctgactctgcacccaacccactcactctgccttttcttccatttccccatggcatcaattcctcaagaaagccttgaccgtccaggctggatcgatggtttcctctgctctcgctcagtgtcttgtgggctgcctattacagcaatttttacagtatattaaaattatcgctttgtctgtaatcccagcactttgggaggccaaggtgagtggatcacctgaggtcaggagaccagcctggccaacatgctgaaaccccgtctctactgaaaatacaaaaattagccgggcgtggtggtgggcacctgtaattccagctacttgggaggctgaggcaggagaatcgcttgaactcacgagttggaggttgcagtgacctgagatcacaccacagcactccagcctgggcaacagagtgagactccgtattaaaaaaaaaaaaaaatcgctttactttttggtctcctgcaatagtctgggaaccgcagatggacaatgtcttatggtttttttgttttttgttgttgtttttgagacggmgtctcactctsctcactctgtgatctgtgatttcggctcactctgcgatctcagctcactgcaatctccggctcctgagtagctgggactacaggtgtgtgccaccatgcccagctattttttgtatttttagtaaagacggggtttcaccatgttggccaggatggtctcgatctcttgacctcasgtgatccgcccaccttggcctcccaaagtgctgggattacaggcattcagccagtgtcatgcctggcctgacaatgtcttattaatatttgggttcccatggcccagcacatggctgagtacctggcgagtctcaggagatacttgaggaataagagagctggaggccgggtgcagtggctcacgcctgtaatcccagcactttgggaggcctaggcgggcggatcacaaggtcaggagttcaaaaccaacctggccaatatggtgaaatcccatctctactaaaaatacaaaacttagctgggcgtggtggcggacgcctgtagtcccagctactcgggaggctgaggcaggagaatcgcttgagcccaggaggcggaggttgaagtgagccgacatcgggccactgcactccagcctgggagacagagccagactctgtctcaaaaaaaaaaaaaaaaagctggcacgtatgaggtgctcatatgtcaagcacggtgctttatatttctaccattattattatcttgactttcacatcaacctataagggatcttgttaattttattggacacatggggaactggctcacagatgctgagtcacttgccagataactgacatctaataggtgatagagttggggttcaaatctggaggacagcctgactctacagttcttgcttttttttttttggacagggtctcgctctgtttcccaggctagagtgcagtggtacaatcctggctcactgcagcctcaacctcccagggctcaggtgatcttcctgcctcagcctccactgagtagctgggattactggcacgtgccaccacgcctggctaatttttgtatttttttgtagagatagggtttttctatgttgctcaggttggtcttgaactcctggactcaagccagcctcctrcctcagcctcccaaagtgctgggattataggcatgaggcaccrtgcccggcccatgcttttcttaaatgctgtggaattgtgcctcmccatgtgtgtgtgtgttcggagtaggcacagtgacagggggcgggaatatggtttcatttcacacttagcctttgtttggttcccagagacttctaggagtatcaccnccagtccaaaggagtcagactctccagctggtgagtaagtcatcctctccagacccccttccttctcacccgtctcttcaccaaagccaactcctttgtctacgcaggggctgcagctctcagatcttgggttccagtgtgtagagtaaaggcagaatatcagcgtatggggttcagaattgggcattaagatcaggtgggaaggttgagattttaaaaagggtcagagaaagagagattccatctctyccccascccttataactgtcctctcttttgcaatgcatcagataacgaggcagcatctgtgtctggggaggagttgtctcagagccctgtgagagcacaggagggagaggtgctacttagagaattggggtcatctggccctgacccctactcgggaagggagggaccctccaggaaagtgagcggcatcccctagctagtagagaataataggatctctgagaagcccagatgtggcttggagggggtcctggaggtgggctctttcacctgctcctgcctctcctcattcctccaggtcctgcccgccagtactacaccaagggcaacctggtccggatatgcctcggrgctgtgatcctaataatcctggcggggtttctggcagaggactggcacagccggaggaagcgcctgcggcacaggggcagggctgtgcagaggccgcttccgcccctsccgcccctcccgcwgacccggaaatcahacgggggtcaggatggaggccgacaggatgttcacagccgcgggttatgttcatgaccgctgaaccccaggcacggtcgtatccaagggagggatcatggcatgggaggcgactcaaagactggcgtgtgtggagcgtggaagcaggagggcagaggctacagctgtggaaacgaggccatgctgcctcctcctggtgttccatcagggagccgttcggccagtgtctgtctgtctgtctgcctctctgtctgagggcaccctccatttgggatggaaggaatctgtggagaccccatcctcctccctgcacactgtggatgacatggtaccctggctggaccacatactggcctctttcttcaacctctctaatatgggctccagacggatctctaaggttcccagctctcagggttgactctgttccatcctctgtgcaaaatcctccygtgcttccctttggccctctgtgctcttgtctggttttccccagaaactctcaccctcactccatctcccactgcggtctaacaaatctcctttcgtctctcagaacgggtcttgcaggcagtttgggtatgtcattcattttccttagtgtaaaactagcacgttgcccgcttcccttcacattagaaaacaagatcagcctgtgcaacatggtgaaacctcatctctaccaacaaaacaaaaaaacacaaaaattagccaggtgtggtggtgcatccctatactcccagcaactcrgggggctgaggtgggagaatggcttgagcctgggaggcagaggttgcagtgagctgagatcacaccactgcactctagctcgggtgaygaagcctgacyttgtctcaaaaaatacagggatgaatatgtcaattaccctgatttgatcatagcacgttgtatacatgtactgcaatattgctgtccaccccataaatatgtacaattatgtatacatttttaaaatcataaaaataagataatgcaccgtctccacccctctcatatttactttctgaaggaaatgttaggtcttctcaaggtaaagttctatatttattatagcgtttaggcatttcttgaccatctaatgagtgtaaaactgtaccactgggccaagtgcagtggatcatgtctgtaatcctagcactgtgggaggccaaggcaggaggatcgcttgagcccaggagttcaagaccagcctgggcaacatagtgagaccccatctctacttaaaataaagaagataaaaattgttttaaaaaaggaaaagaatggctggccacagtggctcatgcctgtaatcccggcactgtgggaggttgagggaggtgagtcacttgggaaaagacagaaggatggcaccaagaagttccaggacgacggctgtgaatcagggctagtgagcacacagcttgggtgaagggggaatgggaaagttgcttagagaagcctccaaatgtaagaatgggtcaattcctcgtcttaacatagtggaaaatcatactgagatgctatcagaagacagaggaaaaataattttagaggtcaagtaaactaagtagattttaaaaagaccagtatagcctaggcacagtggctcacacctgtaatcccagcactttgggaggctgaggcgggatcgcttgagcctaagagttcgagaccagcctgggcaacatggtgaaaccttgtctcatatacaaaaaatataaaaaattagctgggtgtggtaccacatgcctactctcaggtactcaggaggctgaggttggggatcacctgagcccggggaggttgaggctgcagtgagccatgattgcaccactgctstcaaacctgggtgacagagtgagaccctgcctcaaaagaaaataaaaataaaaaacaaatgtaaactttaggggaacaataacaacaacaaaaataaaagaagcaagttatattacccgaaaattctcggctgcgaatatctgtgggtataaacatgtgatactggccgggcgtggtggctcatgcctgtaatcccagcacttcgggaggctgaggtgggcagatcacgaggtcaggagatcgagaccagctcagccaacatggtgaaaccctgtctctactaaaaatacaaaaattagccagtcgtggtggcacacgcctgtagtcccagctactcaggagactgaggctgcagtgagctgagattgcgccactgcactccagcctgggtgacagagtgagactctgtctcaaaaaaaaaaaatgtgatactgaatgttgatatgcagacatagagataaacattggaagagaaaaaacagtaagaacaacgctgtagaataactaaggccccgcctattatgataggaatccagtaagtctaagctcattcacatggttacatgtttttagaaacctaatattaacaagttcctaaagaaaacagctaaaagtgggtgtctcttaggcggagcaatggaggagatggttagtcagccactgcattttgtacacacccttttagtgctattggaattttttaggtaggtgctgtcaggcctctgagcccaagctaagccatcatatcccctgtgacctgcacgtacacatccatatggctggttcctgccttaactgatgacattccaccacaaaagaagtgaaaatggcctgttactgccttaactgatgacattgtcttgtgaaattccttctcctggctcatcctggctcaaaagctcccctacagagcaccttgtgacccccactctgcccgccagagaacaaccccgctttgactgtaattttcctttacctacccaaatcctataaaacggccccaccccatcccccttcgctgactctcttgtcggactcagcccacctgcacccaggtgattaaaagctttattgctcacacaaagcctgtttggtggtctcttcacatggacgcacatgaaatttggtgccgtgacttggatcgggggacctcccttgggagatcaatcccctgtcttgctctttgctctgtgaaaaagatccacctacgacctcaggtcctcagacccaccagcccaaggaacatctcaccaagtttaaattgggtaagcgacctcttcttactctcttctccaacctctctcactgtccctcaaccactttctcctttccactcttcaatctctcccttctcttaatttcaattcctttcattttctagtagagacaaaggagacacgttttatctgtggacccaaaactccggcgccggtcacggactagggaaggcagccttcccttggcgtttaatcattgcagggacgcctctctgattatatacccacgtttcagaggtgtcagatcacgcagggacgcctgccttggtccttcacccttagtggcaagtcccacttttctggggaaggggcaagttccccaacccctcctctccatgtctctaccccttctccacctttctggggggcaagaaacccccaaccccttctccttcactcttagcggcaagtcccgcttttctagaggggcaagtaccccaacctcgtatctctgcaccctgatcccttatttccatgccccaacctcttatctctgcaccctgatcccttatttccatgccccaacctcttatctctgtgccccaaccccttatatccatgccccaacccctttcccgcttttctggaaggtaagaactcccgaaccccttccctccgtgtctctactctctcttttctctaggcttgcctccttcactatgggcaaccttccaccctccattcctcctcctctctcccttggcctgtgttctcaaaaacttaaaacctcttcaactcacacctgacctaaaacctaaatgccttattttcttctgcaatgccgcttgaccccaatacaaactggacagcagttccaaatagccagaaaacagcactttcaatttttccatcctgcaagatctaaataattcttgtcgtaaaatgggcaaacggtctgaggtgcctgacgtccaggcattcttttacacatcagtcccttcctagtctctgtgcccagtgcaactcgtcccaaatcttccttctttccctcctgcctgtcccctcagtctcaaccccaagcgtcgctgagtctttctaatcttccttttctacagacccgtctgacctctccctcctccccaggctgagctaggtcccaattcttcctcagcctccgctcctccaccgtattatctttttatcacctcccctccccacacctggtccagcttacagtttcgttcagtgactagccctcttccacctgcccagcaatttactcttagaaaggtggctggagctaaaggcatagtcaaggttaatgctcctttttctttatcccaaatcagatagtgtttaggctctttttcatcaaatataaaaatccagcccaattcatggctcgttcgccagcaaccctgagaagctttacagccctagacccttaaaagtcaaaaggccgtcttattcttaatacacattttattacccaatctgctcccgacattaaataaaactccaaaaattaaattccagccctcaaaccccacaacaggatttaattaacctcaccttcaaggtgtacaataatagaaaaaagttgcaattccttgcctccactgtgagacaaaccccagccacatctccagcacacaagaacttccaaacacctgaaccacggcggccaggcgttcctccagaacctcctcccccaggagcttgctacaagtgccagaaatctgaccaccgggccaaggaatgcctgcagcccaggattcctcctaagctgtgtcccatctgtgtaggaccccactggaaatcggactgttgaactcacctggcagccactcccagagcccctggaactctggcccaaggctctctgactccttctcagcttagcggctgaagactgatgctgcccgatcgcctcggaagctctgtagaccatcacggatgccgagcttcgggtaacactcacggtggaaggtaagtccgttgccttagtcaatacggaggctacccactccacattaccttcttttcaagggcctgtttctcttgcctccataactgttgtgggtattgacggccaggcttctaaacccctgaaaactcccccactctggtgccaacttggacaacactcttttatgcactcttttttagttatcctcacctgcccagttcccttattaggccgagatattttaaccaaattatctgcttccctgactattcctggactacagccgcatctcattgccacccttctcctcaacccaaagcctccttcgcgtcttcctctcctattcccccaccttaacccacaagtatgggacatctctactccttccctggcaaccgatcacatgcccattaccatcccattaaaacctaatcacccttaccctgctcaacgccagtatcccatcccacagcacgctttaaaaggattaaagcctgttatcactcgcctgctatagcatgggcttctaaaacctataaactctccttacaattcccccattttacctgtccaaaaaccggacaagtcttacagattagttcaggatctgcgccttatcaaccaaattgttttgcctatgcaccctgtggtgcccaacccctacactcttttgtcctcaataccttcctccacaactcactattcccatgcttgatcttaaagatgcttttttcactattcccctgcacccctcgtcccagcctctcttcgctttcacttggactgaccctgacacccattaggctcagcaaattacctgggctgtactgctgcaaggtttcacagacagcccccattactgcagtcaagcccaaagttcatcctcatctgttacctatcttggcataattctcataaaaacacacgtgctctccctgctgatcgtgtctgactgatctctcaagccccagcaccttctacaaaacaacaactcctttccttcctaggcatggttagcgcggtcagaactcttacacaagagccaggaccacaccctgtagcctttctgtccaaacaacttgaccttactgttttagcctagccctcatatctgcgtgctgtggctgccgctgctttaatacttttagaggccctcaaaatcacaaactatgctcaactcactctctacagctctcataatttccaaaatctattttcttactcacacctgatgcatatactttctgctccctggctccttcagctgtactcactctttgttaagtcccacaattaccattgttcctggcccggacttcaatctggcctcccacattattccagataccacacctgacccccatgactgcatctctctgatccacctgacgttcaccccatttccccacatttccttcttccctgtttctcaccctgatcacacttagtttattgatggcggttccaccaggcctaatcgccacacaccagcaaaggcaggctatgctatggtacaagccactagccagcctcttagaacctctcatttcctttccattgtggaaatctatcctcaaagaaatcacttctcagtgttgcatcagctattctactactcctcatggattattcaggccccctcccttccctacacatcaagctcaaggatttgcccccgcccaggactggcaaattagctttactcaacatgccccgagtaagataactaaaatacctcttagtctaggtagacactttcactgggtaagtacagtcctttcctacagggtctgagaaggccaccgcagtcatttcttcccttctgtcagacataattcttcagtttagccttgtcattcccttctgtcagacaaaattcctcagttcagccttcccacctctatacagtctgctaacagaccagcctttattagtcaaatcagccaagcattttttcaggctcttagtattcagtgacagactaatggtctattaaaaacacacctcaccaagctcagccaccaacttaaaaaggactggacaatacttttaccattttcgcttccagaattcaggcctgtccttggaatgctacaagatacagcccatttaagctcctgtgtagacactcctttttattaggccccagtctcattccagacaccagaccaacttagattgtgccccaaaaaacttgtcatccctactatcttctgtctagtcatactcctattcaccgttctc

SEQ ID NO: 17658 - DNA, 75729 bp, Homo sapiens
  misc_feature (1)...(75729): n = A,T,C or G, or insertion/deletion polymorphism (see Tables 1-2)
aggccagagaggttgagcaacttgtccatttcagcacttggttaaggagggatttgaacccggggctgaccttctgtctccagggccagtggcagcccgtcttctatggacacctcctgcccacgatcactgcctctgctcatgcccttacctccccacccatcccgttccaccttcctttggaaatttccctcaatgacccccctattctgacaaaagctaagatttagctcgataatgcctggcccagctccaaggacatcacaaaaatgaacaggctttccaggcataaacacctttctgaaatcacttttccagaactccctccatgctgtagaggttactagcaaagctttccacatcatttctccccagagccccgtgaggggagtgtgtctgggtgggaggctgtcttcgtctcacagatgagaaaatgaggaagagaagggttaagaaacttgcatgggtacagtggctcacatctctaatcccagcactttgggaggccgaggcaggcagatcacctgaggacaggagttcgagaccagcccagccaacatggtgaaaccccatctgtactaaaaacacaaaaattatccaggtgtggtggcgggtgcctgtaatcccagctactcaggaggctgaggcaggaaaatcacttgaacccgggaggcagaggttgcggcgagccgataattgcaccactgcactccagcctaggcaagagagcgaggctccatctcaaaaaacagaaaacaggccgggcgcagtggctcacacctgtaatcccagcactttgggaggccgaggcgggtggatcacgaggtcaggagatcgagaccatcctggctaacacggtgaaaccccgtctctactaaaaatacaaaaaattagccgggcgtggtggtgggcacctgtagtcccagctactcgggaggctgaggcaggagaatggcgtgaacctggaaggcggagcttgcagtgagccgagattgcgccattgcactccagcctgggcgacagagcgagactctgtctcaaaaaagaagaaaaaaaaaaagctgacatcttgcaaggccttaagggacgtgattctgatctcatctcttccttctgtgtgtcagcacactggcctccttgctgctcttggaacatccagacccggtcctgcctcagggcctttgcacttgctgtttcctctgcctggaatgctcttctaccagataccctcatgcctcactttcttgcctcctttggtctttgcctgaatgtcaccttctcagaggactggctgaccaccctgtttcaaatggcggcatcccttactcgacttcttttgttttttttgagacagagtttcactcttgttgcccaggctggagtgcagtggcgcaatcttggctcaccgcaacctccgcccccccaggttcaagtgattctcctgcctcagcctcctgagtagctgggactacaggcgcgcgccaccacgcccggctaattttgtacttttagtagagacagcatttcaccatgttggccaggatggtctcgatctcttgacctcgtgatctgcccgcctcggcctcccaaagtgctgggattatgggtgtgagccaccgcccccggcaacccaacttctttgtagtctctttcctctctccctacttcatttttgtgtggagaacttttcaccttcttacccactgtgttcctggttcattttgtctgtgtctcctccgttagaatgcaagcttcacaggctgggcacggtggcacatgcctgtaatcccagcactttgggaggctgaggcggattgatcacttgaggttgggagttcgagaccaacctggccaacatggtgaaagcacgtctctactgaaaatatgaaaattagccgggggtggtggtgtacacctgtaatcccagcttcttgggaggctgagacaagaaaattgcttgaaccccggaggtggaggttgcagtcagccgagatcacaccatgtcaccaacatgataaaaccccatttctactaaaaaaaaaaaaattagccagagttggtggtgcacacctgtaatcccagcttcttgggagaccaaggcaagagagtcacttgaacctgggaggtggaggttgcagtgaaccgagatgatcgtgccactgcactccagcctgggtgacagagcgagactccatcttaaaaaaaaaaaaagcggccgggtgtggtggctcacgcctgtaatcccagcactttgggaggccgaggcgtgtggatcacgaggtcaggagattgagaccatcctggctaacatggtgaaaccccgtctctactaaaaatacaaaacaattaaccaggcttggtggtgggtgcctgtagtcccacctactccggaggctgaggcaggagaatggcgtgaacccgggaggtggagattgcagtgagccaagattgctccactgcactccagcctgggtgacagagcaagactccatctcaaaaaaaaaaaaaaaaaaaatgcaagcttcacaagggcaaagatttttgtgtgatcagtcctccacttaatctgcagcacacagaattgggtctagcacatagaaagtgttggagagatacttgttgagtaaacgagcttttggcatttggtgcattcatgtgcattactgctttgttgcttcattcaagatatgttgcctccacggtctatgctgagtgagcctggaaatcagagaaggcacatttttgccttcgattgatggggatgaaggaacagagagaaagagatatagtgtggtctgatggcagagagcctcgggcaggtgtgggtctgaatcctggctttgccacttgataattttggagatacttattgtgtgcttatatcttctcagtacatcataaatgtgtgtgtgtgtgtgtgtgtgtgtgtatgcataatcctcaccacatcctatggaatgggtcctattatccccattttttttcttaattgagacaaggtctagttctgtggcccaggctagaatgcagtgtcataatcacagctcactgcagtctcgacctactggggtgatcctcccatctcagactatatataaatatatatacacatatatatagtagagtctccttatgttgcccaggctggtctccaactcctgggctcatgtgatactcctgccttatcctcccgaagtgctgggatgacaggcatgagccacccaccacacccagcttattgggaggataaagtcaggttatagagagttgtcaatacagtacctggcaaagaggaaacgcaaggctggtgttagcaatggcgaggacgatggcctttcttcccatgcgtgctgcaagggaggacacgaggggctctgccaaggccaggagaggctgctgagggtcaggacaggctgcctggaggaggaggacaggctgcctggaggaggagggcaggccaggaatcaccttgaaggatgagtttgacagccagtgtcaatcctagaagataggggtgttctgggccctgcaactgcctgagtgaaggatgggggctgcaggggtggccagcggggctagactgtgagctcctggctacccagcaggtggtcctggtgcgtgtagcagcgggtgggggaggtaggggtggaaggagggcccttacgcttctctttctttggcttctgcaattctgtgttctcatcacattcatgccacaagtattttctgtgcttgactgtacctgagttggggtttgagggaaggagcagaccccttgccccattgacaggagaaaacagaggctcagagagggaagtcagtagcctaaggttacagtggccctgggctgtgacacagatgcagatctgactgggcctgggctcatttcttcatgaacaaggggagaaaactatctcatagaagcatttggtatgggtccgaggcctttgggtctgagggaggaggggctggggtctggactcttgggtctgagggaggaggggctgggggcctggactcctgggtctgagggaggaggggctatctcattgctttgggggtggcgcaggcggccctccaggccatggtctggagcagcaggtgagaccgaaacccgagcctccacccaagtcccaagtcccagggcccagggcctctttcctccttctctggccgcaaaggaggcccctccctctctgtaacccacagcaaatgcctcccaaataccagtcaaagtgtccacccctgcacagtctgactcagccagtccagggcggaggcagtaaagccctgtcttggcaagtcaccagggaaatccatcaccgaagcacctctctcccccctcggcctggctattctgtcattggcacctgttcttgggtgagtgacagggctctgtggtcagggtttgcctctgtcccagtctgggatagctgtcttggggggctggcctttcttccctctcacctgggatgtcccaggaacggaacagaattctcccctggggcttgaagagctcaccccccatctcctccgttatccccacccccacaccacccaacacacatcctctagtctgtaggatttgctgacaaattcctatgacagccggatgtggtgcctcacacctgttacccagcattttgggaggccatcacttgagatcaggagttcgagaccagcttagccaacatggtgaaaccccatctctacaaaagtagctgggtgtggtggcgtgcgcttgtagtcccagctactagggagactgaggcaggagaatcacttgaacccgggaggcagaggttgcagcgagccattgcgccatgcactccaggctgggtgactgactgagattctgactcaaaaaaaaaaaaaatcctatgacaaggagaaaggtcagattccctggcaatgggagctgaggcatgttcttgagaaggagggaggttataaattagatggggctgggtctcagagagatatagctacttacatattaaataatgaggctgagtgtggcgtctcacacctatagtcccagtactttgggaagcagaggcaggaggatcccttgagcctaggagtttgaaaccagcctgggcaacatagggagattccatccctaccaaaaaaaaaattaaaaattagccaggcatagtggcctgcatctgtggtcctagctgcttgggaggctgaggtgggaggattgcttgaacctgggaggtcaaggtacagtgagccacgattgcaccactgcactccagcctgggtgacagagcaagaccttgtctcaaaaaaagtaattaatttatttattcaatacgtagctcctgagacaaaatgtgtgccgtactctagaccctgctggtgtgcacaattcatgggggatatgtgcgctaatggaagtgtggcacagggcaagggtgtccccagagaaagccctaatccagctttatgggtggttgtatgaggcacagaagcctttcctggttaagggataaatggatggggtttcaaaggatgaataggagtttgccaaggacaatgaagcaaagattgacattctaagcattgggagtgtcctatgcaaaatcccaaagtgatgtagtagcaaatacttaagcacctacagtgtgccaagcatgtttcatgtgctggagatacagaggaggaggagacagatgaaaccccagcccttgtgatattgtcatcctagtaggtgtggtggggagataaacaagtagacacctgcatgaataagactttcagattgtggtaaaccctgtggaggaaacgaaacaggtgaaggaacggcgtgactaggagcaggcaggtgcggctgcttcaggtagggtggtcagggaaggaggcggcatctgagctttgacctcaatttcgagaatgagccaggaatgcagagaggatttcaggcagaggaaaccttagggaggctggcgggttaaatctgcaggggtgtggctggccggaggaagtgaggtgtgagacagtcacgttgatggtgacagcagcagtgaccgtagcagcctagaggtggccgaatgcttactctaatgggctggcccatccctgagtgtctagagttcccagcccgcttaaggaaggaaggaaaacacaggcagctctaagtgtacgacgagggaggtctcatcggcggtgaggaagcccaggcgggtccccttcccagctgaaaggggttcgggtaggtttttcctgggcgttcctctgagaacagccagccctggtgagagtgcggggagaggcgcttatgacacagggagggtgggtctgggaaccagcctggcaggaggaggagggagactsccggtggccgggagctgtttgttctctgggagggatcgtggcggggtggtttgtgcagccctttcctgaaaccggaggagcctggctccttcccaggtctctgggggatgggtcggggcggggggtggtgacggggataggaccccagacagacttgagtttggatcctgggttggagccggtgacttcactctcagctccctgaacatcagggcctgcctttcttccctcccttcccctcccctcccctcccctcccctcccctccccctgccctcccctcccgtccccctgccctcccctcccctcccctcacctccacctctcctcccctcacctccccctccccttccccctcccctcccttccctcccttcccttctccttccttccttcctttccttcccttcccttcccctcccctcccctcccctcccctccccttccttccttccttccttccttccttccttccttccttccttccttcccttcctttcccttccctccctccctttattcttttctttttttcttttcttttctttctttcttgacagagtcttgctctgtcgcccaggctggagtgcagtggcgcgatctcggctcactgcaagctccgcctcccgggttcacgccattctcctgcctcagcctcccgagtagctgggactacaggcacccgccaccgtgcctggctaatttttttgtatttttaatagagacggggtttcactgtgttagccaggatggtctcgatctcctgacctcgtgatctgcatgcctcggcctcccaaagtgctgggattacaggcctgagccacagtgcccggcctcctctttctttttttgagacagaatctcactctgtcacccaggctggagtgcagaggtgtggtctcggctcactgcaacttccgcctcccaggctcaagcgattctcctgcctcagccttccgagtagctgggactacaggcgcgtgccaccatgcccagctaattttttggtacttgtagtagagacagggtttcaccatgttggccaggctggtttcaaacccctaatctccagtgatctgcctgccttggcctctcaaagtgctgggattaaaggcgtgagctaccgtgccaggccgtggagtagctaaacttatcttacactgctgaggtctctcaagatgtgtgtagggagagagagttggggggagagagagagmcaaaggaaaagaggaagagagagacagggagaaagagaggaagaaagagaaagagagaaacaggaagagtgagaggagaaagagaggaagggggagagaaagagagatgggggagaaagagagagagagaaggagacacaggagggggagagaaagagggagagagcaatgagagagatatgagacagagaagagagagagaggagacacrgaggagggggacagaaagagggagacagagagatgagagagagaaaagacacagatgagggggagagaaagagggagagagagatgagagagagattgatagcacccagctaatcaatcagtggctttagtgccatgagctggaagggaggaatggatactggggaacagttggttgactttccctggtgggacagcccctctttctagaactacctttcctatgtcccctgtgcttctctccagtccatactctacatctcagccagaaaagaagaaattctaaaacatgtatctgcccgtgacatgaccctccttggctcaacactcttcagcggtacccagcgccctctgagtcaacgccaagcttcctaccatggcattggagccgcgctctgggtccttttactgatggctcccgcctcagcccttccacccctcccataccctgcatgccagcccaggcagccctccctcctcccacaatatctctcatatgcattcctgtcccatgccttctgcttaagctgttcccacagcccggagtctcctccctggctgagggaaatcttgccggctcacatggccgtgatccccatcatttcctgcagaaagcttgcccagctytccgacacggggaccttctgcccctcctgagccctgagtcccctccatcttaactgggaggtcacctgtttgcgtggtgtctgctcagcttgcagrcaaggccaccaacaccctcctttcctgtctttccttcctaccatcctctcctgtccaccctctgcctctccctcccttcttctcttctttccttctagttactgagccatgcatgtgttgcatgcagcaaggatgaataaaataaaataaacctacagcaatcattccrgttactatggccatataacaaattattctaaaactcagtggcttcagacaaggatcrtatctattttactcaaaaacctaccatctgcacaggccttggtggaggcagcttatctgtgtgccctttggtgatggctggggctgtcaagaagctggggcagtgcttgggctgcaaagactcaaatggctggagtctgggaccactggagctccttgcccccctttgcttatctctacacagcmacagggtcgctaaacttaccttacactgctgaggcctcttaagatgtgtrtagggaragagagttggggggagagggagagagagaacagagagagagagacacacacaagaagagagagaggaagaaagraggagagagaggaagaggaagggagaggaagagagagagaaagagaaagagggagagagagaggagagaaagagacaagaagagaggaagaaaaaagaggaagagagggatagaggaagacagaaggagggagagggagagagaggaagagagaggaaagagaaaggaagggaaagagagatgtgagagggagagagagagagaaaagaggacagaggaagagagagaggaagagagagggagagaagacagagagggagagaggaagagaaaaggagacagagagaggagagatagagaagaacgagaaaggagagacagaatgtgaatgagaattgggtgccataaaccctctgatggggaaagcaaagggcattgtgggagaatcctctcagcacctgggacagcacccagtgctgatcaggaacatgttaacaaccaggaaaatggtaaaggcgtggacagcccacctggagtccaaacagatgttctaactcccttgggtgtgtctgggaatcaggtaggagatcctcagaggaggaatatgcatgcattgttctctttataataaccatattaacagccagcaatgttctggcacttactatggattaagtccttgttatraatgacttcatgccatccttccaaattcaatgacaggtagctgggcgcagtggctcacgctttgtaatcccagcactttgggaggctgaggcaggtggatcacctgaagcctggagttcaaaaccagcctggccaacatggtgaaaccccgtctctactaaaaatacaaaaatcagccaggtgtggcggcgagcgcctgtaatcccagctactcatgaggctgaggcaggagaatcgcttgaacccaggaggcagaggttgcagtgagctgagattgcatcactgcgctccagcctgggcatcggagagagactctcaaacaggagctggcgaactgtggcgcactgcttatttttataaataaagwtttatgggaacacagctgtgctcacttgttttcacatcatctgtggctgcttcccagctcctctggcagaggaggtgcaacagccactgtgtggatcacaaagctgaaattatttactatctggctgtttgtagaaaaagtttgctgatctctgtcctggaagtcaatgatattaggatttcagtttacagaaaaggagaaaaagacagggaaaaacagtgttgtttttttttcaaggttgagaaaatgaacatctgaaccaattgcccatgttattaaatgtaaacatttattattattatttttgagatggggtcttgctctgtcacccagcctggggtgcagtggcacaatcacagctcatcatagccttgacctcctgggctcaagcagacctcccacctcagcctcccaagtagctgagggtgcagatgcgtgccaccaaacctgctaatttttgtattttttgtagagataaggttttgccgtgttgtccaggccgctctcaaactcctgggctcatactattctccactttggcctcccaaagtgctgggattacaggcatgagccaccatgcccagtctaaaatttttctttatttttagtttggtaaactatgcataaagtaaaatgtaccatcttaaccattttaagtgtacaattcagtgatgttaagtatattcacattgttgtgcaaccatcaccaccgtccaccttcaggtcttttttttattttgcaaaacaaactctgtatctattaaaaaacagcttcccggccgggcgcagtggctcatgcctgtaatcccagcactttgggtggccgaggcaggtggatcacctgaggtcaggagtttgagaccaacctggccaacatggtgaaaccccgtctctactaaaaatacaaaaattagccgggtgtggtgacacgtgcctgtagccccagctactcgggaggctgaggcaggagaatcgcttgaacctaggaggcagaggttgcagtgagctgagatcgcccactgctctccagcctgggtgacacagtgagactgtctctcaaaaaacaaaacaaaacaaacaaacaaacaaaaacaaatcctgtgacttcccaatctcatctccagccccctgcagccaccactctgttttctgtctctatgaatttgactcctccaagtgcctcttatacagcatttggcattgtgtaactggtttaatacgtttgagatggtgagagcttaaggtctacaggcctaaggtttttttttttttgacagaatttcactctgtcgccaggctggaatgcagtagggcaatctcggctcactgcaacctccacctcccgagttcaagtgatgctcctgcttcrgcctcctgagtagctgggactacaggtgagtgccaccacatccagctaatttttgtatttttagtagagacagggtttcaccatgttggccaggctggtatcaatctcctgacctcgtgatccatctgtctcggcctcccaaagtgctgggattacaggcgtgagccaccgtgcccggccattgactaaggtcttaaaatagctcttcctgcctgtataatctccattatggcagggctcatataagaagatgacagttcatctgatgaggaagaaaacttactcctagttagattgggttgaattcttccctgtttccagcggtgtctgctcctggcacctcaggcacagtcaggggtaggaggtggtgatcagatacactcgctgtgagcagtgcaaggggaagcaggtgcccagaggtgcatcccggtttggtgggggtgacaaacatggacaggtaagtgcaggagtgtgtgcaatactcaatctaagaaaggtagttcaggcagagttcagggaagatatctctgtgcagggccagacatggggatgagattctgataatttgggaatgaatcaggcccccagcccctcctccctcagactcagcagtccaggcacccggccctcctccctcggacccagaagtccatgctcccagcccctcctcccttggacccaggagtccaggcccccagcccctcctccctcagacccaggagtccaggcccccagccgccttctcctgcaggaccccaggagcttgggtacccacaggctaytagatccttgtttctgtgcatggaaattctcaaattatctccaaaagtctatgaagaaggtaaacacacatttccagatgaggraataggctgatatagttgaaagacacacagagggtcacagtctggaattgacagtggtgggattcgaacctatttcactccagaactgcgtagcgccttatacgctgcggcaagtgtgacgtcattcgaacaaaccataggccccgcccccggactagccacgcccacaggctcctgaaaccaccaatcccagctgtgacagcgctcaggaccgatgctcataggtcccgtccctaggatccccgccccctccgcccgcgccccgcccctcgcagcccagttccggacgcgggcccagccgcgcctgcgcytccgctcgcctgtggctgcgtcgcgcgctcttcctcggagctayccaggcggctggtgtgcagcaagctccgcgccgacccckgacgcctgacgcctgacgcctgctmcccggcccsgcatgagccgctacctgctgccgctgtcggcgctgggcacggtagcaggcgccgccgtgctgctcaagtgagtacattctagccccgcgtgcgcggtcaaggcgggcccccagcgcaggggccgggaaggcggcggagacccccgcccctcgcacccgggtccaggccccgtagctcccgacccgcagtgcccgcccggagtggggcaaacctgcgctctggccggccaggtcaccggcccaaggtcactcggagggaagggcgagcctgggcccttgtaaatgttgctttccttccagacttttaaactctttattttgttgttttgtattatttatttgttcgtttatttttaaaggcagaatctggctctgtcgcccaggctggagtgcagtggcgcgatcttggctcactgcagccttgacctcctgggctcaggtgatcctcccaccttggcgtccccaggagctgagatcacacgtgcgccaccacgcccggctaatttttgtatttttcgyagagacggggttttgccatgttggccaggctggtctcaaacacctgccctcaggtgatccgcctgcctcggcctccaaagtgctgggattacagacgtgagccacctcgcccagcctacttaatttaaactttcttaaaaattagcctctgtggctggtggccactgtattgcatggtgcccttctctcctgtgggtgcagtgctgtttacctgctcagcctcctgttgctggacactatcttgttgccagygttagcctctgtgggacatgggtgtggtgggcagagtcgtgactcmgtagaggggtccacgtcctaatcctcggaaggtgtgacgacattacctcacgtgtcagaggttctcgctgatgtgttaagtgaagcatcttttttttttttgagacagagtttcgctgttgttgcccaggctggagtgcaatggcacgacctcggctcaccacaacctccacctcccgggttcaagcgattgtccggcctcagcctcctgagtagctgggattacaggcatgtgccaccacgcctgtctaattttgtatttttagtagagacgaggtttctccatgttggtcaggctggtcttgagctcccgaccaaaggggatctggccaccttggcctcccaaagtgctggggttacaggcgtgagccaccgtgcccggccaagtgaaggatcttatgattatcatgtagtctttttttttttttggagacagggtctctctgtcacccaggctggagtgcagtcatgctgtcacagctcactgcagcctcaccctccctgggctcaggtggtcctcccacttcagcctcccgagtagctgactctacaggcgtgcaccaccaagccctgctaatttttgtatttttagtagagatggggtgtcagcatgttggccatggctggtcttgaactcctgacctcaagtgatcctcctgtcttggcctcccaaagtgctgggattacaggtgtgaggcactgtgccggtcctgccttgtagtcttatagggtccttataagagggagcaggaggctcagtcagaggggagatggaagatagaaggagaggttgttgggtgtggtggctcacgcctgtaatcgcagcactttgggaggccaaggcaggcggatcacaaggtcaggagttcgagaccagcctgaccaacgtggtaaaactctgtctctactaaaaatacaaaagaaattagccaggtgtggtggcatgtgcctgtaatcccagccactcaggaggctaaggcaggagaatcgcttgaacctgtgaggcgaaggttacagtgagctgagattgcgccactgcactccagcctgggcgacagagcgagactctgtctcaaaaataaataagtaaataaataaataaataaaggagaggttccagtgaggatgcaggttgaagatggaggcggggccaagagtggaggaatgtggcggtctgtaggagctggaagtggattcttccctagagcctccagaaggaacctgactctaccaataccttgatttattccagtgagacatgttttggactcttgacctgccgaactggaggaggatgcacttaygtggttttaagccactaagtctgtggtaatgcgtacagcagccwtgggaatctcgtgcagcgggcattttaaatttaaatttaaatttttttgagacagagtctcgctctgttgcccaggctggcaccatttcgactcactgcaacctccgccttccaggttcaagcaattctcgtgcctcagccccctgagtagctgagattacaggtgtgcaccaccacgcctgtgaaggggtggcctgcccctccacacctgtgggtatttctagttgggtgggacgagagactgagaaaagaaataagacacaaagtatagagaaacaacagtgggcccaggggaccggcgctcagcataccaaggacctgcaccggcaccggcctctgagttccctcagtttttactgattattatcttcattatttcagcaaaaaggaatgtagtaggagagcagggtgataatgaggtcagcaaaaaccatgtgagcaaaagaatctatgacataattaagttcaagggaaggtactatgcctggacgtgcacgtaggccagattgatgtttctctccacccaaacatctcagcggagtaaagaataacaaggcagcattgctgtaaacatgtctcgcctcccgccatagggcggcttttctcctgtctcagaattgaacaaatgtacaatcgggttttataccragacattyagttcccaggggcaggcaggagacagtggccttcctctagctcaactgcaagaggctttcctcttttacyaatccacctcagcacagaccctttacgggtgttgggctgggggacggtcaggtctttctcatcccacgaggccatatttcagactatcccacggggagaaaccttggacaatactctgtgttcaagggcagaggtccctgcagctttctgcagtgcatcgtgcccctggtttattgagactagagactggcgatgacttttaccaagtatactgcttggaaacattgtgttaacaaggcacttcctgcacagccctagatcccttaaaccttgatttcatacaacacaggtttttgtgagctccagrttgggtcaaagtggctgggtcaaagctacaaattaacaacatctcagcaaagcaattgttcaaagtacaggtctttttcaaaatggagtctcttatgtctttcctttctatatagacacagtaacagtctaatctctcttttccctacacacctggctaatttttgtattttaagtagagacggggtctcgccatgtttgccaggctggactcgaactyctgacctcaagtgatccgcccccgcccccccccacccccaaaactttggcctcccaaagtgctgggattacaggygcaagccccctcacctggccgggaatctcatgcagtgagcatttataaaataatgactgtcacttgctgaaggcgttccacacgccagacactgggtggagccacttatggagaacatgacagaggtcccktggtgtgatgtgatgatgtctgtgtttcagttggggtatgtgagtgagctcagacaaggttgcctgagatcattcagtcaggggcacgtggggtgagagtgggcccacaggactgaccgtgccgcttctcaccctcagggactatgtcaccggtggggcttgccccagcaaggccaccatccctgggaagacggtcatcgtgacgggygccaacacaggcatcgggaagcagaccgccttggaactggccaggagaggtaaaatctcccctgctttggctctcagagagatatctgtacatccatgctcactgcagcattattcacagtccggaggtggaaggaacccaggcacccatccacagatgaacagggaaacagaatgtggcttctatagacaggggcatatgattcagccttaaaaaggaagggcattctggccgggcgcggtggygcacgcctgtaatcagtactttgggaggccaaagctggcggatcacgaggtcaggagttcgagaccagcctaaccaacatggtgaaaccccctctctactaaaaatacaaaaattagccaggagttgtggtgggcacctgtagtcccagctgcttgggaggctgaagcaggagaatcgcttgaacctgagaggcaggggttgcagtgagcagagatggcgccacggcactccagcctgggtgacagagtgagactcaaaaacaaaacaaaacaaagcaaaacaaaaaaaagggcattgaaacagatgaaccttgaggacattccatgaagtgaaataagccagtcgacagaagagcaaatacggtatgattccacttacaggagctacctacagttaaattcatagagaagttkgaatggtgcttgccaggggtcaggaggggaggggagaatggggagttactgtttaatggaaacggaagtttagtttggcaagatgaaacaatttgagagatggatggttgtaatggttgcacaacattaggaattattattattgtttttttttttttgagatggagttttgctcttgtcgcccaggctggagtgcagtggcatgatcttggctcactgcaaccttcgcctcccgggttcaagcaattctcctgcctcagccacccgagtagctgggattacaggcatgcaacaccacacccagctaagtttgtaatgtgttggccaggctggtcttgaactcctgacctcaggtgatccacctgccttggtctcccaaagtgctgggattacaggtgtgagccaccatgcccggcccagccataaatgtttttaataccaatgaactggacacttaaaaatggctaagagggcgggtctcggtggctcacatctataattccagcacttttggaggctgaggcaggaggatcacttgaggccaggggttccagaccagcctggacaccatagcaacacccccatctctaccagagttagccaggcatgctggcacaggtggtacctatagtcccaggtcacttgagcctaggagttcaaggctgaatgagctgtgatggcgccagcactccagccgcggcagcagagtgagactgactcaaaaaaaaaaaaaataataataaacaaaaagaaaagggggttaagatgataaattttaagtgatttgtattttaccacaacaaaaaaaattggaggctgggcattgtggcttatttgtaatcccagtactttgggaggcygcggggtggatcacctgaggtcagaarttcaagactagcttggctaacatggtgaaaccgctgwctctactaaaaataaaaaaataaaaaattagctagttgtggtaggtgcctgtaatcccagctactcgggaggctgaggcaggagaattgcttgaacccaggaggtggaggttgcagtgagccgagattgcgccaccgcactccagcctgggtgacagagtgagactccatctaaaaaaaaaaaaaaaaaggagaggatggggaatcctcttgccttggcctcccaaagtgctggaattacaggtgtgagccaccgtgcccgaccaattcagtgatgtttagtatagtcacagaatgatgcaaccatctttaaaatcaatcttagaacatctgttaccctagaaagaaacctgctcactgtaactatcaagctgtaattccctctccccaccccctgccctagaaaaccaagaatctattttctttctctatggatttgcctattctgggcgtttcataggtgtgaaatcatatacatagaattcatgtaaatgggattgtacgctgtgtggtctttcgtgtctggtttctttccccgagcacagtgtttctgacggtcatccttgctgtagcatgagccagtgcttcactccttttcacggccgtctaatattccatctctatggatggaccacattttgttgtcccttcatccacagatgggcatttggttgtttctaccttttggcttttgtgaagaatgccgcagtgaacattggtggatgtgtttttgtgtagacgtatgttttcatgtctctggggtcagtacccaggagtggattattaatttaaatctttttccatcctgggttttcaggaggcaacatcatcctggcctgccgagacatggagaagtgtgaggcggcagcaaaggacatccgcggggagaccctcaatcaccatgtcaamrcccggcacctggacttggcttccctcaagtctatccgagagtttgcagcaaagatcattgaaggtaggagaacgctggccatgtgggatgaggactgggataggyggctcccagggccaggctctgagaagtgaatgaagcaagcaaactttagagcagagttttggcaaactatgagttaggggccaagtccagttgctgcctttttttgtacagcctgcaagcaacgactttatttatttatttattactactrttattttgagagggagtctcactctgtcggccaggctgagtgcaatggcgmgatctcggctcactgtaacctctgcctcctgggttcaagcgcggacctcagcctcctgagtagctgggattaagatgcctgctaccataccctgctaatttttgtatttttagtagagacggggtttcaccacgttggccaggctggtctggaactcctgacctcaggtgattcwcctgcctcagcctcccaragtgctgggattacaggcgtgggccactgcgcccggctgactttgttttgtttgtttgttttgagacagatggggtctcgctctgttgcccaggctggagtgcagtggtgtgatcttgcctcactgcaacctccgtctcccgatttcaaatgattctcctgcttcagcctcctgagtagctgggattacaggcacccgccaccgtgcctggctaattttttgtgttttaggtagagacagggtttcaccatgttggtcaggctggtctcgaactcctgacctcargtgatctgcttcccttggcctcccaaagtgctgggattacaggtgtgagccaccgtgccctacctgaataattagtttgtttgagacaggatccatctctgtcacccaggctagagtgcagtggtgcagtcatggctcactgcagtctcaacctgctgggctcaagggatcctcccacttcagcctcccaagtagctgggagtacaggcatacgccaccacacacagctaattattgttttattgttttgttttgtttttagagctggggtttcaccatgttgctcaggctggtctccaactcctgggctcaagtgatccacccaggtcagcttcccacagtgctgggattacaggcgtgagccaccgcacctgaccttattaagcatttattgatcaagtgccttccccaccatggttaaagaaatatgtgtttgttatgggacatttataaaatactgcaatgtaaagaagacagaactggctgggcacagtggctcacgcctgttaatcccagcactttgggaggctgaggcaggtggatcccttgaggtcaggagttcgagaccagcctggccaacatggtgaaaccctgtctctactaaaaatacaaaaattagccaggcgtggtggtgcacacctgtaatctcagctactcagggtgctgaggcaggagaattgcttgaacccaggaggcggaggttgcagtgagctgagattgtgccagtgcactccagcctgggtgacagagtgagactctgtctcaataaaaaagaagacagaactaaacaactttgatctgcaccagccccaggagaatcacttttatggatctttctagtcttgtttmtaataggtttgtgtgtgtatttatatatttttatgtaaaactgggaccatcctctagcttttctattcttgttcatctttaaatagactcaagaatacactaaaattatttattgtttagttgacatgtatacttgtatatattatgtacagcatgatgtacattgtatacattgtagaatggctaaatcaagctaattaacatatgcattacctcaaatacttacctgtttttgtggtgaccacatttaaaatctcttctcttaggattgcttgagctcaggagttagagaccagcctaggaagcatagtgagaccttgtgtgtaccaaagattaaaaaaaaaaaaaaaattagccgggcatcctggcatgtgcctacagtcccagctactcaggaggctgaggcaagaggatcacttgagcccgagagttcaaggctgcagtgagccgtatttgtgccactgcactctaacctggatgacagagcaagaccttttttttgagatggagtcttgctctgtcacccaggctggagtgcaatgatgcgatcttggctcactgcagcctccgcctcctgggttcaagcgattctcctgcctcagcctcccaagactataggcgggtgccaccatgcccggctaatttttgtatttttagtagagacggggtttcactatgttggccaggctggtctcgaattcctgaccttgtgatccgcctgcctcagcctcccaaagtgctgggattacaggcatgagccaccatgcccagctgctttgtttcttttctagtctggcactgaaagggccaaagctttcttsttcagagtcaatgtgccccgctcagtaaacgggtactcaggaaatgaacaaggaatgggggagttgtgggacctcatttatttagcagacgtgatctcagacctgaccaggtgctggaggtgtgagatgaaccagagctgtccttgtgccactcacagccctagggaggcaggtgcaggtgcacattcgttggttcattcattcattcatactgagcccctgctgtgcccttggggatcaagaaagagccggcactgttgtcgggtaggtgagaggcactayggtgagatcacaaagaacagtgagagggcaatgcctcagagwctcagaggtggatgaacatttattaagcacctgctgtgtaccaggtacagcactgtcaccttcatgcacactgtcccaggcaatcccacccagggcgcctctgatcctgtctctggcttgtggacacaggtgtccrgagcactgaggtccctgagacagtgaggaccccggctggacacacctgggcaggtgatgcctcctctcttagccacacgttcctcttccgggaaatggaataattccttctattttctgggattctctagagggktttttttttttttctgagacggtatcttgctttgtcgcccaggctggaggacagtggcacatctcggctcactccaagctccgcctcccrggttcatgccattctcctgcctcagcctcccgagtggcgggggactacaggcgcctgccaccacgcccggctaattttttatattttttactagagacggggtttcaccgtgttagccaggatggtctcgatctcctgacctcatgatccagccacctcggcctcccaaagtgctgggattacaggcatgagccaccacgcccagcctctctagaggattaagtaaagctgtgtctgtgacttttttagcaaatcaagtaccagcttcttggtgttttcctaagatcaacagccaggaataaagacagcagtggatttaaaaatagtgaagatsgtccattttatgtggtgtgtattctaccacactggggcaggccaggtgcagcggttcacgcctgtcatcccggcactttgggagacagaagttttgggaagatcagtttgtgagatgacactctgacaaagctggaagctgtggctcttcccagctccmgactagaaagaacacaaagcaaagagccccaggaagcaggtacccacagccttgtttatcagggagtttgagatcagcctgggcaacatagcaagacctcatctctacaaaaaatacaaaacaatcaggcaggcgtgcaggctcacgcctgtaatcccagcactttgggaggctgaggcgggcggatcacaaggtcaggagatcgagaccatcctggccaacacggtgaaaccccgtgtctactaagaaacacaaaaaaattagccgggcgtggtggcgggcacctgtaacccagctacttgggaggctgaggcaggagaatggcgtgaacccgggaggtggagcttgcagtgagccgagatggcgccactgcactccagcctgggtgacagagtgagactccatctcaaaaaaaaaatamaaaacaatgaggcaggcgtgatggtgtgcacttgtagtcccaactacttgggaggtggaggtgggaggattgcttgagcctgggaggttgaggctgcagtgagggattttttttttttttttttaagacggagttttgctcttgttgcccaggctggtgcaatgacgggatcttggctcacggcatcctccacctcctgggttcaagtgattctcctgcctcagcctcccgagtagctgggattacaggcatgcgccaccacgcccggctaattttgtatttttagtagagacggggtttcttcctgttggtcaggctgcaacctccatctcctggtttcaaataattctcctgcctcagcctcctgagtagctgggattacaggcacctgccaccatgcccggctacttttttgttttaggtagagacagggtttcaccatgttggtcaggctggttgacctcaggtgatctgcccgcctcggcctcccaaagtgctgggattacagatgtgagccaccacgcccggcctgcagtgagctttgattgtaccactgcactcggggtgagaccctgtgtccaaaaaaaaaaaagttgaggcagttcccagataaacaaaacaacaggccaggcactgtggcccacgcctgcaatcccagcactttgggaggccgaggtgggcgaattgcctaagctcagaaattcgagaccagcctaagcaacatagccaaaccccatttctacaaaaaattttaaaagtagctgcttgtggtgtcgggcgcctgtggttcagctatgtggaaggctgaggtgggaggatcgtttgagccctggcggcggaggttgctgtgagctgagatcgcgccactgcactccagcctgggccactgagtgagcttccctctcataaaaagaaaaaaaaaaaaacaggctgggcgcggtggctcacacctgtaatccctgcactttgggaggcagaggcgggtggatcacgaggtgaagaattcaagaccagcctgaccaagatggtgaaaccccgtctctactaaaaatgcaaaaattagcagggtgcggtggcgggcacctgtaatcccagtactcgggaggctgaggcagcagaatcgcctgaacccaggcggtagaggttgcagtgggccatgggccaagatcacaccactgcactccagcctgggtggcagagtgagacttcatctcaaaaaaaaaaagaaaaaaaaccaaaacaaaacaccagaagctggcggcactcctgggcgcccagctgtgagtggagtctccctgtcccgcctttgggccttacccgtgctgcgcctgctgcctgcatyccccttccctgggtctccgcacgtgggccctgcctcattttcccggtcccagtttctgcgtcacctcctgagaggggcctcctgtcagcttccacgcagctctgtcacgggtagattctctcacgagtggaagtggctctcagctgcactggaatgtccggtccacacggacgggrcctcggctgtgctgtccaccctgtatttccagtgcccagtaataggtgcttagaaaatacttacygaatgagtaagtatacagttgtaccaggcaggtgatgtyattatcctttttttttttttttttttamaaggagtaaactgagtcacagagaagtgatgtgacttggccaggatcatgcagctggtcggggtggagccaggctttgaacctgtctgtcctgctccagagctggtattcatgacgggtgtgctgcaaccccctccttctcacacagagaaccagatggtgtctgtgtgttacgcgctggacacctaattcacgatccccgccgaaaaccacttcgggagcattatgaattccattgtgtcctccacccccaaggataggttgggatcctgaacccccatccctcagcatgtgacttcatttagaggtgggtgtttacagaggtcctgaagtgaaaatgaggtcattagggtgggccctaatccagtgactggtgtccttatgaaaaggggagatttgcgcacagaaacagacgtgctagctgggcatggtggcgcatgcctgtggccccagctacttgggaggctgagcaagaagactgcttgagcctgggaggttgaggctgcagtgagcagtgattgcrccactgtactccagcccaggtgtcagagggagaccctgtctcaaagaaatataaaaaataggccaagtagactgagtgtggtggctcacgcctgcagtcccagcactttgggaggctgaggtaggtggatcacgaggtcaggagtgtgagactagcctggccaacatggtgaagccccgtctctactaaagatacaaaaaattaacccggtgtggtggtggatgcctgtagtccagctacttgggaggctgaggcaggagaattgtttgaacctgggaggcrgaggttgcagtgagccaagatcgcaccattgcactccagcctgggtgacaagagtgaaactccatctccccccccaaaaaaaaaaaaataggctgggggcagtgaaattgcagcactctgggaggccaaagcaggaggattgcttgagttcaagagtttgagaccagcctgggcaacatagtgagaccatgtctgaaaaatctaaaattaaaaaaggaaaaatgaaaaaaaaaaaagagacagctccaaagggaagagggagagaggagatggtcacctgtgagccaaggagagagaccagagcggatcctccctgagggccctgagagggaaccagccctgcccacaccttgatctgggacttccagcctctgggactgtgattttttttttttttttttgagatggagttttgcttttattgcccaggatggagtgtaatgatgcgatctcggctcactgcaccctctgcctcctggtttcaagcgattttcccgcctcagcctcctgagtagctgggattacaggtgcatgccaccacgcctggctaattttgtatttttagtaaagacgcggtttctccatgttggccaggctggtctcaaactcctgacctcaggtgatctgcccacctcggcctcccaaagtgctgggattacaggcgtgagccactgtgcccggccaggtctgtgaggttttaaaccacctgtctgtggcactttgttacggaacccgagctgagtggtacagggaggaaggccctgtggttcagcgcattttacagctgaggaaactgaggctgcagtctccatctgtgtgtcctttggttgcttgtatgagtgaggtggcaggtttgggaatgaaaccacgcctgcggtgccggggctcccaccggtaacctcccgtttttggcctcggggctccggcaggaagsagtcccaaggcttagatggaggtgyggagggcgtgtgagtgtcctggagctgctgtaacaatgtactgcaaacccagtggcttacaccctcagacgtgcattccctcacggttccggaagccggcagtctgaatcgcggtgtccctgtggctgtgacytgtgagacgggccataatcctcccagcctcttccacttccagcgggggcggcccaccctcaccttggagctgtgcctctccggtctttgcctctgtccacacatggccttctccccatgtgtctctgtctctgttttcccttcctataaggacaccagtcattggattagggctcaccctaatgaccgcatcctgacatggccacttcggcacagaccctgtttccggcacaggccacattcacaggttgtgggagcacaggagtgtttctgctggtgcatcaggctggggtctgtcctcacsgggatgtytcctcctccacccctctcttccagaggaggagcgagtggacattctaatcaacaacgcgggtgtgatgcggtgcccccactggaccaccgaggacggcttcgagatgcagtttggcgttaaccacctgggtgaggcctgggcaggggctgcaccatgggttcaagcgatcctcccccgtcgtcctcccaaagtgctgggattttaggtgtgagtcaaaagtgaccttttcatcatccttaatccaggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctygccatcgtcctcttcaccaaggagytgagccggcggctgcaaggtacgggggygctaggctcggcctccctcttgctttactctgagcctagagcggcctttccatgatcctaggctgatgggaggccaaacggtggatccagaacagagtcagcaaaagtagagcatgtggaccacgctgcccgcttctggtgyctgaagcagacatcactaatcgatcgttcttctgaggattgtctgttcatcccaggtggtctagtctgcctggatcagatgtccttccctgctgctgttgggcaggcagctcagccttttggctccagccagtgagtctcaaccaggggcagttttgacccgcagttgtcaatgcctggaaacacagtgatcacagctggcttggggagagattgctctgggcatctggagggtaaaggcccagatgctctcaatgtcctacagcgcacgggatggcccctcactcctcccaacccacagcatccacagtgctgagattgagaaatctgtgctaggcctttgcttctgaaagacggtctgtggaccagcggtgccagccccactgggagctggtcagagttacagtatcttaggtcccaccgccacgcaccgatgcaggctcccggggtaagctcagcgttctgggtttatgaagccctccaggaaagctcggctcccagcagccatgtggcagagccgctccgcaagataagaccacttcactaagattccagagcaagagggacgatggggtttgagtgcaggaagcagcctggtgcccggaagccccacagctgggtgtrggctgccacagcctcccaggtgaggctggacccctccctcagtcttctctttctttcttccccaggctctggtgtgactgtcaacgccctgcaccccggcgtggccaggacagagctgggcagacacacgggcatccatggctccaccttctccagcaccacactcggtgagtcccctcccagcctggggtctccacgtggagccctccacccctgctttctcagcccagggcccaggaccctccctcagagaccgtccctgaggcctcatgcctgctcctcgcctacgtcttctgaggcacagagcacaggtccctttcctcygttgacctggcctgccagcctctaacagcyccgggaagcaggcagagccctgctggcggatgagaaaaccgtgtctcagaggaagaggccgtggagctgacgcctggagtcaggctgtactcagggtaactccagcttcaccccaaaccagctgcacctcctggggaagagctgttacccctctgagcctgtttcttcatctgcagagtgcaggccttaataggactcacctcacagtcactgggggggttatacgagaccttccttgaaagggccagcacaggaccccgcccagagaataggtggaacaaacagttggagctttacttacttatttttgagatgaagtcttgctctgtcgcccrggctggagtacaatggcatgatctccactcactgcaacttccacctcccaggttcaagcgattctcctgtctccaagtagctgggattacaggtgcacaccaccacacccagctagaggtggggtttcaccatattggtcaggctagtctcaaactcctgacctcaggtgatccaactgcctcccaaagtgctgggattacaggtgtgagccaccacccccaggcagttcatgctttatgactagtgtttataatcctgaaaaacatggagtgggtgattggttggcatcaagaatcttaacttggcgaggctaatagccacgcctgtaatcccagcactttgggaggctgtggtgggcggattacctcaggtcaggagttcgagaccagcctggccaccatggtgaaaccccgtctctactaaaaatacaaaaattagccaggtgtggtggtgtgcacctgtagtcccagctactcaggaggctgaggcaggagaatcgcttgaacccgggaggcagaggttgcagtgagctgagatcacaccactgcactccagcctgggtgacagagcaagacaccaggtctcaataaataaataaataaatgtctttttttttttgagacggagttttgctcgtcacccaggctggagtgcagtggcacaatcttggctcactccaacctctgcctcctcggttcaagtgattctcctgtctcagcctcccaaagtagctgagattgcaggcgcccaccaccacacccagctaagtttttatttttagttgagacagggtttcacacgttggccaggctggtcttgaactcctgacctcaggtgatccacctgcctcagcctcccaaagtgctgggattacaggcgtgagtcaccacgcccagccctttttttttttttttttgagacgaagtcttgctattgtcacccaggctggagtgcaatggtgtgatcttagctcactgcaacctccgcctcccaggttcaagggattctcctgccccagcctcccgagcagctgggattacaggcacccgccaccacacccagttaatttttgtatttttagtagaaatggggtttcaccatgttggccaggctggtctggaactcccgaccccaggtaatccgcccgcctcggcctcccaaagtgctgggattacaggcctgagccacctcgcctggccaaaaaaaaatccttaacctgaggctggtgccaggtgcatttaataagatgttattaaaggagaaatggggtagggtgaggactggggctgaccaagaggaagagagcttccattttcctggacaaagccaggaaggctccttgggggaggcagcttttggtctgatccctggtctggtgggatttgcctgggcagtgccagggaagggaactgcagatggaggcagccaaggggaaagggctagaggagggctctgtgggactccagggacccggagctccctgaccggggagcggggcttccttccttctctctgagcgagtgtggactaaatgccctgtgggctgattgcagggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagccmctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgcccygggctctggctggttccgtctgctctgctgccagcaggggagaggggccatctgatgcttcccctgggaatctaaactgggaatggccgaggaggaaggggctcygtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagygagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatccygagttcaggctctgcacggcatggagtgggaaccccaccagctgctgctacaggacctgggattgcctgggactcccaccttcctatcaattctcatggtagtccaaactgcagactctcaaacttgctcatttaaaagaaaaaaaaaagaagaaaatgtacccgagtcgtagattttatttttcctctgtgcatgggtgaatgcccatgagctgaacaaaggcaactcatggctttattccttttaggaaacaaggcatcagtttatcaccagggcaacaggccatgcaaaagttcagacttggccgggcgcggtggatcacgaggtcaggagatcgagaccatcctggctaacacaatgaaaccctgtttctactaaaaaaatacaaaaaattagctgggcatggtggtgggcgcctgtagtcccagctactcgggaggctgaggcaggagaatggtgtgaascygggaggcggagcttgcagtgagccgagatcatgccactgccctccagcctgggtgacagagcaagattccgtctcaaaaaaaaaaaaaaagttccgactttttagagatgaaagcccctttcacctgtttcacaggaaataaccgtttaagtccgggcatcttacaagactgctgtgttagaaactggatagagatcagggtgagatgaaggggctcttagcttaggtgcagaaccgaaggaggcaccgaaaagctcagtaatcgagatagaaaacatgttttcatatttgagatactggggaggccagggatgctactcaatatcccacagtacacagaacagccacctagtctcgctctgttgcccaggctggagtgcaatggcatgatctcagctcactgcaacctgtgtctcccatgttcaagcgattctcatgcctcagcctcccgagtagctgggattacaggcgcccaccaccacacctggctaattaaagacagggtatcaccatgttggccaggcttatcttgaactcctgacctcaggtgatccacccgtcttggcctcccaaagtgctgggattataggtgtgagccagtgcacccagccctttttgcttttttagagacgaggtcttactgtgttgccaaggctggagtgcagtgccrtcacagctcactacaacctcgacctgtgattctcctgcctcagcctcctgagtatctgggactacaggtgcatgccaccacacttggctaattatttgtagaggtggcaacataacatttgctatgttgcccaggctggtctcaaactcctgggctcaagkgacccttccgccatggcctcccaaattgttgggattacaggcatgagccaccgtacctggccttagttttctttccgatgccacaccaaatggctagagggtgtgtttgggatgacctgagtctggtaggcaacttccagtggaccccacrgtgcgaccacctccctttgagtgtgggggagatgtagcgactggcttctagcagtaggatagggcagaagtgacagtaggttagtcttgtggttaggttacaaaactgacctctgtgatggtagcgtccctcgtcagccctcttgtcttgccctctcgctggctggyggtgatggagccggctgccatggtgagcggccctgtggagaagccagggaggaatggagacaatctggagaaacagaatcacaccaacaaccaygtgcgtgagcttgctgtgtgctcttgcttgggagcaagttacaggttcagcccaagaggagyggaccactccagggtgtaaataccaggagggggaattggaagactaccctaagcatgccgaccggagactgtgtgtgtgtagtaggtatttcttactgggagatcacggaaaagcaagtttgagaaacactcccatcagatgggtgggccgaggataacctcaaagcctttggttctccgwataggtgcgtaggactcacccaggcactctttccttttttaaattgtggtaaaaactacataacagtggccaggcgtgatggtgcacgcctgtaatcccagctattagggaggctgaggcagaagaactgcttgaaccaagggggcaccgctcctggctgtaacatgttttcaatatcccccctcttcggtggcacaggggctggccccatatacatgtgcgatggcaactgacagggtccctgatamaccggagtgctccagaaacaccccattgcgtgggacggaggatgttaggtggccctcctagcrtttgagtttgataaatgagcaaaggaagtggtttttactagaaagccagctttcctttttttttttttttttttccagccagcaaaccccaaacaggaacctatggttggtgatggatgtgcgttcagaaagcagggagggagggggagtcagaggtgagggggtcatcagccatagctgtccgctgcatcaccccctcgctatctccaggaagcgttctgggcttttcctgttgtgcagtgtggaagtgctctatcttcattcatatcaaggaaagtcaaaggacaaactaaagccggcagcgtctttctggcttcctagtcaggctgttcggtagcggagtgtcaccctgatttccagccccgcagcacacacastgagabcctgcctggcgtgattcagaggcaacgtatttcccaaggtggctgtgaaggaaccagggggataaacacagcccgtgaaccgcacgccagaggacaggtccggctgcctgccgcggagtcgtcacggcgtgtcgcgtctgagcgcttctccaaagcacccaagtggcacccggggtgacakttacatcatcttgagtacagttctctcaaggaaaaagcaagcccagcatcttctgccatggcaaccctggcttggagcctccataagagagaaggccctaagaatwccattttcttgctctaagttgctcttacgggaaagaagtgataatattcttcctaaacgccatcattcgtgcatccttcccacctayatgtgtcaccggatcattctccgcctgggcggggccgtcctgtgcactgcagaatgctgagcagtgtccttggcttcgaccgaccacatgccaggagcaccccaatttctgccatcgggtgattgacttcactgttgcatttgattttttatgtatcttttaaaaggacccaatagggccaggcacagtggctcacacttgtaatcccagcactttgggaggctgaggtcggtggattgcttgagcccaggaggagttcaagaccagcctgggcaacatagtgaaaccccaactctacaaaaaacaaatgttttatttttatttattttagatggagtttcactcttgttgcccaggctggagtgcagtggcgcaatctcggctcattgcaacttctgcctcccgggttcaagcgattctcctgcctcagcctcctgagtatctgggattacaggcatgcgccaccacacccagctaattttgtatttttagtagagatggcgtttctccatgttggtcaggctggtctcaaactcccgacctcaggtgatctgcctgcctcggcctcccagagtgttgggattacaggcgtgagccaccacgcctagccgggtttatagttttataacccttatgacaaatctcatagtattctgcagggataagcatgaaaccactygttcaataagtgcaaacaaaaacgccaacaattcttaagacatttctaatcttattttaccaataattttaaagccagcttatgtattaaagatttataactacttttattaacacgtttaaaattctatgcagcttaaagcatttataatggataaaactgccaatactgagtgcctgacataatatttgaaaggtggcaggcattcaaccatggtcactgaatgagagatgtagggaagatgatggcagggaggtttttagatatcaacaccctgatagktctcattttaaccacctgtaagtgcacatacaagtcaacggcactggccgggmgcggtggstcaygcctgtattcccagcactttgggaggccaaatcacaaggtcaggagatcgagaccatcctggctaacacggtgaaaccccgtctctactaaaaatacaaaaaatcaactaggcrtggtggcrsgcacctgtagtyccagctactcaggaggctraggcaggagaatcgcttgaaccygggaggcggaggttgcggtgagccaagatcgcgccactgcactccagcctcgkcgacagagtgagactcygtctcaaaaaaccaaaaaacaaaaaacagtcaatggcattaaatataaatacatttacagtgttgtgtaaccatcaccactatggatcccccagactttgtcatcatcttcaacctaagcgctccctattaaatagtaactccccacttttcccaggccttggcaaccaccattctaatccctgtctctatgaatttgactcctctcgatacctcagataagcggcacaatgcagtatttatctgtcaagtccggaatatttcctttagcataatgtcttcaaggtccatcacgttgtagcatgtatctgaatttattcttttataatattttttattttttggagacagaatctcgctctgtcacccaggctggagtgcartggcgygatctcggctcaccgcaacttccgcgtcccgggttcaagccattctcctgtctcagcctccggagtagctgggactacaggtgcstgccgccatgcccggctattttttttttgtattttttgggggttttactgtgttgcccaggctggtcttgaactsctgagctcaggcaatctgcctgcctcagcctcctaaagtactaggattacaggcatgggccaccacgcccggccttatttttatttttgagacagtctcactctgccgcccaggctggagtgcagtggtgcgatctcggcttaccgcaatctctgcctcccaggttcaagcgattctcatgcctccgtctcccaagtagctgggattacaggcacctgccaccatgcccggctaatttaacgcccagctaatttttgtatttttagtagagatggggtttcaccatgttaaccaggctggtctcggactcctgacctcaggtgatccgcccgcctcggcctcccaaagtgctgggattacaggcgtgagccactgtgcctggctgatttttattcttttagttaaggctggttgatattaccttgtgtgtatataccacatgttgtttatccattgttgttgatggacatgtgggtggtttcaccttttggctattgtgaataaagctgctatgaacactgtgtacaaatatgttagagaccctgttttcagttcttttaggtgtgtaccccgaagtggaattgctggattttatggcaatcccacgtttaacttctggaggagctgctggaactgttttccacagcaggggcgccatgttacgtccctgccagcaatgcacgcgcagtycaatttctctgcatactcaccaatatctgctrttttccattaaaaaaaattatagccggtcgggtgcagtggctcatgcctgtaatcccagcactttgggagaccgaggcaggtggatcaactgaggtcaggagttcaagaccagcctggccaacacagtgaaaccccatctctactaaaaatacaaaaattagcctggtgtggtacatacctataatcccagccacttgggaggctgaggcaggagaatcgcttgaacctgggaggtggaggttgtagtgggccgagatggcgccactgcactccaacctgggcaaaaagaacgagactttgtctcaaaagaaaaaaaaaaaatacagccattccagaaggtgtgaagtcatatctcactgtggttttgatgcgtattttcctagtgacatcagggagtttatgggagcacgggaacacagaccaggccccagcaggcggacaaacggtgcaacgccaggctggccagaggagataagcgcggctccttggagcttgtgtgcaagtcactgtactgaggagcyggctacggctcgatgagtctcaattaggaaaggcyggggctggtggaggaagggaggagagcattcttcatcctcatcacatcctgagcctgtgccccaggctcccaccacttccctccctggycacagagctcaggacagggctgaggaaccatgtctccatccccgaccgccctcttctgtcttggtgagtcctgagggtcagatctgggaaatgctgaaggacaggcatggactgccagacaaaggatttttaagaawtttgcattggtgatgaatttcaggacaaaaaggaacctgtaagagccccttcatttgttgggtggggaaacggggggccagcgagctggcattttgcatgagttattccagtgtattcatggctgggtcaggaaatgaacagagtatcctagcattggtcacaactttgttctactacactgcagttgccccttttttaaaaaatgtgggccaggcacagtggctcacgcctgtaatctcaaccttgggaggccgaggtgggtggatcacctgaggtcaggagttcaagaccagcctggtcaacatggtgaaaccccatctctacaaaaattagccgggcgtgatggcgggtgcttstaatcccagctacgtgggaggctgaggtgggagaattgcttgaaactgggaggcagaagttgcagtgagctgaggtcaggcattgcactccagcctgggcaacagagagagcctccatctcaaaaaaaaaaaaaaaaaaaaaaaaaaaggctgagtgccatggcttacacactttgggaggccgaggcgggtgggccatctgaggtcgggagtttgagaccagcctgaccaacatggagaaaccccatctctactaaaaatacaaaattagccgggtgtggtggcacatgcctgtaatcccagctactctggaggctaaggcaggagaatcgcttgaacctgggaggtggaggttgcggtgagccaagatcacaccattgcactctggcctgggcaacaagagcgaaactccgtctcaaaaaaaaaaaaaaaattgtggaattgatatctggactaggtatggatttaatttgtcagtatcccctacagtagtggagtaaatagtctcctgatggatgggtggcaggtcgaatgcatttctgctgcctgatcttcacttgtgctgggcatgtcgaatgmattatttcctgatttcttcagaatttgaccactaaagggacagcatctccaaaaggctaagcaggaagaagatggttgcattactggagatgagagggttaactgtgaatataaacaacctctcattcattatccatccatggatgtattctttttttctttttgtttgttttttgagatggagtctcgctcagtcggtcgctcaggctggaatgcaatggcatgatctcagctcactgcaaactctgcctcccgggtccaagkgattctcctgcctcagcctcccgagtagttgggattacaggcatctgccaccaggtctggctaattattgtatttttagtaggggcggggtttcaccatgttggccaggctggtctcaagctccttacttcaggttccacccgcctcggcctcccaaagtgctgggattacaggcgtgagccaccgcacccagcctgttttaacttttatttatttaattttatttgagatagggcctcacttctgtcacccaggctggagggcagtggcatgatcatggctcactgcagcctcaacctcccaggctcaaccagtgcctccccatcagcctcctgagtatctggaactacagttgtacaccatcatgcctggcttgtttttgtaatttttttagttacgggggtccgctatgttgcccaggctggtcttgaactcctgggctcaagcgatccacccacctcggcctcccaaagtgttggggttacaggtgtggcctgtacaggttactgcatctggcttgttgcttcagtagcttttgggatacaagtggttcttggttacatggatgaattatattctggtgaattctgagattttagtgcacctgtcacctgactagtgtaccttgtacctaatgtgtagtttttcatccctgccccacttctgcccttcccttctgagtctctgaagtccattacatcactctgcatgcctttgcatacccacagcttagctctcacttataagtgagaatatacagatttttgttttccactcctgtattactttacttagaataatgccttccagctccatccaagttgctgcaaaagactttttttttttttttttaaagacggaatytcgctctctcaccaaggctggagtgcagtggtgtgatctcggcttactgcaaactccacctcccgggtttaagtgattctcctgcctcagcctcccgagtagctgggactacaggcacccgccaccatgcccggctaatttttgtatttttagtagagatggggtttcaccatgttgggcaggatggtcttgatctcttgacctcgtgatccacccacctcggcctcccagagtgctggcattacagatgtgagccactgtgcctggccaaaagacattatttcactccttttaatggctgagtagtattccacgctcatttatttttatttatttttattttttgacatggagtctcactctgttgcccagactggagcgcagtggcatgacgttggctcactgcaacctccacctcccaggttcaagcgattctcctgcctcagcctcccaagtagctgggattacaggctcctgccactacgccccgctaatttttgtatttttagtagagacagggtttcaccatgttggtcaggctgctctcgaactcctgacttcaggtgatccgcccaccttggcctcccaaaatgggattacaggtgtgagccagcgcgcccggccggtgagaacatttaaaatctactatcggtgatatgcaagtgtacaatatgttgttattaactacagtcaccatgatgtgcagtagatctccaagacatactcctcttgtccaactgaaactgtcctcctctgaccaacatctccccaaaccttaccccaccgccccggtaaccaccactgtgctctctactcctgtaagttcccaagtccacactctttaccactaattggtgctgctagggtttgaatctactcctgccagctgtaggactgtggataagatactgtctcactagcctgatgtataagaggggactgataatggtgggtaacccgtacgattatggcgacttggagtccatgcacagaaggcgctcagcacggcgcctggaagactcccagccatggtacagcgtcgcatggaaacctacaaagaggctgaggtgggctgtgatgcggcaggaggagggggacagagaagcggccggagcttgsgttggggtgcagagggagcctggggtggacaaagggtggtggctatgggggcgctggtgacaagttgtcactctctgagctcagagtcaagacatgakctgggttcacccacttcttgctatgtgagctacacaaggttgcttggcctctgcccagtttccttatgtttacagtgggaatgacaactatcccgcctttgtgtgtgtgtgtgtgtgtgtgtgtgtgtgtgtaagaatgagggttaccagataaaacactggatgcctggttaaattggaatttcagataattagtactttttttttcctcctcctcttcgttttctgagacagggtcttgctctgttgtcagtctggagtgcaatggggcaatatcatttttttttttcctcgagatggagtcttgctctgttgcccaggctggagtgtagtggcgtgatcttggctcactgcaacctccgcctcccgggttcaagtgattctcctgactcagcctccccagtagctaggattacaggcacgtgccaccatgcccagctaatttctggtatttttagtagagatggtgtttcaccatgttgaccaggctggtcttgaactcctgaccttgtgatccgcccaccctggcctcccaaagtgctgggattataggcatgagccaccgtgcccggccagtggtgcaatcttacctcacagcagacttgacctcctgggctcaagcaattccaggaggggatcgcttatgcacatgtatttgtatacatatgtatatatatacacacacacacatgcatacatatatacgtatacatacatatacacatatgtgtatgtacacacgtatatgtacatacacatgtatgtatagatgtaggtttacatatatgtactatatgtgtatatacatatagtaatcagatcagggtaagtagcacacccatcttctcaaacatgcatcctttctgtgttgggaactttccccatcctccttcaggctatttgaaacgattattatatatattacatcctatcatgtaatcatggaatactgattcaaccaaatgttgtaaataccgggaaacccatggccagcacatgctgagacgtcctgacttacacgctgaggctccatcctgctccatccttggagcccaatgcatcccattagtgtggggttttatcgcatatattacatagacaataaaatacaataatatacaatatgcaatagtatttacaatacttgtctacacaattgcatactattgtaatgtacttggatattatttaatattgggagactgaagggaggaaacgaaggaacagcaatgtctcaggtcccattcctcacatccactgaggaagtcaatgggcaatgtctaacacgaacgagcccaccgtgtctaacacaacacaaacgagtccacygtgtctaacacaacacgaacgagccgtgtctaacacaacacgaacaagcccaccgcgtctaacacgaacgagcccaccgcgtctaacacgaacgagcccaccgtgtctaacacaacacaaacgagtccaccgtgtctaacacaacacgaacgagtccaccgtgtctaacacaacacgaacgagtccaccgtgtctaacacaacacgaaggagyccaccgcgtctaacacgaacgaacccaccgtgtctaacacgaacgaacccaccgtgtctaacacgaacgagtccaccgtgtctaacacgaacgagtccaccgtgtctaacacaacacgaacgagtccaccgcgtctaacacgaacgagtccaccgtgtctaacacaacacgaacgagtccaccgcgtctaacacgaacgagcccaccgcgtctaacacgaacgagcccaccgcgtctaacacgaacgagcccaccgcgtctaacacgaacgagcccaccgcgtctaacaccaacgagcccaccgcgtctaacacgaacgaaccctccgcgtctaacacgaacgagcccaccgcgtctaacacgaacgagcccaccgcgtctaacacgaacgagccctccgtgtctaacacgaacgagccctccgtgtctaacacgaacgaacccaccgtgtctaacacgaacgaacccaccgtgtctaacacgaacgagtccaccgtgtctaacacgaacgagccctccgtgtctaacacgaacgaacccaccgcgtctaacacgaacgagtccaccgtgtctaacacgaacgagcccactgtgtctaacacgaacgagccctccgtgtctaacacgaacgaacccaccgcgtctaacacgaacgagtccaccgtgtctaacacgaacgagcccaccgtgtctaacacgaacaagtccacagatagcagtacgccaccatgccttgccctcctctcccaccacccccagccatggatctgctttcttctccatctcctatagatttacctattctggatatttcatgtaaatgacctcataaactatgtggctttttctgaccggtttctctcacttaaattacattcctgtgtgtcttttgaagaaatwattaggacagagtaaagcatatgcatgcaaaygtcttatcaccgcgcccagcaggcaggaatgtccataaaagcgagtcctggcatctggtccctttcttctttcctcagggctgtgtctggggcgtgtgccagcgcagagtggtgagtccttccccagaccccttccctcctgcgggatcyrccagcgcgggrgcagcggggtccaggcggggtctgcggggaggctgacccagccctgctcctcttccaggaccgctccccaagccctccctccaggctctgcccagctccctggtgcccctggagaagccagtgaccctccggtgccagggacctccgggcgtggacctgtaccgcctggagaagctgagttccagcaggtaccaggatcaggcagtcctcttcatcccggccatgaagagaagtctggctggacgctaccgctgctcctaccagaacggaagcctctggtccctgcccagcgaccagctggagctcgttgccacgggtaaaggaagggggatcrragcctgggactgcgtggtcctccgttcaggacacaaatacgggggacattgagggcagggattagggtgaggcaaacgaggcamtggcctagcgggtggtggtgccacgacatttatggatcaatgtgaataatattttgttttttggacacagggtcttgctgcgtcacccagggtggagagcagtggcgcgatcttggctcactgcagcctccacctccagggctcaagcgattctcccgcctcagccctccaagtagctaggattacaggtgtgcaccaccacgcccagctcattttttatgtttttatagagatggggtctcttgacagttttcacaaaaggcattaaaatacaaaagagagagagatagggtctcgctatgttgctcaggctggtctcgaactcctgtgggctcaagctatccttccaccttggcttcccaaagtgttgggatttcaggcgtgagccactgcatctggctgtgaataacattttcatgcaatttttwaaaaaatcaaaataaattgcaaaaacatccacaatgaaaaaaaccagaatttcaaataaaggcagaatcagccagtgcctgtgtcaagtcataccagagtctgtgccaaaaygaaaaacaggcamccctttatctgtgttttaatgcacttaaaaaaattagcgatggggtcttgctacactgcccaggcyggagtgcagtggctgttcataggagcagtcatagctcactgcagcctggagctccttgccttgagcaatcctcctgcctcagcctcatgagtagcagggactacrgtcaygggccaccgtgcttggctcgggattctttttaaaactttgttttggartaatttttagactgacagaaaagttccaaagataatattaatggaaatatttcacccaggatcccctcatgttaacatcttacatttgttacaaccaaaaaataaacgtagcactggtcccagtggtttacacctgtaatcccagcactttgggaggctgaggcgggaggattgcttgagctcaggagttcaagaccagcctgggcaacatagtgagacctcatctttaaacaaaattaaaaattagtggggcatggtggcatacacctatagtcccagctactcaggaggctgaggcaggaggatcgcttgagccagggaggccraggctgcagggagctgtgatcacgccactgcactccagcctgggtgacagagtgagaccctgtatcaaaaaacaaacaaaaaactaaccatagacacaactatrttatatcaagtaaactccaggctatttgaatttcaccagtctttccactaatatcctatttctgttcccagaccccgtccagggccccacagtgcatttagtatttatgtctccttagactcttgattggtgcaaatattctaatttcttttcttatttwtttwttttttttaagagaagaggttgggccgggcgcggcggctcacgcctgtaatcccagtactttgggaggctgaggtgggtggatcacttaaggtcaggagtttgagaccagcctggccaacatggtgaaaccccgtctctactaaaaaaaataataataattagctgggcgcggtggcgcactcctgtaatcccagctactccggaggctgaggcaggagaatcgcttaaacctgggaggcggtgagccgagattgcaccactgcagtccagcctgggcgacagagcaagactccrtcttgggaaaaaamaaaaaagagaagaggtcttactatgttgcccaggctttagtacactcgctgtattcacaggcatgatcatagctcactttagcctcaaatccctgggctcaagtggtcctccctagtagctgggactataggtgcacccagttagtgcacttttaaatggttattttctagaagtaggttttggaaatagcactgatgcgcttgcatccacaaaagcctagaatgtaaaattctaataaatctttcaggggaataaagtattcaaacagaataatgtgagttttaacgacctactcttcaaattttcaataattttttcaaataygttaattgtttgggaataattaaattttacatcccaggagagtgcctcactcacgccaccctaattcctggccagctgcactgtggtctattccgcgttataaatcctgcctccctcccctcttccctgcctcactcccctccacagcatcactggcctcctctctgctactagaatggaccagcctggctgcctcattacttctttcagggtcagactcaaatactctcttctcgctaagtatatcccccaccaccctagtcaaagtggccctcctcactatctggtatgtgaagtatacctttttttatcttggtggtggttgtctatttttaattcctggtcgggcacggtggctcacgcctgtaatgccagcactttgggaggccgaggtggacggatcacctgaggtcaggagttcgagatcagcctggctaacatggtgaaaccctgtctctactaaacatacaaaattaactgggcatggtggtgcatgcctgtagtcccagctactcgggaggctgaggcaggagaatcgcttgaacccaggaggtggaggttgcagtgagctgggatcatgccactgcactccagcctgggcaacagagtgagattctgtttcccaaaaaaaaaaaaaaaaaaaaaaaaaaaaaaaatatatatatatatatatatatatatatatatatatatatatatatatatatatatatatgccattgcactccagcctgggtgacagagcgagactccgtctcaaaacaaaacaaaacaaaacaaaacaaatgaaacaacaaaaaaagaatacagacagacacataatagttgcttaagtgaaaattaagagaaaatattgctgagtgaatgttacagttatcaggcagcttatatatttccttccttccttcctccctccctcccttccttcctctttctttctttttcttcttgttgagtgaatgccataattattaggcagcttatatttttatcttccttacttcctttcttttgctttctctctctgtctttttttgagacaaggtctcactctgtcacccaggctagtgtacagtgatcatagctcactgcagcctcgccttcctgggctcaagcgatcctcccaccttggcctcccaaagtgctgggatgaccggtgtgagccgccgcacccagcctcaacctttgtttttctgactcctgtgtgcaggcatgcatcaccacaccggtctatgacaacaacctcacatcagagtagtgtaggttcgtgtttaggagcggagaccctggaatcaaactctgtgagtgcagatttcaactctgccacttatgatcttggacaagttttttatttatttttaaattaaaatatgtccagctttgttgaggtataattgaaaaacaaaaatggaatatatccaaggtgtacaagttgatgttttgatatacgaatccactgtgagacagttactactagcaagctaattaacatacatcacctgacacagttaacttttttgtgtgtgagaayacttataatctaccctcttagcaaatttcagctrtacactgcagtattgttacctagagttggacaaattatttaatgccatgtgccttagtttcatttataaaatagggacattaagagtgaggactccataggtctctgaggattcactgaactgatayacatcataagtttggaaggcacccggaagctagcactgtcagccacatttacaacgtaacaattgtatgtggcaatacaagcttacagcacagtataagcttaagctatttacttactccagcgcttgctaggcaacaggcactctgcaaattactgtrtactgtctcattcagtcatccccattttaacagaacaaggcagtgaggctcagatacagagggagatttgtctccagggccaccaggcccctgaaggcagaactaggatttgcacccaagcactaggacgtgagcacagcctccttcctcaaccactgggtgactcgacctctctgtgagcttgggtgggggagtgcgctctctgggagggatacagccaaaaagctccccagctcttaggcaggtgtggggacctccccagtctcagctgagatgctggctcctgccttcaacatcagactttctttttctcccaggagtttttgccaaaccctcgctctcagcccagcccggcccggcggtgtcgtcaggaggggacgtaaccctacagtgtcagactcggtatggctttgaccaatttgctctgtacaaggaaggggaccctgcgccctacaagaatcccgagagatggtacmgggctagtttncccatcatcacrgtgaccgccgcccacagcggaacctaccgatgctacagcttctccagcagggacccatacctgtggtcrgcccccagcgaccccctggagcttgtggtcacaggtaggggtagtgcagaccaaacctttcttcctcagcctttataggtcctgatggccattccaagggaggggccataagtgggaaggaagtgggagggcaggaagccctgggctgcaggggcggggccgtaggtgggaaggaagtgggagggcaggaagccctgggctgcaggggcggggccgtaggtgggaaggaagtgggagggcaggaagccctgggctgcaggggcggggccgtaggtgggaaggaagtgggagggcaggaagccctgggctgcaggggcggggccgtaggtgggaaggaagtgggagggcaggaagccctgggctgcaggggcggggccgtaggtgggaaggaagtgggagggcaggaagccctgggctgcaggggcggggccgtaggtgggaaggaagtgggagggcaggaagccctgggctgcaggggcggggccgtaggtgggaargaagtgggagggcaggaagccctgggctgyaggggcgsmgccrtaggtgggaaggaagtgggagggcaggaagccctgggctgcaggggcggggccgtaggtgggaaggaagtgggagggcaggaagccctgggctgcaggggcggggccagaggtgggaaggaagtgggagggcaggaagccctgggctacaggcagctgggagaatggaggtttcttttttttttttttgacgaagtctcactctgtcacccaggctggagtgcagtggcgcgatctcagctcactgcaacttccgccttccgggttcaagcgattctgctgcctcagcctctcgagtagctggaattacaggtgcctgccacgatgcctggccaatttttgtatttttagtagagacggggtttcactatgttggtcaggctggtcttgaactgacctcatgatctgcccgcctcggcctcccaaagtgctgggattacaggcgtgagccaccgcgtcggacttgactaccattcttaaagggggtttctttcaaaaragagcagcatacctcataatgtggttatatacatgcaatggaatattatgcagccttaaaaaagaaggaaattctgacacatactacaacatggatataccttgaggacattatgctaagtcagtcagtcacaaaaggacaactactgtatgattctastcaaaggaggtatctaatgtcaacactgtagaaacacaaagtacaatggtggttgttaagggccagaaagaggagagagaaggaattagtgtttaatgggcacagaatttcagttttgcaagaaaaataagttctagaggtcaacatattgtaccacaatgtgaacatacccaacgccactgatcagtacatttaacaatgtcatattaaatcaaacaaaatacatcatttagtttttggtagaaaaatctgttttgcccccagggtcacagtgaggggtaggacacaggaatccagaagaaatagaactgaggttgaaaaaggyggacgggagctgcatgcatttccttgttaatagcccagaatgtgccaggtgtgctttacaaatgctgctgcttttttttttttttttttkkrgrgagtctcactttgtcacccaggctggagtgcagtggagtgatctcagttcactgcaacctccacctcctgggtttaagcgattctcctgcctcagcctcctgagtagatgggattacaggcacctgccatcatgcccagctaatttttgtatttttcgtagagacagggtttcaccatgttggccaggctggtcttgaactcttgacctcaggtgatctgcctgcctcggcctctcaaagtgctgggattacaggtgtgagccaccacgccyggctaagcctktttttttcagatggagtcttactgcgtcacccaggctggagtgcagtggtgcgatctcagatcactgcaacctctgcctcctaggttcaagtgattctcctgcctcagcctcccgagcagctgggattacaggtgcacaccaccacgcctggctaatttttgtatttttagtggagacggggtttcaccatactggycaggctgggcttgaactcctgacctcaagtgatctgccctcctcagcctcccaaagtgctgggattacaggcatgaggcactgcacccagctcaaatgcttattaacatccacaacagtccagtgatgtaagctactttaggctcatttttccggtgaggaaactcagtcacggagatgtttcgttatttgttcaggacccacagcgacagagcacagatttatctcattttctgatttcccaggaacctctgtgacccccagccggttaccaacagaaccaccttccycggtagcaggtaggttctgcagggtccattctggtgcacagcgtatgaggtacacggaccccttctctctctcctctctgcctagacttctcgatttaattcagttggttctttcacagatttgctttgttttaaaaatcctttatttctgcctgtaaacagggtgggtgtcctaagtagttagatgttaagatgctgcccccaatcctactctaggtggatggtttatcacatataacatgcagaagaataatcggagtggcttgctatactgtggagtccagctggttgaatatgggtgacaaaaacaaacaaactaaccaaccaaccaaccaaccaaccaaccaacaaacctgtagagtccgggactctgtttctgagtcactgawtgcattgatcagcggttctcaaacttccatgagcataagaatcacctggaggcttaaagaatagatttctgagcccccagggcttctgcttcagtaggtctggggtgaatccagtcattttcattcctagtaagttcccaggtgatgctgatgctatggctccagaatgctgctttgagaaccactgcggtaagttttgtgtgaggcgtgttatcccctccactttcacaaacrtctcagctgaatacggtgtaccagactacggcctgcactttaagaatatcatacgctaggctggaggctgggcgtgtctaacattccctgygtctcagagtgaagcaccaaggcaggagaaacatgctggaaagagccgaggttgataaggatgagatttgcggggttgagggcagagtgagggctattatgcctagtgggcagggacatggaagatggtcacatactgtgtgcgtgcatrtgygtgtgtgcgtgcatgtgcgtgtgtgcgtgcatatgtgtgtgtgcgtgcatatgtgtgtgcatgcgtgcatatgtgtgtgtgtgcatgcgtgcatatgtgtgcgtgtgcttctgactgaatttttgaactttctcttttgaaatggttctagagtcacaggaagtctacaatgatagaacagaagaatcccatgtgctctttttccagtttcctctaatggttacatcttacgtaattagagtacaacataaaaaccaggaatttgacattggcataaagtaggtgtctagttctatgccaatttgtcacagttgtagattcgcgtcaccatcaccgcagtcactgtacagaactcttccgtctcacaagggcctcccttgggctacccttttatattcacacctacacccttctccttcccttgccatccctaactcctggtatccattaatttgttctccatctctataatcttccatttctagaatctgatgtaaatgggatcatccagtatgcaaccgtttgagatatccttttgtcactcagtgcaatgcccctgaggcccatccaagctgctgtatgtatcaatgatgtgttccttttgattgctgagcartatttcatgctatattaggccgattttgtgctgctataaatayctgagactggatcattgataagaaaagaggtttaattggttcatggttctgaaggccgtataggaagcagaaggctggcttctgcttttggggaggcctcaggaagcttacagtcatggcagaaggcaaagagggggtagctgtctcatgtggtgggagcaggagcaagagagagagagagttgggactgggggacatgccacactttgcaatagccagatcttgtgagaattcacttactattgcaaggaaagcaccaagcaatgagggatccacccctatgatccaaacacctcccaccaggcccccacctccaacattggggatcataatccagtatgagatttggtgggaacacatattcaaactgtatcacatggcatgcaaataccacacgctgtgttgaaatcaaaatcaaaacaaggtgtattaaatagggaatcctttccccattgcttgtttttgtcaggtttgttgaagatcagatggttgtagatgtgtggtcttatttctgagatctctattctgttccattggtctatgtgtctgtttttgtaccagtaccatgctgttttggttactatcaccttgtaatatagtctgaagtctgagcctgaggcctccagctttgttctttttgcttagtattgtcttggctatatgggcccttttttggttccatatgaattttatagttttttctaattgtgtgaggaatgtcaatgatagttcaatgggaatagcaatgaatctataaattactttgggcagtatggccattttcacgatattgattcatcctatccatgagcatggaatgtttttccatttgtttgtgtccgctctgattttcttgagcagtgaattgtagttctccttgaagatgtccttcactttccttgttagctgtattcctaggtattttattctctttgtagcaattgtgaatgggagttccttcatgatttggctctctgcctgtctattgttggtgtataggaatgcttgtgatttttgcacattgattttgtatcctgagactttgctgaagttgcttatcagcttaagaaacttttgggctgagatgatggggttttctagatataggatcatgtcatctgcaaacagagatagtttgatttcctctcttcctatttgagtatcctttatttctttctcttgcctgattatcctggccagaacttccaatactatgttgaatasgagtggtgaaagagggcatccttgtcttgtgctggttttcaagggaaatgcccatttagtatgaaattggctgtgggttaataaatggtgctgggagaattggctagccatatgcagaaaatagaaactggacccgttccttacaccttgtacaaaaattaactcaagatggatgaaagacttggatgcaaaacccgaaaactataaaaaccctagaagaaaatctaggtaataccattcaggacacaggcatgggcaaagatttcatgacaaaaacgtcaaaagcaattgtaacaaaagcaaaaactgacaaatgggatctaactaaactaaagagcttctgctcagcaaaagaaagtatcatcrsagtgaacagacaacctacagaatgggagaaaatgtttgcaatctatcaattcacaaaagtctaatatccagaatctacaaggaagttaaacaaatttacaagaaaaaaaaaaccattaaaaagtgggtaaaggacatgaacagtcacttctcaaaagaagacgtttatgcagccagtaaacatacaaaaaaaagctcaacatcaccaatcattagagaaatgcaaatcaaaaccacatttagacaccatctcacaccagtcaaaatggcgattattaaaaagtcaagaaacgccgggcgcggtggctcacgccggtaatcccagcactttgggaggccgaggcaggcggatcacaaggtcaggagatcgagaccatcctggctaacacggtgaaaccccgtctctattaaaaatacaaaaaattagccgggcgtggtggcgggcgcctgtagtcccagctattcgggaggctgaggcaggagaatggcgtgaacccgggaggcggaggttgcagtgagccaagattgtgccactgcactccagcctgggcgacagagcgagactccatctcaaaaaaaaaaaaaaaaaaaccaacaaaagtcaagaaacaacaagtgctggcgaggctgtggagaaataggaatgcttttacactgttgggaatgtaaattagttcattgtggaagacagtgtggtgattcctcaaagacccagaaccagaaatcctttttcctttttttttttttgagatgtagtattgctcaatagcccatgctggagtgcagtggtgcgatctcggctcactgcaacctccacctcccaggttcaagcaattatcctgtctcagcctcctaagtaactgggactacaggcgcctgccaccatgcctggcttttttttttttttttcttttagtagagatggggttttaccttgttggtcatgctggtctcaaacttctgacctcaggtgatccacctgcctcggcctcccaaagtgctgggattacaggcgtgagccaccgcaccagggccaccttttttttttttttttttttttaaacagagtctcactctgtcacccaggctggattgcaggggcatgatctcggctcactgcagcctctgcctccagggttcaagtgattctcctgcctcagcctcccgagtagctgggactgcaggtgcatgccacaacgcctggctaatttttggatttttgctagagacgggagtttcaccatgttggccagggtggtcttgagctcctgacctcaggtgatctgcccacctcggcctcccaaagtgctgggattacatgtgtgagccactgcgcctggccagaaataccatttgacccagcaatcccattactggttatatacccaaaggaatataaatcattgtattataaagatacatgcacacatatgttcattgcagcactattcacaatagcaaagacaaggaatcaacccaaatgcccatcaatgatagaaaggataaagcaaatacagtacatatacaccatggaatactatgcagccataaaaaggaatgagatcatgtcctttgcagggacatggatggagctggaaaacattatcctcagcaaactaacacaggaactgaaaaccaaacactgcatgttctcacttgtaagtggcagctgaacaatgagatcacatggacacagggaggggaacaccacacactggggcctgtagggggaattgggggagggagaggatcaggataaatagctgatgcgtgtggggcttaatacctaggtgatgggttgatgggtgcagcaaaccaccatggcacacgtttacctatgtaacaaacctgcacgtcctgcacatggattctggaactgaaattttaattgaaaaaaaaaaaggtttattaatgcatctcacacgaagagaaataacaaagaccaaataatacccacactctcattatgccaccgagagctgagcataaactagttttttccaagctggttccaccataaaaagactcccaggatagtacccactgcaacaagagcttcgtatttatcagctgaggcagttcaggaatattttggtggcctcaggaggcccctggttaagaaaatggcctggccgggcgcggtggctcacgcctgtattcccagcactttgggaggctgaggcgggtggatcacaaggtcaggagatcgagaccatcctggctaacacggtgaaaccccatctctactgaaaatacaaaaaaattagccaggcgtggtggcgggtgcctgtagtcccagctactcgggaggctgaggcaggataatggtgtgaacccgggaggcagagcttgcagtgagccgagattgcaccactgcactccagcctggacgacagagtaagactctgtctcaaaaaaaaaaaaaaaaagaaaaaaagaaaatggcctaagttggaaggtggagatcccgtgttctgaggctaacacgagctcattcttcctctaggctcacgaagacatggatccacatcttattattcaaactgagatataattcacataccataaaattcaccatgccaactaggatgactatgatttttaaaacaaaacaaacggacaagaagtattggtgaggatttggaagaaccttcttatattgctggtgggaatataaaatggtgcagctgctttgaaaaacagtctgtggccaggcgcagcctgtaatcccagcactttgagaggccaaggagggtggatcacgaggtcaggagatcgagaccatcctggccaacatggtgaaacccygcctctactaaagtacaaaaaaaaaagttggccaggcgtgatggcaggtgcctgtaatcccagctactcgggaggctgagggaggagaatcgcttgaacccaggaggtggaggttgcagtgagctgagatcgcgccactgcactccagcctgggcaacagaatgagactctgtctcaaaaaaaaaaaaaaaagaaaaaaaagaaagaagtctggtagttcttcaaaaagtaaaacacagagttactgtatgacccagtgattccaccacccctgggtgtgtacccaagagaacagaaaacttatgttcacacaaaaacctgtacgtcaatgttcacagcagcaatattcataacagcaaaacgtggaaaaaaaaccaagtgtctatcaattgctgaacggatctgcttcttactaagccggtcatggaagataagtcttacacctttcgaatttgtctgtcttcagtgtctgtgcagtgtgtcagagaaaggggtttcagggagcctagatatctcaaaaggggaatggagatatctagaggatatagggaaccacggggaagacctaacattgttttgctttcttagaattctcagaagccaccgctgaactgaccgtctcattcacaaacraagtcttcacaactggtgagtaaccaggcatttcatgctcagcagaaaggagtgtgaggacggagctctctcttccattatctaagcctgtaggctttyaaycacttcaccgaactgtccgtctcttaccaagaaagtccttggtgtgaggctagagcatgggtgcagagtggagctctggggttcagaaggaggagcrttttgggtgatggggccatttcaaagatggcggagccaaggctgtggcgggacgaccgccatccctacgcactgctcccaggatgaagtcctaggctttggactcggctgtgatccaggtatttaatctcgctcctcactgtgtccaggtagagcccatgctcggacgcacacagactgtaggcacctggacayagcacatcttctaaccgctccaggcctctgcagatacgctttcctcagtctctttccccttgcctgtcctggaaaatctccatttccttccagactaaacaccttcacagattccctgataataggttagatacttccactgggcccacatgactctggctttcatgaggcacctgatcccacgtagttctatttttattttttatttttttgaggtggagtcttgctctgtcgcccaggctggagtgcagtggtgcgatctcggctcactgtaacctctgctgcccgggttcaagcgattctcctgcctcagcctcccgagtagctgggattataggtgcatgccaccacacctggctaatttttgtattttagtagagacggggtttcagcatcttgggaaggctggtcttgaactcctgacctcatgatccacctgtctcggcctcccaaagtgctgggattggaggcatgagccaccgcgcccggcatatcccagggagttctgtgatggaagccttccctatcttcagttcggaacctcccaatcaccctcagsatgcagttccaattcctcagcttgctattctgtgagcttagatatccagcccctgttgatccctccaattttgtctgcataccttccacgcattcccatgctgttctcagccacacacagtcacttgaagctctcctggaggcttcctaacctctcctgactctgcacccaacccactcactctgccttttcttccatttccccatggcatcaattcctcaagaaagccttgaccgtccaggctggatcgatggtttcctctgctctcgctcagtgtcttgtgggctgcctattacagcaatttttacagtatattaaaattatcgctttgtctgtaatcccagcactttgggaggccaaggtgagtggatcacctgaggtcaggagaccagcctggccaacatgctgaaaccccgtctctactgaaaatacaaaaattagccgggcgtggtggtgggcacctgtaattccagctacttgggaggctgaggcaggagaatcgcttgaactcacgagttggaggttgcagtgacctgagatcacaccacagcactccagcctgggcaacagagtgagactccgtattaaaaaaaaaaaaaaatcgctttactttttggtctcctgcaatagtctgggaaccgcagatggacaatgtcttatggtttttttgttttttgttgttgtttttgagacggmgtctcactctsctcactctgtgatctgtgatttcggctcactctgcgatctcagctcactgcaatctccggctcctgagtagctgggactacaggtgtgtgccaccatgcccagctattttttgtatttttagtaaagacggggtttcaccatgttggccaggatggtctcgatctcttgacctcasgtgatccgcccaccttggcctcccaaagtgctgggattacaggcattcagccagtgtcatgcctggcctgacaatgtcttattaatatttgggttcccatggcccagcacatggctgagtacctggcgagtctcaggagatacttgaggaataagagagctggaggccgggtgcagtggctcacgcctgtaatcccagcactttgggaggcctaggcgggcggatcacaaggtcaggagttcaaaaccaacctggccaatatggtgaaatcccatctctactaaaaatacaaaacttagctgggcgtggtggcggacgcctgtagtcccagctactcgggaggctgaggcaggagaatcgcttgagcccaggaggcggaggttgaagtgagccgacatcgggccactgcactccagcctgggagacagagccagactctgtctcaaaaaaaaaaaaaaaaagctggcacgtatgaggtgctcatatgtcaagcacggtgctttatatttctaccattattattatcttgactttcacatcaacctataagggatcttgttaattttattggacacatggggaactggctcacagatgctgagtcacttgccagataactgacatctaataggtgatagagttggggttcaaatctggaggacagcctgactctacagttcttgcttttttttttttggacagggtctcgctctgtttcccaggctagagtgcagtggtacaatcctggctcactgcagcctcaacctcccagggctcaggtgatcttcctgcctcagcctccactgagtagctgggattactggcacgtgccaccacgcctggctaatttttgtatttttttgtagagatagggtttttctatgttgctcaggttggtcttgaactcctggactcaagccagcctcctrcctcagcctcccaaagtgctgggattataggcatgaggcaccrtgcccggcccatgcttttcttaaatgctgtggaattgtgcctcmccatgtgtgtgtgtgttcggagtaggcacagtgacagggggcgggaatatggtttcatttcacacttagcctttgtttggttcccagagacttctaggagtatcaccrccagtccaaaggagtcagactctccagctggtgagtaagtcatcctctccagacccccttccttctcacccgtctcttcaccaaagccaactcctttgtctacgcaggggctgcagctctcagatcttgggttccagtgtgtagagtaaaggcagaatatcagcgtatggggttcagaattgggcattaagatcaggtgggaaggttgagattttaaaaagggtcagagaaagagagattccatctctyccccascccttataactgtcctctcttttgcaatgcatcagataacgaggcagcatctgtgtctggggaggagttgtctcagagccctgtgagagcacaggagggagaggtgctacttagagaattggggtcatctggccctgacccctactcgggaagggagggaccctccaggaaagtgagcggcatcccctagctagtagagaataataggatctctgagaagcccagatgtggcttggagggggtcctggaggtgggctctttcacctgctcctgcctctcctcattcctccaggtcctgcccgccagtactacaccaagggcaacctggtccggatatgcctcggrgctgtgatcctaataatcctggcggggtttctggcagaggactggcacagccggaggaagcgcctgcggcacaggggcagggctgtgcagaggccgcttccgcccctsccgcccctcccgcwgacccggaaatcahacgggggtcaggatggaggccgacaggatgttcacagccgcgggttatgttcatgaccgctgaaccccaggcacggtcgtatccaagggagggatcatggcatgggaggcgactcaaagactggcgtgtgtggagcgtggaagcaggagggcagaggctacagctgtggaaacgaggccatgctgcctcctcctggtgttccatcagggagccgttcggccagtgtctgtctgtctgtctgcctctctgtctgagggcaccctccatttgggatggaaggaatctgtggagaccccatcctcctccctgcacactgtggatgacatggtaccctggctggaccacatactggcctctttcttcaacctctctaatatgggctccagacggatctctaaggttcccagctctcagggttgactctgttccatcctctgtgcaaaatcctccygtgcttccctttggccctctgtgctcttgtctggttttccccagaaactctcaccctcactccatctcccactgcggtctaacaaatctcctttcgtctctcagaacgggtcttgcaggcagtttgggtatgtcattcattttccttagtgtaaaactagcacgttgcccgcttcccttcacattagaaaacaagatcagcctgtgcaacatggtgaaacctcatctctaccaacaaaacaaaaaaacacaaaaattagccaggtgtggtggtgcatccctatactcccagcaactcrgggggctgaggtgggagaatggcttgagcctgggaggcagaggttgcagtgagctgagatcacaccactgcactctagctcgggtgaygaagcctgacyttgtctcaaaaaatacagggatgaatatgtcaattaccctgatttgatcatagcacgttgtatacatgtactgcaatattgctgtccaccccataaatatgtacaattmtgtatacatttttaaaatcataaaaataagataatgcaccgtctccacccctctcatatttactttctgaaggaaatgttaggtcttctcaaggtaaagttctatatttattatagcgtttaggcatttcttgaccatctaatgagtgtaaaactgtaccactgggccaagtgcagtggatcatgtctgtaatcctagcactgtgggaggccaaggcaggaggatcgcttgagcccaggagttcaagaccagcctgggcaacatagtgagaccccatctctacttaaaataaagaagataaaaattgttttaaaaaaggaaaagaatggctggccacagtggctcaygcctgtaatcccggcactktgggaggttgaggkaggtgagtcacttgggaaaagacagaaggatggcaccaagaagttccaggacgacggctgtgaatcagggctagtgagcacacagcttgggtgaagggggaaygggaaagttgcttagagaagcctccaaatgtaagaatgggtcaattcctcgtcttaacatagtggaaaatcatactgagatgctatcagaaracagaggaaaaataattttagaggtcaagtaaactaagtagattttaaaaagaccagtatagcctaggcacagtggctcacacctgtaatcccagcactttgggaggctgaggcgggatcgcttgagcctaagagttcgagaccagcctgggcaacatggtgaaaccttgtctcatatacaaaaaatataaamaattagctgggtgtggtaccacatgcctactctcaggtactcaggaggctgaggttggggatcacctgagcccggggaggttgaggctgcagtgagccatgattgcaccactgctstcaaacctgggtgacagagtgagaccctgcctcaaaagaaaataaaaataaaaaacaaatrtaaactttaggggaacaataacaacaacaaaaataaaagaagcaagttatattacccgaaaattctcrgctgcgaatatctgtgggtataaacatgtgatactggccgggcgtggtggctcatgcctgtaatcccagcacttcgggaggctgaggtgggcagatcacgaggtcaggagatcgagaccagctcagccaacatggtgaaaccctgtctctactaaaaatacaaaaattagccagtcgtggtggcacacgcctgtagtcccagctactcaggagactgaggctgcagtgagctgagattgcgccactgcactccagcctgggtgacagagtgagactctgtctcaaaaaaaaaaaatgtgatactgaatgttgatatgcagacatagagataaacattggaagagaaaaaacagtaagaacaacgctgtagaataactaaggccccgcctattatgataggaatccagtaagtctaagctcattcacatggttacatgtttttagaaacctaatattaacaagttcctaaagaaaacagctaaaagtgggtgtctcttaggcggagcaatggaggagatggttagtcagccactgcattttgtacacacccttttagtgctattggaattttttaggtaggtgctgtcaggcctctgagcccaagctaagccatcatatcccctgtgacctgcacgtacacatccatatggctggttcctgccttaactgatgacattccaccacaaaagaagtgaaaatggcctgttactgccttaactgatgacattgtcttgtgaaattccttctcctggctcatcctggctcaaaagctcccctacagagcaccttgtgacccccactctgcccgccagagaacaaccccgctttgactgtaattttcctttacctacccaaatcctataaaacggccccaccccatcccccttcgctgactctcttgtcggactcagcccacctgcacccaggtgattaaaagctttattgctcacacaaagcctgtttggtggtctcttcacatggacgcacatgaaatttggtgccgtgacttggatcgggggacctcccttgggagatcaatcccctgtcttgctctttgctctgtgaaaaagatccacctacgacctcaggtcctcagacccaccagcccaaggaacatctcaccaagtttaaattgggtaagcgacctcttcttactctcttctccaacctctctcactgtccctcaaccactttctcctttccactcttcaatctctcccttctcttaatttcaattcctttcattttctagtagagacaaaggagacacgttttatctgtggacccaaaactccggcgccggtcacggactagggaaggcagccttcccttggcgtttaatcattgcagggacgcctctctgattatatacccacgtttcagaggtgtcagatcacgcagggacgcctgccttggtccttcacccttagtggcaagtcccacttttctggggaaggggcaagttccccaacccctcctctccatgtctctaccccttctccacctttctggggggcaagaaacccccaaccccttctccttcactcttagcggcaagtcccgcttttctagaggggcaagtaccccaacctcgtatctctgcaccctgatcccttatttccatgccccaacctcttatctctgcaccctgatcccttatttccatgccccaacctcttatctctgtgccccaaccccttatatccatgccccaacccctttcccgcttttctggaaggtaagaactcccgaaccccttccctccgtgtctctactctctcttttctctaggcttgcctccttcactatgggcaaccttccaccctccattcctcctcctctctcccttggcctgtgttctcaaaaacttaaaacctcttcaactcacacctgacctaaaacctaaatgccttattttcttctgcaatgccgcttgaccccaatacaaactggacagcagttccaaatagccagaaaacagcactttcaatttttccatcctgcaagatctaaataattcttgtcgtaaaatgggcaaacggtctgaggtgcctgacgtccaggcattcttttacacatcagtcccttcctagtctctgtgcccagtgcaactcgtcccaaatcttccttctttccctcctgcctgtcccctcagtctcaaccccaagcgtcgctgagtctttctaatcttccttttctacagacccgtctgacctctccctcctccccaggctgagctaggtcccaattcttcctcagcctccgctcctccaccgtattatctttttatcacctcccctccccacacctggtccagcttacagtttcgttcagtgactagccctcttccacctgcccagcaatttactcttagaaaggtggctggagctaaaggcatagtcaaggttaatgctcctttttctttatcccaaatcagatagtgtttaggctctttttcatcaaatataaaaatccagcccaattcatggctcgttcgccagcaaccctgagaagctttacagccctagacccttaaaagtcaaaaggccgtcttattcttaatacacattttattacccaatctgctcccgacattaaataaaactccaaaaattaaattccagccctcaaaccccacaacaggatttaattaacctcaccttcaaggtgtacaataatagaaaaaagttgcaattccttgcctccactgtgagacaaaccccagccacatctccagcacacaagaacttccaaacacctgaaccacggcggccaggcgttcctccagaacctcctcccccaggagcttgctacaagtgccagaaatctgaccaccgggccaaggaatgcctgcagcccaggattcctcctaagctgtgtcccatctgtgtaggaccccactggaaatcggactgttgaactcacctggcagccactcccagagcccctggaactctggcccaaggctctctgactccttctcagcttagcggctgaagactgatgctgcccgatcgcctcggaagctctgtagaccatcacggatgccgagcttcgggtaacactcacggtggaaggtaagtccgttgccttagtcaatacggaggctacccactccacattaccttcttttcaagggcctgtttctcttgcctccataactgttgtgggtattgacggccaggcttctaaacccctgaaaactcccccactctggtgccaacttggacaacactcttttatgcactcttttttagttatcctcacctgcccagttcccttattaggccgagatattttaaccaaattatctgcttccctgactattcctggactacagccgcatctcattgccacccttctcctcaacccaaagcctccttcgcgtcttcctctcctattcccccaccttaacccacaagtatgggacatctctactccttccctggcaaccgatcacatgcccattaccatcccattaaaacctaatcacccttaccctgctcaacgccagtatcccatcccacagcacgctttaaaaggattaaagcctgttatcactcgcctgctatagcatgggcttctaaaacctataaactctccttacaattcccccattttacctgtccaaaaaccggacaagtcttacagattagttcaggatctgcgccttatcaaccaaattgttttgcctatgcaccctgtggtgcccaacccctacactcttttgtcctcaataccttcctccacaactcactattcccatgcttgatcttaaagatgcttttttcactattcccctgcacccctcgtcccagcctctcttcgctttcacttggactgaccctgacacccattaggctcagcaaattacctgggctgtactgctgcaaggtttcacagacagcccccattactgcagtcaagcccaaagttcatcctcatctgttacctatcttggcataattctcataaaaacacacgtgctctccctgctgatcgtgtctgactgatctctcaagccccagcaccttctacaaaacaacaactcctttccttcctaggcatggttagcgcggtcagaactcttacacaagagccaggaccacaccctgtagcctttctgtccaaacaacttgaccttactgttttagcctagccctcatatctgcgtgctgtggctgccgctgctttaatacttttagaggccctcaaaatcacaaactatgctcaactcactctctacagctctcataatttccaaaatctattttcttactcacacctgatgcatatactttctgctccctggctccttcagctgtactcactctttgttaagtcccacaattaccattgttcctggcccggacttcaatctggcctcccacattattccagataccacacctgacccccatgactgcatctctctgatccacctgacgttcaccccatttccccacatttccttcttccctgtttctcaccctgatcacacttagtttattgatggcggttccaccaggcctaatcgccacacaccagcaaaggcaggctatgctatggtacaagccactagccagcctcttagaacctctcatttcctttccattgtggaaatctatcctcaaagaaatcacttctcagtgttgcatcagctattctactactcctcatggattattcaggccccctcccttccctacacatcaagctcaaggatttgcccccgcccaggactggcaaattagctttactcaacatgccccgagtaagataactaaaatacctcttagtctaggtagacactttcactgggtaagtacagtcctttcctacagggtctgagaaggccaccgcagtcatttcttcccttctgtcagacataattcttcagtttagccttgtcattcccttctgtcagacaaaattcctcagttcagccttcccacctctatacagtctgctaacagaccagcctttattagtcaaatcagccaagcattttttcaggctcttagtattcagtgacagactaatggtctattaaaaacacacctcaccaagctcagccaccaacttaaaaaggactggacaatacttttaccattttcgcttccagaattcaggcctgtccttggaatgctacaagatacagcccatttaagctcctgtgtagacactcctttttattaggccccagtctcattccagacaccagaccaacttagattgtgccccaaaaaacttgtcatccctactatcttctgtctagtcatactcctawtcaccgttctcaactactcacacatgccctgctcttgtttacactgccagtttacactgtttctccaagccagcacagctggtatctcctggtactatccccataccgccactgttaactcttaaaataaataaataatctttgctggcaaggctatgctgaacctccttaggcactttctaattagatgtcctgagtcstcccaattcttagacctttaatacctgtttttctcctttccttattccctttagtttttcaattcatacaaaactgtatccaggccatcaccaatwattctaaatgacaaatgtttcttttaacaatcccacaatrtcaccccttaccacaaaatcttccttcagcttaatcgctcccactttaggttcccacgccgcccctaatcctgctcraagcagccttgagaaacatcacccattatctctccataccacccccaaaaatttttgctgtcccaacactttacccctatttcattttatttttcttattaatataagaagacaggaatgtcaggcctctgagcccaagctaagccatcatatcccctgtgacctgcacgtacacatccagatggccggttcgtgccttaactgatgacattccaccacaaaagaagcgaaaatggcctgttcctgccttaactgatgacattgtcttgtgaaattccttctcctggctcatcctggctcaaaagctcccctactgagcaccttatgaccccgactctgcccgccagagaacaacccccctttgactgtaattttcctttacctacccacatcctataaaayggccccacccctatcccccttcgctgactctcttgtcagactcagcccacctgcacccaggtgattaaaagctttattgctcacacaaagcctgtttggtggtctcttcacacggacgtgcatgaaaggtgcgtgtatatttttgtaacacaataaataataacagtatayactttttcttttagaagtatgctgttaaacagaattaagaacaggaagtctcaaaattgtttctttcaggagagaagacttattaatgggggagagttctgaaccacttgctttgcatactgccacttagttaaaaaatcgcattttaacttaaaaatatccaaaaataacacagttttataataaattattacgaatatcacaaaataataaaaatacaagtaatgcagagtggaaatgcaaagctatgagtgctagacggctaacaagtcataacaaacaacaccaaaattaaagaacaagatagttgtgacttaccttggtcaatcactttccatagtaattcaagtcattcaatccaggatctcatctctgaaaatgaaggaaaaaagcaacagaaaatagtgtagaggtctctggtgttccaagaataggcgctgcagagagatgtgggtgcctgggctgtgcccagtcactgaaatggcacacctgatgctacctgttcacttcgggctgagcaggagagagaaaagacgttcccctcagccacttcccgtcttctgatttcacttcttgcctgcctccgactgcaaatcctggtttgacgtcacttcctgtcttctgattttacttcctgtatgacctcacttcctgtcttctacaaccacttcctgtcttcttacttcacttcctgtcttctgactttacttcctgtatgacttcacttcttgtcttctaccaccacttcctgtcttccgaatttacctcctatcttgacttcacttcttgttttttttttttttttttgacagggtctcgctctgtctcctagggtggagtgcagttgtgccagcttgaaaccacctttccaaaattatgactgagacagtgaaagagatttaactgactccattttgcttctaacctccaagctgtcctttttcattcctgggcataggctgaactttgggagaaacttatagtttaaacaaagatgatagcccttttccaaagcacacctctttgttgcctggggactagattggccctgtaggacgaacattagccacgagattagaaattatgacttaggagtcatgcagctggaggctacaagattgtgaccctccctaaactgcttctaagaccagcgcttaatttgcagatgctgcacttgatgggtcagctggcaccacccagatcaataaactggcccatcttatcttttggcctccactcaggaactgagtgcaagaagatagctttggctcccacgatttcatccctgaccaaacagcactcctggctcactggcttcccacccacccaccaagttatccttaaaaactcttcctgaatgctgggagacactgatttgaataataataaaactctggtctctcgtagagccagctctgcatgaattattctctattgcgattccctgtcttgacgaatcagctctgtctaggcagtgggcaaggtgaacacattggactattacaatcttggctcactgcaacctccaccgcctgggttcaagtgattctcctgcctcagactcccaagtagctgagatcacagacgtgcactaccatgctcagctacattttttttttctgtcccccgggctggagtgcaatggtgcgatctcggctcattgcaacctccgccttccgggtttaagcgattctcctgcctcagcctccagagtagctgggattacaggcatgcaccaccaagcctggctacttttggtatttttagtagagacagggtttcaccatgttggccaggctggtctcaaactcctgacctcatgtgatccacctgcctctgcctcccaaagtgctgggattacaggtgcgatccaccatgcccagcccattccgtcttctgacttgacttcctgcctgacttcacttcctgaaggatgtggttaccatggaagttgttttggggcacaggatgtggtctgggattggggattgtgaaaagcaagaccctcaccggggtctttcttccagagctgcagctgagccacaggatcttgaacaggagagagttcttcctattcttgtggaagagctgaggattgagaaaagcgcggcttagctcatgggagtgaccttagctttgagaagcctgaaaatgaggcttggaggtagagagtggtgtgtgtgtgtgcgcgttgggggagggggtcaggctctcatgacttctggctcttttttttgctccaggaacatttcccaagcccaccatctgggctaacccagccctcgtggttcctgggtgcaaacatggccgtggaattgtggaatggttttttttgtatccttagcagagaacccagtgaatactttgttcttgatcatcaatgtgatgagatccagagcaagcaagtgctaatgctgctgtgagcctgaggccacattttcagaattcagtgatgggcggaggcgagtggtcacaggtatagggagagcagtacttgttcatctctgaacgtatagattcagacacacatgaacccatgtgccacaggtttccctgtttaggacttgtaggtcatgggggtgggcatctgagagtgtggctacatgaaatacacacgttggagaaagatggttaattgtgagtgcgagtttacatttcatgggcccctggggtgtcgatagttcctcaatggatgtagatccgttactcaatttcttctctaaagatggggctagattacaatggttctcaacctaagaaaactttgcatttcaggaaatattttctactgcccagagacatttttgatcactgttaactgtgaggatgtgagctggtatctagggggtagaggctagggatggtgccgaacaccctggaaatgtacaggacgtttcccaacgagtagtgatccgatcccaaatgtcaatagtgtggagaaggagaaacctttagtttcttcacgcaatgtcctttttaaactttgtgcctctctttttaccaaccttcccccttcttcccgctgaaactgagaataaagatgctctggaggccgggcacggtagcttatgtctgtaatcccagcactttgggagaccgaggcaggcagatcgcttgaggttaggggttcgagaccagcctggccagcgcggtgaaaccctgtctctactaaaaatgcaaaaattatccgggagcctgaggcagaattgcttgaacttgggaggcagaggctgcagtaagccgaggtcacaccactgcactccaaaccgggcaatggagcgagactgtcaaaaaaaaaaaaaatgctcagggaatgacccatgccgcattgaacaaggacaccttgaaccaggaaacctcagaagcccacactgtatgcagtggaactggaaagtgatggagtggtttaaaggtagtatcagagaacttggatctagtcggtgggaataaaccaatagcccctgatgaagaaatgaaagtaggaagagagattaacttttttagttttaaatttaaatattaaaactacttttgaccaggtgtggtggctcatgcctataatcccagcatttggggaggccaaggtgggcagatcacctgagctcaggagttcaagaccagtctggacaacgtggcaaaaccctatctctaccaaaaatgcaaaaattacctgggtgcagtggtgcacacctgtggtcccagctacatgggaggctgagatgggagaactgcttaaactggggaggtggaggctgcagtgacccgagatcgtgccattgcattccagcctgggtgaaagagcaagattctgccaccaaaaaaaaaaaaaaaaaaaaaaaaaaaaaagaaaaaaatgttgccaggtgcggtgacttatacctgtaatcccagcactttgggagaccaaggctggtggatcacctgaggtcgggagttcgagaccagcctgaccaacatggaaaaaccccgtctctgctaaaaattcaaaattagccaggcttggtggcacatgcctataatcccagctactcagtaggtcgaggcaagagaatcgcttgaacccggggaggcggaggttgcagtgagccaaaatcgtgccattgcactccagcctgggcaacaagaagaaactgtctcaaaacaaacaaaaaaaaacatgattagtgtttaataaaaatttgtactgttctttttcccccttaccgtccatttgtttgctcatccagtaaacacagacagcaacaaagtctccccatgagaagcaactttgccaactagtgttgtctttatagtacagttcgttttgtttgtggttttacagcgtagagcttgcactgctgctttgttgaatttggaattctgtatcacaaggaaataatggagactctatagtgaaaaactatgcataccatgagattttgtttttttttggagaaggagtcactctgttgcccaagctggaatgcagtagtgcagtcttcagcacagtgcaacatccacctcctgggtttaagcaattctcctgcctcagcctcccaagtagctgggattacaggcatgtgccaccatgcctggctaattttttatatttttagtagagacggggtttcaccacgttggccaggttggtctccaactcctgacttcgtgatccacccacctcagcctcccgaagtgctgggattacaggtgtgagccaccgtgcctggccgagattctattttaagttagaatttttaaaaagcaaaatcagagcaatgacatggtcatatatgagctacaccgaagcacctaaaatattgtagattggtaggagaaatcctctggcaagtaatactcagcaggcagtgatccacgcaggtcaacaagtaacaagacaggctaggcacagtggttcacacctgtaatcctagcactttgggaggctgaggcaggaatattacttgcgcctgggagtttgagatcagcctgggcaacatagtgagaccctgtcttcaaaaaaatcccacaaaaattggcctggtttggtggtgtgcacctgtagtcccagctactgaggaggctgaggctggaggatcgcttgaacctgggagcttgaggctgcagtgagctatcatcatgctgctgtattccagcctgggcaacagagcaacactcatgcttgaggaaaaagaaaaagaaaaaaaaaaaagccgggtacagtggctcatgcctgtaatcccagcactctgggaggctgaggtgggtggatcacttgaggtcaggagtttgagaccagactggccaacatggtgaaacctcatctctattaaaaatacaaaaaaatttagccgggtgtggtgggggatgcttgtaatcccagctactcaggaggctgagacaggagaatcgcttgaacctgccaggttgtagtaagctgagatcgtgccagtgtactccagcgtgggcaacagagtgaaactcagtctaaaaaaaaaaaaaaaaaaaagaaaagaaaaaagaaaggaaataccaaggcaaggcaaagattgacaaggcaatagaaatcaatgcaattaaacactgtcacttcccccaccccccaggttctacccagtaagatatcttttctctaacttgtcaaagcccattattaagtaacagcttcatttgtgaatgctctcacctttatttctctcaatatacccgtgatacagatatttcatatgtaacaaagataaggatgtgtgcaggtataaaacagaggcagaatcatggctaaaacatctagcccagcaatgaactcattatccctgaggggtaggggccggggaggagaggagtcacaggcagttcaccaacacctggaaaatcgatgacttcatggagaatgaatgactcggggggattcagatcatgaagtcatgagaagaaggcctttctgcccagggatgatgtttctcagtatcaataatcagttgtgggtttttttcttctatttcttccagcagcttattgagttcatcattaaagtcatcgattttcaacctggggtacaatgggggaagaaaaggttactttgtgcatcaaggagatttgtttcaaattcccaagtacctgaaagtctgttaaggaggcacagggcatgggtcacctttcctgattattctaggtggcaaaggagtgttccacattgattttttttttttttttttaaaagacagtctcaggtggggcgtgatggctcatgcctgtaattcccagcactttaggaggctgaggcgggtggatcacgaggtcaggagatcaagaccatcctggctaacacggtgaaaccctgtctctactaaaaaaatacaaaaaattagccgggcgtggtggcggacgcctgtagtcccagctactcaggaggctgaggcaggagaatggtgtgaacccgggaggcggagcttgcagtgagccgagatcgtgccactgtactccagcctgggcgatctcaaaaaaaaaaaaaaaaaaaaaaaaaaaaaa

SEQ ID NO: 17659 - DNA, 23672 bp, Homo sapiens
cttaagctagtggttcagcattagtgccttacaaatgttaactgctgttatctcattcatcttttgtaacaactgtgtgctgtgcaacaagggtgacaactggtatgcctgccagagctgggcaggtcacacaaacagacgaagtgggctgccagtgatggggcccaggcaggtgagacagtaagagcccccatttaaaggcattctgctcaacattgttacataataatctatggcatgaaactcacctatggaggcgagagctccttgttgctcttgatgtcaatggaaaaaattgaccatgacctacctggtccttaggtggggttaacagctattctgaaagaagaatgctgatttgacaagaactgggcgtgaagccaaccatgtggtctagaaaggacacaattgcctttaagccaaggcctaagcctatcaagactgagttaatgaggctgccccatcaagccagcggaggtcagccctcaccagccctggctggctctctggctgcagagttgctgagcagggctggagaacagaccaaatggggccagccaagttcgcacatcctcagagccacccgctcaagtgtttagctctcctggggtgattgacttcagtgggagcgtggctctgccatgattcagacttctggcctccagaactgtgagagagtgaattcctattgtttcaagccacccagtttgtggtgattaattatggcagccaactaacattcctcttttcctccaatttcataagaacaggtgttgctcttcttgacactcagctgtgtgttctcttggcctcctgctccctgggggagtctccttccattaataaccacctttaacctccctttcagcttcttcccccaaacctgggaagtccctccttccaagccacagctccctctgccccacctccttcccagccttctcatcaagaagcaatctgccttgaccatctctttgacttctcagcctgctggccctgggctcctgctcccaccttcccacccagatcaccctggtggattccatggaccagtgaccatcctcatctacttgaatgttctgctgcatctgacactgacagtgacatcccttgtcctcccttgtttactgccctggtcctcctccttcccagccatcatcacctttgtgagctctctccctctctgctcaggcttatgccgagggtctcagcgttctatgcttcatcctcttctcttgtcctctccttgccccaggacacccctgatcccatgtgcttccttcattttatttcctgtctctgttcttgcctccaaatctctctttagacccattcacctgtgtcatctctgccagcaggcaccacaggcccttcaggctcactaggtccaaaactgaactcatcatcctccatacaggcttccaaaacctacccctcagctcacaccaggtccattctccttccttaatgtgtctcctcctctccagcctcacccccgcttccttggcccacaccaccatcatctctcgcttggattatcacagcagtgtcacttggtcctgtcttgatctccaggtgaccatacccgtgacagcccaagataatttatccctcctttacttacagaatgaagttcaaccctggttcccaacccagcaggacttccaagccctccatctggccctgatctggcttctctctgtcctcccttcctcctctctgatgggctcccggtgccccaccacccccttagcctgtactgctatcactcctgtggttctctcagcccaaaatgcagcctcccactgctgtgctgtaagctattctgtctgttcactcctctccacccagccagggctgataaaaacctagacaaggttcaaaaacccagatccaaggtcaccaccttcacaaagcttttcctattccattcctctctccaaccacgggagaatggaccattcctccctgtgtgtctttattgtggagacatgtgtcagagcatcgactctctatctttagttcatctattgagatattgatctctcttcttgaggccaggggtattttctgggacatggttagatctcaataaacattgatactggagggatgaaatgaaggaaggatggatagaaggctataaggatgggtggatggataaatggatggatggatggatggatggatggatggatggatagatggatggatggaaaaatggatagatggatgggtggatggatgaatggatggatggatggatggatggatggatgaatggatgaatatatgggtggatggatggaaggaaggaaggaaggaaggaaggaaggaaggaaggaaggaaggatggtagaagaaaggtagtaccagtatgctttagctcatgcaggcaaacagatgatgggcagagggaagcatggtggctgattacaggaggatcatagcagatgtttaaggcaagattgacagccccacaaagactgagaagagaagataagaaaaatgggaaagttattaagacacaagacctagatcaggagctagaagctggatcccagaacaaggcaagagcctaatgactcgagtagccaactcatcccagtttgccaaggtctttgccagttttagcactgaatatcccacaccatcggaaattactcagtcccagcaaattggaatggttggtcaccctactagtaattaagaccagtgccccacttcagagcagaagcatcagccaggccctgagtgacatcttgtaggctcttgaactggtctcactcaatccccatgaggcccagtaccatggaacagagggcagggaggctgagggccaagcagaggagcacctgtgctcagcagggcaaggcatcacaggggccaacattggtttccctgcccttctcccagaaaccacctccccactttgatcctttcccatgccctgctaggctctaggacaccaaattctcatattctagccactggccctccctaggcagtcaccctgggtgttatggactgaattgcttctcccgcaaattcttatgttgaagttttagccctcagtgtgactgtagagattgggcttttagggaggtaattaaagttaaataaggttataagggtggcactctaatctgataagattggtgcccttttaagaagaggaagagtaatcagagagctcgctctcttcctctgcccaatccctctcttggggggtgtgtgtgtgtgtatgtgtgtgtgtgtgtgtgtgtgtccagtgtgggctcacagggaagaggtcatgggcgaacagagtgaaggcaaccatctataagtgccagagagccctcaccagagaccaaccctgacggcaccttgaccttggatttccagcgtccagaactgtaagaaaatacatttctattgtttaagacatccagtgtgtgtttaagccaggccagtgtgaggtattttgttacagcagccagagaagactgatacactggggtgccatgcccccgagactccttccaaatctctcctttcaaaacgcaccaccctcagtcctgattccttcagagctctttctgcatggcagtgggagtcatgagttacctcagactttcccccaaattctcaagacattccttaagatgtaagcttgggaaacggcatgtgatgtctttccctcgtgggtggtcagagcacagacagcacacacaggctggagacggcccacaggaaaggtgggctaaccacctttcccaaagtagtttcatctggaacccatttgggcggtgttacactagtttctgatggctgctctaagaagttatcacaaacagtggctcagacaacacaaaattcttctttcatggttgaagaggccagaggcctcactgggctagaatgaggatattggcagggctccactctttctggaggctctaggggaggatccattcctttccctctccagcttctagaagcttcctcactccttggcacctggctccgacatcacattgacttttcccttcctgcttctaccatcacatcaccttcttctgactccaatctcctgcctctttcttgcaaggatccttgtgattgtaattaggacccagctggataatccatgacaatctcttcaagatccttaacttaatcacatctgcaaagtcccttttgtcatagaacgataacattcacaggttctgggtattaggacacggataacttcggggttccattactcacccataactggtatgcagtgctgatttccatcctgtaggtacggtttagggatctctaggtcaatgagataatggactcttgctcatgttacatggcataatgggaagaaagccaaacctagaaaaagagggactcaggttcccttgttagagcctcttcttactaactgtgggattaggggctgattccctgacctgctgtgttctgtcttctctccaattcaatgggaatgaactgtgagggcactgagcaaaaactaaggtctcaatacctagtagtagtgggacttgcctctggatacccagtagtgatcctgccgcctgtttctggatatcctacagtagcaatcccacctgtttctggatatcctacagtagtgatcctgcctgtttctggatatcctacagtagcaatcccgcctgtttctggatatcctacagtagtgatcctgcctgcttctggatacccagaagtgatcatgcctggttctagatacccagtagtgattgtgtttcctctagatacccagtaggtattgtgcttgcttctagagatgtagtagtagctggacttagctctagatacccagtgctcatctctagactgggctgagatcagtgtctcccttgaagggttattgtaaggatgaaaaaagataatgcgtttaaagcacttggtgtagtaggtggtctttttaaaagtgtgaataaatactagttcttattatttctgtggatatccaacagccacataattgggccccaaagccatgaagaaggaagaggaaatgtcttaaaggttgtcgatggacagtgtttgctgaacatcaaaatcactttccaggtattacctctgatttgctctaccaactccacaccccacctgcagccacataaccttccatgatcacggccatgcacaacacaccatgtcccccaggcaaggggaccttagaaacataaccaggcttgagacagcactctgcaccggtgtcttggaaatgctcttaagagtgtatggctgagttagggaaccaggatttcaaagtagaaagggagaatctacccaagcccatagaaatcctgaatccactcctttctcagcaacaagcactggcctgggagtcagccacttatgcaccaaccccactctgcccctaattaaatgcatgactttgaaaattcccctcattcttctgagccccaattcagtgattggtgcaatcacaggcttggctacagtgacccattcattgcaggcatggtgagactctcaatccctctcatttccactagaatctaactgttgggatctatgacccagtcagcatagcaggcctgtggggagctctcaggttcaagcatatgccccccctaatctacaagaaattagctgcagaaaaccaaggaatagaacctggaaaaagagagggtttgctagagctgtccctttccctgtctctggaatgccaacaatagggaggctctttggtcttgtctctcaggagtgcccatgccattccaggaaaatgatggcccagctggtggtgtaaggcttggggggcagcgagtgggcatcgtggtgaaagcctcgggatcagggagctgcgtctgcaggcaggcctgctggccggaaacctgccaggaaaggaaggggctgtcycggggcggggccagggaggggtggagacagggccggctgtggtcagtgacaaatgctggctgcaatccagccagccctctgccctttctgagcccgagggactgccacctccactgtgtgcacactcagctacgggacacagtaagtaccgatgccgcaaagggaggtccccagggcttgagggcatgtgaggcgaggagaggatggactctagagttttggggtttggggtctgcaaagctctgaaggagtctcatctctgcagtttcaggtatccaaggcagcagaggtgagtgggtcccccgagctctgtgaccttatgctccacactaactctggcagagcctccgtttcctcataggtaagatggaaataattacaccctctggatggtgtgactgaagattaaatacagcgggtgctctcactcagcacatctggccatgtctgcagacacatttggttgccacaactggaaggggggtgggggttagtgacatctagaggccagcgatgctgctgatgatcccacaatgcccaggacaagatcacaaagcatcatcctgttcaaaaggtcaacaggatcaaggttgagagaccctgaaataaggccatggggacaaaatgtcggctggataggaggtgctcagtaagtggcagcttctgttgttttctgtgcctggagtcttgggsctttagaaatcaggaacaatgatccaatattatcggcttccgtgagataagggcatcttgcctggaggctgccacccaggccggtcatggcagctgctcatgaaggacagtaacaatttggcagtttgttaaatgaacaaaatgtagaaataaagtaagcagaatttttagtttttctgaaggtagggcttttggccagatatgcagcaataaaagagcaaactgcttccttgggccagtgtccttgctcatagatcaggaaaccgaagcatgaagaatacaggcggcagatgcctgaaggtaacggacgtgttcatggtgctgacggtgatgataagtgacagatgtagactcatctccaaacttgtcaggttatagacattaaatatgtgcaactttatgaatagcagtcatgtctcaatcaagtggttttaataaagaaataataggaagccagagctgagagacagggagggagttgttcaaggtcacctggcaagtgagctccggggcggggagagctcagctctgggtggccagcctggctttttccactgctcagtgtccagcttgcagtctaatgtctctgaattacagagaaggagactggtcagttcattcattcattcattctacaaaggtttatggagcatctctcctgactgcaagctcttgaaggtgagagcagcacaaatgagggtcccatggagagagaggccggaatgaaaaatgtcaatgacaaatgcatatataaaggcacatgtgtaattgaaagagctttgagagaaagagtcaagggactgttccagagaatagccatggaaggggaaaaggtccagtgtgataaggtattgcaaagaagtgacatttaagcaaaagcctgcagcctatgcagaagttggcctcagtgagaaaggttgggggagggttccagtagagagggaaggtatgcaaaggcccagagttaggacagaacttgctgtgtttgagaaactgggaaaagaagagtgagcctgggggtatcacgtgatccagggcagagcaggtccaggccaggtgcagccaggtcacagcagccctagtgggttagagcacaaatcaaagtttagcatttatctgaaacacaggagttggccatgagtttcttaggcgaggaagcgctgtgaccatatttatgattgaaggagattcttttatatgctgtatatagaaagcctttcagggcaaagaaaggaagctactggggtagccctgggggagatgaagggagcttccactgggggcagtaagaaagccagggaaaggcggcagctttaagacctgttttggagatagaacggacaagctttgctgatgggctggagtggaacaggaagtcaagattacttcttctgggaagttctgttcctgggtctttaggatctagaggaagctgtgactttgtctctcatctctgcctgggctccaagcctcacatccctttttgtaattagaagatattggacagaccgtcctcactaacacaattcccacagctgagtccagggtagaactgggcaggacttcactgcccaacacgggaaatatcagtcagcagatttgggtttcggggatggtggtgggccagcgggaagactgaccagggcctacccatcacatccccaccacctcccacctcaattcaccttggcctgagatgacaggtgaacatgactgatcctctctcttccctctgcagaaacactaaagccagggaccaggagaggggcagcccaaccaagctttcaaagcactcagtagaggctggtctgggggatgggaggctcccagggcttcacctgtctctgtcaaagccatgtatttccaccagaggcccaagagtgcgatggcaaaccctggatttgaaactaagaaacgtaaaacaagcactgaggactccactgcctcttgagtgacctctctgaccctctgtttcttctgcactgttaggataatgatactaactccatgttgttgtagagaagtataaatgagctaatacaggtgaaccgcctggggataccaggaggtgaggtcgaggaggaacgaggtatcactcctcagagccactcagagasaggctgtgcacgagtcagaggaacctggattttaattccggttccatcactcagtagctgaaacaagctattccacttcacttagcctcagtctattcaatctgtaaaatagagtgagtttacttttggaaaactctgtaaaatagagagcttacttttggtgaaggttaaacatagtaatatttatggagtgtctagtatgtctttaataattagtggttttactgaaaagtagagagagttggcccagagggagcaagatttctgggtctcaaacatgtagcccaggagagcctaagtgaacctggggccctctccaaacagatcctgggggagactcagtgcacacccggagaagcagctcctccccatcggatctctagtgcttggcagggggcggggtcttgagggggtgtccacaacacatggcagactgcagatgaagaaactgaggcccagagggggtgaggcttgcccagggtgacctagtagctgaatagatgggagaatggaggccagggcctcactgagactctctggtcagctgcccctgggctgtatccaataaggaaactcccctgcttctgaagctgttctcgaaattatcagctcagtgtgaccctgtggggggttgagccacattgtttctttagaagcatctccatacatggctggttccaacccttggcaggagggaccatattgtgctgtaaaatagactcatttagagaagccggagattaaagcacccacctatgtccttcaaagctctccaggcaagtgccatggtgggaacaggtagggagtgtcagtggggggaagcccagactctgctcactcattatctgcagattagggctattgttggtggctactaagtcagggatttcaaaatcaggaagatgcagccaggaaaagaggaggcaggactctgcagaggaggcaggactctgcagagtcagagtgataaccgagtctgagtccaagctttgccagtgttagcaagcgactccatctctctgaacctcggattacccatctgtaaaatagagctagcagcaagatgtacctttttgggtggtgcagggctgaaggagttggcacagtgcctgaaagagggtgcgggcaatgcgcccaactgctgtggctgctgggtttggtgccaggttcgattctgcaggcagaaacttctacatgaggctccttctcggaaggagctcaggacacaatttggaggctgggctggcaagggtgacctgctggagctattcaacttcacttaaagacaggcctgcagtccaagcctgcccaattcctgagaccattctctctccactgctgagccccacggccactctgcaagggatttcccacccacctgtttggggccctttggagtttggttttaattgggtcacgggatgctgtgacaggctgcccctgcctggtggggatctggggtcactgatgacattgtgcccatggagagagcccagcagaaagggattccctccaaggcgacacacagggcaaagctcacatcagaagccaggcaggccctctgcacctggtaattagccrgccygggtgctgtcaggctcacacgtgtgtgtgtgtgtgtgtgtgtgtgtgtgtaaagcatgtaccctatggtacagttgagaatatggaggcctcagatggggcttttgccagaaactgccatgcctactgctcacacttccatagcacgtgcccccaagcaccccatggtgtaggtgctgttattatcactatcttacagttatggagcagtggctcaaggtgtaactgayttgcccaaaatcacactacaaggacacagcagggctgagatttgaacccaggcagtggcttcagagcctgagctgtttcctactgcagagggaggaggcaagacttctacccgtagccagatggggaggcatgggcacaggaayggctcttgggtgaagyggagggaggaagaggaggactgaaggcsaaggccacrtcaggagtgatgggakaccccacaaaggcctccctgagaagmgctagagacaaagatgagtgcctcctcatctggaagatgaaaagatgtctttgcctgcatgggctgcyrtcacaaagtcccaggggctagggggcttcaacaacagaaatttctttctttacaactctggaagctggaagtctgagattaaggcaccagcaggatwtgttccttccaaggcccctctccttggctcacaggtggctgccttctccctgtcttcacctggtcttccctctgtgcatgtctctatcctgatctcctctttttaatttttgtgtaaggacgtagtcatattgggttggggcccactctagtgacctcattctaactcagtcccctctttaaaagccctatctccagatatagtcacattctggggtattgaaggtaaggacttcagyatatgcattttgggggcacaattcagccagaacaggaggacrgtggggatgtccacatgaagaggttcaggcagaattcctttaggaggggaagatgtctctctgtgggacaagggtggcatggagcagcccctgggggaaggagaaggggacwgtttgcatactggtattctgcctaccccagggtggacactcactcagcgtttgctgaatgaacagggcaaggccagcagtgctgatggtsccaggcatgtagctggtctgagttcatagaaggaccacagcgccctgccatgtgccaaaccaggacaccagagtgaagrccagaagctcacatggaagcagcttagttccctggtaacctcgagatgctgatgagacagagcagagcagagggaaccctctccctccatatcccatcctccaaaatgtgtcccttgatgtggatgggtagacaggattcctgccctggcagccagacccctgccttgggtctgcacctcctctccctccttcctctccccgtcatccctraatcttgtcctcragccactgccaccctgtgtaaaccctcatgyccagtcttgsgggtgccatcccttctctttraagctgaatggaccaaacatacccattgagtgttgggtggggacatctctggaaagtcagcacctggaccagctccacccctctctgaggacaccttctttccctttcagaacaaagaacakccaccatgcagctcttcctcctcttgtgcctggtgcttctcagccctcagggggcctcccttcaccgccaccacccccgggagatgaagaagagagtcgaggacctccatgtaggtgccacggtggcccccagcrgcagaagggactttaccttygacctctacagggycttggcttccgctgcccccagccagaryatcttcttctcccctgtgagcatctccatgagcctggccatgctctccctgggggctgggtccagcacaaagatgcagatcctggaggkcctgggcctcaacctccagaaaagctcagagraggagctgcacagaggctttcagcagctccytcaggaactcaaccagsccagagatggcttccagctgagcctcggcaatgcccttttcaccgacctggtggtagacctgcaggacaccttcgtaagtgccatgaagacgctgtacctggcagacactttcccyaccaactttagggactctgcaggggccatgaagcagatcaatgattatgtggcaaagcaaacgaagggcaagattgtggacttgcttaagaacctmgatagcaatgcggtcgtgatcatggtgaattacatcttctttaaaggtaaggcccttgggcccaaacctgcactttctttggcttttctgctgcttttatctaaagaatacccaattccctcacatacataaaagacggggagtacgttaagttcttttgggtgcctgttgagaaaaattaagtaaacaagcagccagagaaggtaagatgaatgccttcttgctgtggatgggattagtgaggctgagatgctgtttcctccacggaggaagagctggttgctgtcttcgggcccctgrggacatctgaagccccagctttctacaggctctgaagtatgaacccattgtggccaccatggcaaagacaccaacaccttagccactcagggcaggacacagaccccagaagggcttaaagggcatttcccagtcccccgtatccctcagatcttggcccctctgccctcatagaggccaagactccctcagacaaatgcttgttcctctgaaatgcctcctcctgactyctcagcaagagctgacctctgcttatctccccgacactccttgtaagcattcctgctcgcctctgcagctcctgccagttgctgaccctggggaaagcaagagtggatagagaggagaagagaggagaggagagggtgggaagggttgcgaaggaaggtaaattgttaacacctccccttcctatggtcacagatcatgagtatctttggccatttgggtggctataacaaaataccataaactgggtggcttagcaacaacaaacatatatttctcatagttctggaggctgagaagtccakgatcaaggcactggcagatgcagtgcccattccttggttcatagagagtgccttcttagtatatccttgctggaaggaggaaggcagctctctgtggtctcttttgtaaggacaccgatcctgttcatgacagctccacccccatgacctaatcaactcccaaaggccccctgtcctaataccaccaccttgggggttaggtttcaacatatgaacaatgtggggacacaaacattgagaccacagcastgagtgtcgaacttggactctgagatttcctatcccctggtgcagggcagtccccattacaccagattgctgagggcagctgggaaataagctaaggacggtattgactggggtcttccttcgataacgattaagaagttggaaacaggccaggcatggtggctcacgcctataatcccaacattttaggaggccgagatgggcagatcacctgaggtcaggagttcgagatcagcctggccaacatagtgaaaccccgtctctactaaaaaatacagaaattagccaggcatggtggtgggcgcctgtaattccagctacttgggaggctgaggcaggagaatcacttgaacctgggaggtgggggctgtagtgagccaaaattgcgccactgcactccagcatgggtcacagagcgagactccatctcaaaaagaagaaaaaaagaaaaaaaagaaaaaaagaaataaaataaaataaaaagaagttggaaacaatcacttgtagcgttttgttcagaagttcccawaggaaggtcagagaagggtcattgaagacttcccaatgggaaaaaccattcatttccaggatccatactaacttctttctaaaatttaaatcaaaatattgsaatgaaagtgcaaacagagaagttcacccagatatcaggtagcattcacagccagccacatttttcaccctcttcacttggagatttggtcttgagtaaaacgttagagaatcagagaacaycagggrtccagggcctctgaagatgtgaaaaccaacctccttgttttgcaaatgtggaaggaaaagtcccacgaaaagtccaagaatgtgcccaatgttataaagagacttgccttcatattcaagaggttcaacagtcactgctctggggctgccrtaaagatggtctccgctggctatctttactgtcttcactccttttatttgcagctgagaatttctaattctgacacaaaattctttttcatttttcccttttttcatctttagctaagtgggagacaagcttcaaccacaaasgcacccaagagcaagacttctacgtgacctyggagactgtggtgcgggtacccatgatgagccgcgaggatcagtatcactacctcctggaccggaacctctcctgcagggtggtgggggtsccctaccaaggcaatgccacggctttgttcattctccccagtgagggaaagatgcagcaggtggagaatggactgagtgagaaaacgctgaggaagtggcttaagatgttcaaaaagaggtactttcagactaccccagggccagcctaaacccacacagccccagggagacacacacgccctaccagggccacacagcactggtgggaaggactcacccagccaaggagctgcctccaggcccagaggcatcctgtgacatccaagtcctgggggcctagcccagttggagggacaagagctggaaactgggttccttagggtggtgccagagtgggcagagacctctgggcagcccacrtccaagtccagagcaaggggaggctcatcctagaaaagaggccagaggagccataaccaccattgttccttgggttaaggagtccttttttaaaaccatcaaaactaagaatccagtgcattatgaatccaaggggtgaggctcagtgtgccaatgccccagaacagtctaagaaagctccttttccctttccaggcagctcgagctttaccttcccaaattctccattgagggctcctatcagctggagaaagtcctccccagtctggggatcagtaacgtcttcacctcccatgctgatctgtccsgcatcagcaaccactcaaatatccaggtgtctgaggtgggttcagaagctcctatgcatctgcttcccaagrtctattctgttctattctttctaktctactctaccccatttcattccattccattccactcaactccactccactccactccactccagttcactctattcaattccactccactccactccagttcactytattcaattccactccactccactccagttcactctattcagttccactccactccactccactccagttcactctattccattccactccattccactcctccactcctctcatccactccactctactcctccactccacatctccactccactcctccactccactcctccactccactcatccactccactcctccactccactcctccactccactcctccactccactccactcatccactccactcttccattccactccattccactcctccactccactcttccactccactccattccactcctccactccactccactcyattctattctattccattccattctactctattctattccattccattgcagtcaactccactccactctctactattctattccactcctctcccctccactccattccattgcagtccactccactgcactccactcctttattctgttctgttctattctattctattctattctattctattctattctattctattctattctattctattctctccctctccctctcttttcccacaagtagtgaaagtttcactttgtgtcttatccttcatgtaatgggaagccatatccaccactgttccttgagttaaggagtcctgttttaaacaatcaaaactaagaaggcacttcctagctatgtgrtctccaaaaaayacttgactctctgagcttcctttctctcttctataaaattgaagaattacaccttgctcaaagatgccatgagaattcaatgacagacacatgcgaagtcaccccccagcacagtgcctggggcagagtagctgctccattgttccatttcctacttgctccatggctcagttgaacagatacttagaggttgatgcccataggcagaagctttgccatttgctatgatgacttcacctgcccctrgtggcctggtgatgcctggtgtctcccctgcagatggtgcacaaagctgtggtggaggtggacgagtcgggaaccagagcagcggcagccacggggacaatmttcactttcaggtcrgcccgcctgaactctcagaggctagtgttcaacaggccctttctgatgttcattgtggataacaacatcctcttccttggcaaagtgaaccgcccctgaggtggggcttctcctgaaatctacaggcctcagggtgrgagatgaagggggctawgctatggcccwtctgtatgctggtagctagtgatttacacaggtttagttgactaatgaggyattacaaataatattactctatgatgattgcttccacccacacractgcaacatacaggtgccttggggaaatgtggagaacattcaatcttgccgtcactattcatcartgaagattarcactgagatccagagaggctggatgacttgctcaagttcaccagcatggtagtggcaaagagaggtccagagtcctggcccttgatgcccagctcagtgccacaaagctcartaggagggatgttccagtggatgagggccaccaggaagcacaggtccaaggctggtcccacacttatcagcagcaacaactstcagttcatcctgcatgggaaaaatgttggaatgggagtctgaaatggggctactgtttcagtcctaaygtgctgtgtgacattgggacaacactttccctctctggacctcagtttccctctgtatacaaggatcagattcttgctgtgacccaagaactcctgaaatcatatagaaargctggggtgggccctgtcattcrtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtrtcagttgcaggtgccaatgrctaactttttgaattctatgttggcattaacaataaagcattttgcaaacactggttataactgtctttatggaggcagctctgggaatggtgacattgatagcttaccatgctccaggccgggtgcctggcccttcacctggatggtcgcatttgcccctcataagactcccatgaagaaaggcaccactgttatcccatctgttattcacagatgggaaaggcaaggcttgaagtggttaggtggcttacccagtcacatatcttctaagtggtgcagccagaatttggcggggggagtgcgaccaagaaccctacactcagtcctgtgctctgtgctgtggaggagagatgaccaggagcagaaacttcattcagggacatctcaggcaccagctcccccatgagccagctaagttccctccctcccttcaccaagcaccatgtgtttcctcatgtgccgaatgaagaggattagatactcaagaatggaatgagtgggtgagtgagtccttcgctgcacccaagtctgattttctgtgcgcctgctcaccccaccctgcatgttctaagcatgcttccataaggctgtgccccaccctctgattctagagtctggactgtatcagaggtgagtgcctactagaggtaacaaggtcaggaccccaaaccttgtccatcccccaaagtactgagcccccaccatgcaccagcccatgccagatgctttgcacttgtgatatcacccatcccttgacaacccagcaagttctattattgttcccattttacaggcaataacataagtgctttcccagggtcccacgctggtgacagtgagggcccagggtctgagagcccagatcgcacatgtgcgggctggtggcaggggagatggcagcaaccagactcagacatttctctgcagttgtgctgtgggctcagggtggctctttatgaaggggccccttcatggggtcatgcactcctgtgtgttttcccttgcatcatgccttgcctgtcttggcaaatatttctctggagtttacccagccagtccaaggtcacagggaagccctgtctgtgtctcacacagaaggtcaacgtccagcactgtccaaactttactcagcaaacagtcacaaagcagctcctgtgtggggggtcaggggtgggctcactgtggtctctgctgcatgtcacacattgaagcactgtgctgggggtcatcacaggctgtttaactcaattgtcacatgagcctgggtgcacaaaatggtagagcagctcagagagagatggacagacagcatgaacctctgaggagtcaggttttcttggatgaagggacactaagatggctttggagcgtgagaaggacttcacctagcaaatgtgggaaaggagtgagacctccaggcagagggactggctggagacgagcgtgatgtggtgagccatggagtgtatgggtccccacagaacttcagtctgggcctgcacagggcatgtggaggagacaaggaggagggaggtggccgtgccggcggttcagtgacagagatcctaaatgggaggccaatcctaaatgggatgatctctttcatcccaatttcagggtagtttggtcatccacgccacattccaagtgtcccctgggccctttctctccctcacccccctgtctgcacatgagtagatgcctccatgcagccctcccaggacgctcacctctatccacagatgcttctccaaaacccaccaggccctcccatggaacgagctcacctacagggtaaaatcaggtcacggtcacatatagcctgactactcccctcaggaccctcattcacagccactgtattaatttgctggggctgccaaaacaaagtgtcctcatctgggaggctgcagtagatttgctgaaattgatttgctagcgttgctgaaattgattcaagcttgattctggagcttgaatcgaagatcaaggcaagtgcagggctggtttccctgaggcctctccccttggtttgcaggtggctctcctctccctatgtcttcacatggtcctcctctgcatgtgcctgagttctaacttcctctcctctcctcatctccaccagtcttatagaattagggccccccaatgacctcattctaacttaataacctctttaaagtctctatctccaaatacagtcacattttgaaatattgagggttaggacttcagtgtatgaattttgggaggatgcaactcagccaggctcactcttatcattacagctgcactagtgccatgcctggttcccagtggacaccccaggaacagccatccatccagagtgatattctgtgacatcccctacactccacagctcatcacatcacactcgtctccagtcggtctgtctgcctggaagtcccacacctgttcccacatccactgtctgggaggtccttttcatgcttcaaagccagctcagtgtcctcctttgtacaaaaaaatgtcctgacctctcagaacttcattctttctctctttctgtcgatctttgtctgaactcctctatcattttgtgcacccaggaacgtgtgacaattgagttgaacaggctgcaaaaacgaaaaagaagaaagaaatgctgagttaaacaggctgcaatgacccccagcacggtgcttcaatgcatgaaacgcatcaatgacttgcagcagaggccacactcagcccccctctgccctttgagtttttgcagctcttgccaagatcattcttgttcttagaaagcccaccattattttcctttctagccatatggattctaaaagttcctcttgtgagctgtaatcagaatgcagagaagtaatacaaggttagggcccaggactctttctcccacctctccctgcagagactcagatttttttaaaaaatgaccttggtcttcgggggaagaacttcccaccacagtgaacagccatgcccagcctacacttgactgtgcggcttacttagctcatccatccaaaggctattcctgggttgcctagtggaaatccaggcatggagctagtgcaagcacaatgataagagtgagcctggcagacactgaccccagcaataatcaggtaaacaaataaacagaactacaaactatgatgacaagaattcatccatccacagatattcactgaatggccactgtgtgcctggcactgttccaagtgctgaagaaaaatgaagaaaacaaaaatccctgcccttatagaggagacattataatgtgacaagataacataatgaaaaagaatgaagaataaaatagaaaagtaaaatggattgcatgtcacttgatgacaagtactgtggaatgaggccgtcatctaaatggagcacagaaagtggaacatggcgacatctcagccaaaagacccggcagacaccatcttggccaagggatcgaggttggcatcgccagctgtgagcagtgctgacatcttattatcttcgatatggcgtcatgagcaggctgcctcctcttggtgggatcttcccccaaacccagaacctcagtctaatcacaagaaaatgacagccaatcccaagttcagggacatttggcaaaatagcccaccactcctacttaaaagtgtcgaggtcttgaaaggcaaggaaaccctgggaaatcgtctttggccggaggaaactcagcagacatgacgactaaatgcaatgtagaatcctcggacagaaaaggacattagtaggacagctggtgaaacccaagtaagtccaggctgtaccaatgtccacttcccagttctgaggaacatgctgtggtctgtccacatttacattaggagaagcagggagagcgtatatgggacctctctgtattgtttttataacttttctgtaaatccaaaactgtcttaaaatagtttttttaaattatactttaagttctggggtacaggtgcagaatatgcaggtttgttacataggtatacatgtaccatggtggtttgctgcaccccctttttttaagaaaatgtttcaaaaagaaaaacagccaagtaggggagggcacacgagtggggttgggaattgcaaaggcagaagcaggagaccagttaaggaagaaaacggggcactaagagagacaatcaggaggacctgctgcagccagggccctgaggggctccctgaggtggtgccattgaagcggagttctgagggacaatcaggtgtagacactgtgagtctcagaagtgggaaaaggggagtgctgtgcacaaaattgagagacggtgcctgtggcagcagctgaggagggaaagagaaggtggggtgggaggcccatcccttccttggccacaaggacactgagtagggtgctgagatgggagtaacagtaataataacaggcagcacttggaggctgcgtcccgtgtgtctggcactcgcctaagccctttgtgcacattggctgagttaatgcagaggtgaactgagaggcacctggggtaggggctgggggacaggaagcaggtgacatctccagtcctctccagcgtccttagagcaggtctacagtactgatccttctctgccacccttctccaagaccaccttggtgggagtaaggggctctaaggtgacaacacacacaggagccacagacacaagacacaagacacttttgactcccaggagaacctagtatgggcatccacacacccttcctgatggtgactttttatgtagacatgcagagtgcagttaaccagctgttcctgcacacatctggattgctactcacacatctgtgcacacacacacacagcctcctggagcactgtggcttctgggtggctaacacagctaccacctctggttgtgctgagctgagcacccattgcctgctggggtggggagagggcaggcactttccctgcgcgaccccgtttaaccctctctgccccactgatgtggtccctgttgtccccgatgcacagaggaagaacctgtgtcaggacccccagagcggtgtctccactaagcagaagtctctgtttctctcctggcctctcccagaggggctgctctgaagcatgtggatttgatcaggataatcaaggtaaatgatccttatcttgatccatcacaaatgttaaggtacaaggctgtggagatggagagtgggtggagtctctgctgcccggtatcctaagctgggtgatcgcaagcagacacacacatgaccacctcttgggccatgcagggggaatgaatgtaatgaggccgatgttacagggttattgaaggctcaggggagaccaggccaaaaaaaaaaaaaaaaaaaaagctatgacctgagacctccctatagcagtgtttctcaaactctgattaacgttacttgaggagcttgttaaaaatacatactcctggccctgatcagataaatcagaatatttgacacagagtctttaagctccccctcgggattcaaatgcacacagatttttggtgctttgccgcctacagtacaagagagggcaggactgtcctgttcagtgcactgtgacccggacgctcaggcccacggaactcccctactccccctgctccctgcggtgccacccacctagctttcgtgcctgagggtggtcctcagactcctcctagaacaggcccagaggctcttagctatgtaagtattcattcctccaatcactgcagagcactcaccaggtaacaagcacgcacacccaggcgagttccccatgctcgtccccacgttgatatctcagactctacaagtcttcagctgctgcctaggactctgtaagtccttgagcttgggacccctaccacacacaagcgctgggcgtgccccacaggcggggaagtgctggccatatacacccagtgaagtgggaattccagataatgagtaactttttagcaaagtacccatgccctttgaattgtgaggtgtttttgtttgctaaatctgacaattctacctgtagggaaca

SEQ ID NO: 17660 - DNA, 25871 bp, Homo sapiens
ccagcttctttacttcaacctgttttattggcaagctctttatgaccttgtgctgacctcctaactcatcctgtgacttagaatctcttaacaatctgggaatgtatcccagtaagtctcagcctcattctaaccagtccctattcaagatggagtcactcttattcaaatacctttgacattatgaagtgtcttctctatgctggtcctctctgtgtactcatttatttcatcttagcaaccaactctaagacctcggaactataaactccacttacacatatggacagtaaagccataaggagttaagtaacttgtccacagtaaactgagcctagctctaactctcccaaatctcataatcttgccatagtctacactatttcaggtggtgtcagggccatcattttttccagagcccttaaaataaggaaggagacccccaaaagtcttatgtggggatgttagtgtgtgtatgcacatgtgtgcaaactgtttgtcttcagcaccctaagtgccttgtcctgccctccctggtaaacctgagggctccatcccaagagagcagggcacttctccaagtgtgtcctcagctccctgaatcccatccacacagcttccagtacctgagcctaagtcgcttcacagagtcttccctatctgcttcccacgtagccccgctggagaacagaggtagagggaagagggcagagaagtccagaacacacacgtcctcattgtttgctaggagggctgatgttgacccagcttgtgtttgcccttcttgcccaatgctctctgagggggagagccaaacaccaggtcctgagaaccagtttaagtagaatggaaatcattgatttttcactaaattcctgaaacaacgttgttttttgttcccagtcatttcactgaattaaatttctatttgtctgccatcagaacaacaggcacacagtcccaagggtgaaagagtaaggaaatactatttattcaaccaggcactttctgtaatcctcactgcagccccaccatgtcaggactatcatctccattccacagataaaggagatgaagtcgctggctctgggttcttggtggttaatggcagatctgggatttgaactatgtccaacttcttttccacttaattcctggaatccttccaagacagcaaggaaaggggaaggagggaagagaaaaaaaaagcaaggagtggagagaaaagggtttttttttaatacagtttatcatactctacaaatagccattccacccaaaagaaatgaaaatacaaagacttctacatgaatgctcttagaagcttcacccataacagaccaaagtggaagccacccagacatccgtcaataaatgggctaattgtggtccgcccacacaatgatgatggaataggactcagcaagaagcataagcgcactgctgatattggtgacaacatagatcaatctcagaaacatgatgttgaactaaagaagacagacacaaaaacataagtagtgtattatcccatttacatgctcttctagaaggggaaaaaccagtctatggagacagaagtcagaacagaagttaccttcgggaggcattgatagaaagaggactttgtggatgggagaatttgctctgtcttgctcagaatggcggttacacagatgcacacacatgtaaaaatgtattgagctgtgtatttaggagttacagttttactacatgcaaataacacgtccataaaaagtaaatcgataaagacagggaagggatggtggcacaggggagatgcggagaggctggaggattcaagagaggctttatagtgtcatcttatatattctcttcaatcctaacgtgcaaagtaggtataataaaaccttccttgcagagctgctggggaaatgaacgtttgtgagcacaaatttctgacagaggccttggcatctggtaaccaatcagcaaatgggttgctttggctgggattctgctgatgagctcaggaggggccacaaggagaatggaaagagggacggcaggggcatgatgcaacctccttcctcatcggtggatttcatcatgacagctcagtccttgctctgttgtcctcccacggactgtttcccttttctcatggggcagacagaggaggcgggtggaaaagcagcttgggtggtggtggaagcccaggcttggcactgggttctaggtcctggctgggaggctttggcagcctgctaacctctccctcctcagtgttagactccagcttgaatagtaaagcaactgggtttgttttgttttgttttacctaagaagttgcacgcctcacacaaatttttagcatatgcgaggttttcacactttcaccctggcaagacacctcagccatctgattaaagaaatgctccatttccatgacccttgattaactcagttcatgaagcaacctttgatcacctattctgtgctcagtacaaagccacagagatggaaaaaacacagtccctgccctccagttacttgcagcctggtgatgccaccgagctttggggtcatgcgcctcacagcctggttagaatctgccctccaccacttgccagctctgtgacccagggctaggtgctcgacgtctatgaacctcagtttcctcatctgtaaaatgggataacagaaatatcgacttcataggcttgatgtgaggacgaggagttaatctgtaaccaatgcttggaatggctctggcatgagccacgtgctcactgttacctattatgctaatgttacaaagggatgtgtaggaagtgttggggaagcagcaagcagggagaaagagaggaagggagagagggaggtacctgtttcagcatcagggtaacactctgcctcagtttcctcatctgttctaaggcagtaacagtggtactcactgcacaggatagagtgaggtgatgcatgtgaagtgtttaagacagggcctggcagaggccacatgtgcaaggagtctcagccgcgattcagggggtggcacaccaccgctggagtatttggagatttatattataaaatttcggaagcaagaggcctgttaaaaccaagcaaatagaaatgctcaaaatcaacatgaaggagtcaacagggtaaatcgaacaatttgaagccaaggtcggagttgggcaaattaagagccctattgctctctgttatctaagccacccacgcagggcatgtatttctgaataataagccctcaagtcctgctgggtctcccatagtccccacgcaagggtgagtcttgcacgctcagccctgcctgtggttcccagaaggcctctgtcactgcgtgcttgctttctctcccagggaagataccccagtgccatgtcttggggcaagagaaaatgaagacagacctggaacatgaacatggtggccttgccagaaagcaagtgtgtgttgctgaaacatcagcagagattgtcaaagggataaagagataacttaaaagggttcctattgaccaaaatgcgacaagttgaccatctaaaatcaaatcataattatagttcaataggacacattgagtctcttaaaagcttccaatccgtaatgaccatcaaggcccataacctcaaaagagtaaagttaaaataaagttcagaaaaggttagctgcaataaaacatgagttttagtaattttaacaagaaggggatgaagctatagatgcatttttattccttcttttaactatgttgccccttataatgtatagctttgccttatttttctctgtctgagtaaggataaagagtaaaggccaggcacagtggctcacacctgtaattccagcactttgggaggccgaggcgggcagataacttgaggccaggagtttgagaccagcctggccaacatggtgaaaccctgtcactactaaaaatacaaaaattaactggaattggtagcacatgcctgtaatgccagctactctggaggctgaggcacgagaatcgctcgtaattccagaattcgagaggtggagtttgcagtaagccaagattgcgccactgtactccagcctgggtgactgagtgagactctgtctcaaaaaaaaaaaaaaaaagaagaagctgtgagtaggccacatagttccagaaaatgcagaaatcccccctcccctccccaacacacaggaagtggctcaggagattacacacagaaggaaagtgtgtctgctggggttttgcaagttggctaatttgaaaggtgactggaggaggtgaacaaatggtgcaaacttcattcattcattaaatgagttataagaagacagacacaagtgtccattatgctaacagagctctgtgttaaacaccccaccagcatcgcctcatctaagcctcagaagagctatgtgggaaagaaacttttatccctattttatagatgaggaaaccaaggctcagagaactgagggcctcccccggatccaagtccacctagctgcagtcaccccacatcctctgcatgtcacaggtgctcagaaagatgctgaaggcacctggcccttcaccttcggaaagccaaaatgagcacggcccctaaagaggggattgacagcctttttctggaaaaaatggaagtttgaatctgaggaggtgtccctcaacaacaggtgctgctccccaaatctggggccaaacgcagcagttgttcccccacttagacccctgagacccatctatatggtttttcagagccaggacacatccccaaaggtcatggcctttggtggttagcattgacttggggcccatcacatgccagaggctgcccgaagtgcttaartgttattatctcattcgatcttcacagtcctgatggaagtgactcttcttagagtcttcctatctcacagatgaggaaaccgaggcacagagaggttaagtggcttgtctaagagctcacaaaaagagcgatggagctaaggcttggccccagatattagatcccgaacccacgccttaaccagtgacctgcactgactctcaaagaaggaagctggtgcctgggaaggagggtgcatagtgagggtgtgcatggggtgtgtgtgtttgtggggtggccagcactctccgggggcactttgccaatgagttcagctcccatgaagtccactgttgttctcctgaccagccactcagtcttgatttacttggcccagggccactggcacacctcacccccttacccgattccttgctgcagaccccaaatctcgactctcacatccctatccagcccataccacgaggctcccatctccaggcagggccctgtggtggggcagggcctcccccagatgccccttactcatgaccagctcacaggatcttcccatgatgcatttcctctggggggatcagcccagatgctgcaatagacaattgtggaagtaaccaggtggacaagactttccccctcatgtcctggggttcctgggggcacagtatccttgtgaatggccactgagtactcccacccctcccaccacaacccccgggattttgtcctggtgcgtttttccagattatcctagcccttcctcccaggatggatgtccagagcagggcgggggctgagcctagagccctgccaaaagagcaggaccccaaattctgagccccttacttgcctcacctgctcccacccatgctttcttcattcctcctccaaaagccccagctccccactgcaatcccttctgcacccagccaggtcctatgacacacacctccccagtgcacacagacctgcccaactgtggggctgcccactgggcatttcataggtggctcagtcctcttccctctgcagctggccccagaaacctgccagttattggtgccaggtctgtgccaggagggcgaggcctgtcatttctagtaatcctctgggcagtgtgactgtacctcttgcggcaactcaaagggagagggtgacttgtcccgggtcacagagctgaaagggcaggtacaacaggtgacatgccgggctgtctgagtttatgagggcccagtcttgtgtctgccgggcaatgagcaaggctccttcctgtccaagctccccgcccctccccagcctactgcctccacccgaagtctacttcctgggtgggcaggaactgggcactgtgcccagggcatgcactgcctccacgcagcaaccctcagagtcctgagctgaaccaagaaggaggagggggtcgggcctccgaggaaggcctagcygctgctgctgccaggaattccaggttggaggggcggcaacctcctgccagccttcaggccactctcctgtgcctgccagaagagacagagcttgaggagagcttgaggagagcaggaaaggtggracattgctgctgctgctcactcagttccacaggtgggaggracagcagggcttagagtgggggtcattgtgcagatgggaaaacaaaggcccagagaggggaagaaatgccyaggagctaccgagggcaggcgacctcaaccacagcccagygctggagctgtgagtggatgtagagcagcggaatatccattcagccagctcaggggaaggacaggggccctgaagccaggggatggagctgcagggaagggagctcagagagaaggggaggggagtctgagctcagtttcccgctgcctgaaaggagggtggtacctactcccttcacagggtaactgaatgagagactgcctggaggaaagctcttcaagtgtggcccaccccaccccagtgacaccagcccctgacacgggggagggagggcagcatcaggaggggctttctgggcacacccagtacccgtctctgagctttccttgaactgttgcattttaatcctcacagcagctcaacaaggtacatacmgtcaccatccccattttacagatagggaaattgaggctcggagcggttaaacaactcacctgaggcctcacagccagtaagtgggttccctggtctgaatgtgtgtgctggaggatcctgtgggtcactcgcctggtagagccccaaggtggaggcataaatgggactggtgaatgacagaaggggcaaaaatgcactcatccattcactctgcaagtatctacggcacgtaygccagctcccaagcaggtttgcgggttgcacagcgggcgatgcaatctgatttaggcttttaaagggattgcaatcaagtggggccccactagcctcaaccctgtacctcccctcccctccacccccagcagtctccaaaggcctccaacaaccccagagtgggggccatgtatccaaagaaactccaagctgtatayggatcacactggttttccaggagcaaaaacagaaacaggcctgaggctggtcaaaattgaacctcctcctgctctgagcagcctrgggggcagactaagcagagggctgtgcagacccacataaagagcctactgtgtgccaggcacttcacccgaggcacttcacaagcatgcttgggaatgaaacttccaactctttgggatgcaggtgaaacagttcctggttcagagaggtgaagcggcctgcctgaggcagcacagctcttctttacagatgtgcttccccacctctaccctgtctcacggccccccatgccagcctgacggttgtgtctgcctcagtcatgctccatttttccatcgggaccatcaagagggtgtttgtgtctaaggctgactgggtaactttggatgagcggtctctccgctcygagcctgtttcctcatctgtcaaaygggctctaacccactctgatctcccagggcggcagtaagtcttcagcatcaggcattttggggtgactcagtaaatggtagatcttgctaccagtggaacagccactaaggattctgcagtgagagcagagggccagctaagtggtactctcccagagactgtstgactcacgccaccccctccaccttggacacaggacgctgtggtttctgagccaggtacaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatcgtaagtatgcctttcactgygagrggttctggagaggcttcygarctccccatggcccaggcaggcagcaggtctggggcaggaggggggttgtggagtgggtatccgcctgctgaggtgcagggcagatggagaggctgcagctgagctcctattttcataataacagcagccatgagggttgtgtcctgtttcccagtcctgcccggtcccccctcggtacctcctggtggatacactggttcctgtaagcagaagtggatgagggtgtctaggtctgcagtcctggcaccccaggatgggggacaccagccaagatacagcaacagcaacaaagcgcagccatttctytctgtttgcacagctcctctgtctgtcgggggctcctgtctgttgtctcctataagcctcaccacctctcctactgcttgggcatgcatctttctccccttctatagatgaggaggttaaggtycagagaggggtggggaggaacgccggctcacattctccatcccctccagatatgaccaggaacagacctgtgccaggcctcagccttacatcaaaatgggcctccccatgcaccgtggacctctgggccctcctgtcccagtggaggacaggaagctrtgaggggcactgtcacccagggctcaagctggcattcctgaataatcgctctgcaccaggccacggctaagctcagtgcgtgattaagcctcataaccctccaaggcagttactagtgtgattcccattttacagatgaggaagatggggacagagaggtgaataactggccccaaatcacacaccatccataattcgggctcaggcacctggctccagtccyyaaactcttgaacctggccctagtgtcactgtttctcttgggtctcaggcgctggatggggaacaggaaacctggrctgracttgaggcytctctgatgctcggtgacttcagacagttgctcaacctctctgttctcttgggcaaaacatgataacctttgacttctgtcccctcycctcaccccacccgaccttgatctctgaagtgttggaaggatttaatttttcctgcactgagttttggagacaggtcaaaaagatgaccaaggccaaggtggccagtttcctatagaacgcctctaaaagacctgcagcaatagcagcaagaactggtattctcgagaacttgctgcgcagcagkcacttcttggcattttatgtgtatttaatttcacaatagctctatgacaaagtccacctttctcatctccaggaaactgaggttcagagaggttaagtaacttgtccaaggtcacacagctaatagcaagttgacgtggagcaatctggcctcagagcctttaattttagccacagactgaygctcccctcttcatttagccaggctgcctctgaagttttctgattcaagacttctggcttcagctttgtacacagagatgattcaatgtcaggttttggagygaaatctgtttaatcccagacaaaacatttaggattacatctcagttttgtaagcaagtagctctgtgatttttagtgagttatttaatgctctttggggctcaatttttctatctataaaatagggctaataatttgcaccttatagggtaagctttgaggacagattagatgatacggtgcctgtaaaacaccaggtgttagtaagtgtggcaatgatggtgacgctgaggctgatgtttgcttagcatagggttaggcagctggcaggcagtaaacagttggataatttaatggaaaatttgccaaactcagatgctgttcactgctgagcaggagccccttcctgctgaaatggtcctggggagtgcagcaggctctccgggaagaaatctaccatctctcgggcaggagctcaacctgtgtgcaggtacagggagggcttcctcacctggtgcccactcatgcattacgtcagttattcctcatccctgtccaaaggattcttttctccattgtacagctatgaagctagtgctcaaagaagtgaagtcatttaccccaggccccctgccagtaagtgacagggcctggtcacacttgggtttatttattgcccagttcaacaggttgtttgaccataggcgagattctcttccctgcaccctgccgggttgctcttggtcccttattttatgctccyrggtagaaatggtgygagattaggcagggagtgrctcgcttccctgtccctggccccgcaaagagtgctcccacctgccccgatcccagaaatgtcaccatgaagccttcattcttttggtttaaagcttggcctcagtgtccgtacaccatggggtmcttggccagatggcgactttctcctctccagtcgccctcccaggcactagcttttaggagtgcagggtgctgcctctgatagaagggccaggagagagcaggttttggagwcctgatgttataaggaacagcttgggaggcataatgaacccaacatgatgcttgagaccaatgtcacagcccaattctgacattcatcatctgagatctgaggacacagctgtctcagttcatgatctgagtgctgggaaagccaagacttgttccagctttgtcactgacttgctgtatagcctcaacaaggccctgaccctctctgggcttcaaactcttcactgtgaaaggaggaaaccagagtaggtgatgtgacaccaggaaagatggatgggtgtgggggaatgtgctcctcccagctgtcaccccctcgccaccctccctgcaccagcctctccacctcctttgagcccagaattcccctgtctaggagggcacctgtctcrtgcctagccatgggaattctccatctgttttgctacattgaacccagatgccattctaaccaagaatcctggctgggtgcaggggctctcgcctgtaaccccagcactttgggaggccaaggcaggcggatcaagaggtcaggagttcaagacctgcctggccaacacggtgaaacctcagctctactaaaaatacaaaaattagccaggcgtggtggcacacgcctgtaatcccagctatttgggaagctgagacagaagaatttcttgaacccgggaggtggaggtttcagtgagccgagatcacgccactgcactccaccctggcrgataaagcgagactctgtctcaaaaaaaacccaaaaacctatgttagtgtacagagggccccagtgaagtcttctcccagccccactttgcacaactggggagagtgaggccccaggaccagaggattcttgctaaaggccaagtggatagtgatggccctgccagggctagaagccacaacctctggccctgaggccactcagcatatttagtgtccccaccctgcagaggcccaactccctcctgaccactgagccctgtaatgatgggggaatttccataagccatgaaggactgcacaaagttcagttgggaagtgaaagagaaattaaagggagatggaaatatacagcactaattttagcaccgtcttyagttctaacaacactagctagctgaagaaaaatacaaacatgtattatgtaatgtgtggtctgttccatttggattacttagaggcacgagggccaggagaaaggtggtggagagaaaccagctttgcacttcatttgttgctttattggaaggaaacttttaaaagtccaagggggttgaagaatctcaatatttgttatttccagctttttttctccagtttttcatttcccaaattcaaggacacctttttctttgtattttgttaagatgatggttttggttttgtgactagtagttaacaatgtggctgccgggcatattctcctcagctaggacctcagttttcccatctgtgaagacggcaggttctacctagggggctgcaggcwggtggtccgaagcctgggcatatctggagtagaaggatcactgtggggcagggcaggttctgtgttgctgtggatgacgttgactttgaccattgctcggcagagcctgctctcgctggttcagccacaggccccaccactccctattgtctcagccccgggtatgaaacatgtattcctcactggcctatcacctgaagcctttgaatttgcaacacctgccaacccctccctcaaaagagttgccctctcagatccttttgatgtaaggtttggtgttgagacttatttcactaaattctcatacataaacatcactttatgtatgaggcaaaatgaggaccagggagatgaatgacttgtcctggctcatacacctggaaagtgacagagtcagattagatccyaggtctatctgaagttaaaagaggtgtcttttcacttcccacctcctccatctactttaaagcagcacaaacccctgctttcaaggagagatgagcgtctctaaagcccctgacagcaagagcccagaactgggacaccattagtgacccagacggcaggtaagctgactgcaggagcatcagcctattcttgtgtctgggaccacagagcattgtggggacagccccgtctcttgggaaaaaaaccctaagggctgaggatccttgtgagtgttgggtgggaacagctcccaggaggtttaatcacagcccctccatgctctctagctgttgccattgtgcaagatgcatttcccttctgtgcagcagtttccctggccactaaatagtgggattagatagaagccctccaagggcttccagcttgacatgattcttgattctgatctgrcccgattcctggataatcgtgggcaggcccattcctcttcttgtgcctcattttcttcttttgtaaaacaatggctgtaccatttgcatcttagggtcattgcagatgwaagtgttgctgtccagagcctgggtgcaggacctagatgtaggattctggttctgctacttcctcagtgacattgaatagctgacctratctctctggctttggtttcttcatctgtaaaagaaggatattagcattagcacctcacgggattgttacaagaaagcaatgaattaacacatgtgagcacggagaacagtgyttggcatatggtaagcactacgtacattttgctattcttctgattctttcagtgttactgatgtcggcaagtacttggcacaggctggtttaataatccctaggcayttycacgtggtgtcaatccctgatcactgggagtcatcatgtgccttgactcggggcctggcccccccatctctgtcttgcaggacaatgccgtcttctgtctygtggggcatcctcctgctggcaggcctgtgctgcctggtccctgtctccctggctgaggatccccagggagatgctgcccagaagacagatacatccmaccatgatcaggatcacccaaccttcaacaagatcacccccaacctggctgagttcgccttcagcctatacygccagcyggcacaccagtccaacagcaccaatatcttcttctycccagtgagcatcgctacagcctttgcaatgctctccctggrgaycaaggctgacactcacgatgaaatcctggagggcctgaatttcaacctcayggagattccggaggctcagawccatgaaggcttccaggaactcctccrtaccctcaaccagccagacagccagctccagctgaccaccrgcaatggcytgttcctcagcgagggcctgaagctagtggataagtttttggaggatgttaaaaagttgtaccactcagaagccttcactgtcaacttcrgggacaccgaagaggccaagaaacagatcaacgattasgtggagaagggtactcaagggaaaattgtggatttggtcaaggagcttgacagagacacagtttttgctctggtgaattacatcttctttaaaggtaaggttgctcaaccagcctgagctgttcccatagaaacaagcaaaaatattctcaaaccatcagttcttgaactctccttggcaatgcattatgggccatagcaatgcttttcagcgtggattcttcagttttctacacacaaacactaaaatgttttccatcattgagtaatttgaggaaataatagattaaactgtcaaaactactgacagctctgcagaacttttcagagcctttaatgtccttgtgtatactgtatatgtagaatatataatgcttagaactatagaacaaattgtaatacactgcataaagggatagtttcatggaacatactttacacgactctagtgtcccagaatcagtatcagttttgcartctgaaagacctgggttcaaatcctgcctctaacacaattagcttttgacaaaaacaatgcattctacctctttgaggtgctaatttctcatcttagcatggacaaaataccattcttgctgtcaggtttttttaggattaaacaaatgacaaagactgtggggatggtgtgtggcatacagcaggtgatggactcttctgtatctcaggctgccttcctgcccctgaggggttaaaatgccagggtcctgggggccccagggcattctaagcyagctcccactgtcccaggaaaacagcataggggaggggaggtgggaggcaaggccaggggctgcttcctccactctgaggctcccttgctcttgaggcaaaggagggcagtggagagcagccaggctgcagtcagcacagctaaagtcctggctctgctgtggccttagtgggggcccaggtccctctccagccccagtctcctccttctgtccaatgagaaagctgggatcaggggtccctgaggcccctgtccactctgcatgcctcgatggtgaagctctgttggtatggcagaggggaggctgctcaggcatctgcatttcccctgccaatctagaggatgaggaaagctctcaggaatagtaagcagaatgtttgccctggatgaataactgagctgccaattaacaaggggcagggagccttagacagaaggtaccaaatatgcctgatgctccaacattttatttgtaatatccaagacaccctcaaataaacatatgattccaataaaaatgcacagccacgatggcatctcttagcctgacatcgccacgatgtagaaattctgcatcttcctctagttttgaattatccccacacaatctttttcggcagcttggatggtcagtttcagcaccttttacagatgatgaagctgagcctcgagggatgtgtgtcgtcaagggggctcagggcttctcagggaggggactcatggtttctttattctgctacactcttccaaaccttcactcacccctggkgatgcccaccttcccctctctccaggcaaatgggagagaccctttgaagtcaaggacaccgaggaagaggacttccacgtggaccaggygaccaccgtgwaggtgcctatgatgaagygtttaggcatgtttaacatccagcactgkaagaarctgtccagctgggtgctgctgatgaaatacctgggcaatgccaccgccatcttcttcctgcctgwygaggggaaactacagcacctggwaaatgaactcacccacgatatcatcaccaagttcctggaaaatgaagacagaaggtgattccccaacctgagggtgaccaagaagctgcccacacctcttagccatgttgggactgaggcccatcaggactggccagagggctgaggagggtgaaccccacatccctgggtcactgctactctgtataaacttggcttccagaatgaggccaccactgagttcaggcagcgccrtccatgctccatgaggagracagtacccaggggtgaggaggtaaaggtctcgtccctgggracttcccactccagtgtggacacygtcccttcccaatatccagtgcccarggcagggacagcagcaccaccacaygttctggcagaaccaaaaaggaacagatgggcttcctggcaaaggcagcagtggagtgtggagttcaagggtagaatgtccctggggggacgggggaagagcctgtgtggcaaggcccagaaaagcaaggttcggaattggaacagccaggccatgttcgcagaaggcttgcgtttctctgtcactttatcggtgctgttagattgggtgtcctgtagtaagtgatacttaaacatgagccacacattagtgtatgtgtgtgcattcgtgattatgcccatgccctgctgatctagttcgttttgtacactgtaaaaccaagatgaaaatacaaaaggtgtcgggttcataataggaatcgaggctggaatttctctgttccatgccagcacctcctgaggtctctgctccaggggttgagaaagaacaaagaggctgagagggtaacggatcagagagcccagagccaagctgcccgctcacaccagaccctgctcagggtggcattgtctccccatggaaaaccagagaggagcactcagcctggtgtggtcactcttctcttatccactaaayggttgtcactgggcactgccaccagccccgtgtttctctgggtgtagggccctggggatgttacaggctgggggccaggtgacccaacactacagggcaagatgagacaggcttccaggacacctagaatatcagaggaggtggcatttcaagcttttgtgattcattcgatgttaacattctttgactcaatgtagaagagctaaaagtagaacaaaccaaagccgagttcccatcttagtgtgggtggaggacacaggagtaagtggcagaaataatcagaaaagaaaacacttgcactgtggtgggtcccagaagaacaagaggaatgctgtgccatgccttgaatttcttttctgcacgacaggtctgccagcttacatttacccaaactgtccattactggaacctatgatctgaagwgcgtcctgggtcaactgggcatcactaaggtcttcagcaatggggctgacctctccggggtcacagaggaggcacccctgaagctctccaaggtgagatcaccctgacgaccttgttgcaccmtggtatctgtagggaagaatgtgtgggggctgcagcwctgtcctgaggctgaggaaggggccgagggaaacaaatgaagacccaggctgagctcctgaagatgcccgtgattcactgacacgggacgtggtcaaacagcaaagccaggcaggggactgctgtgcagctggcactttcggggcctcccttgaggttgtgtcactgaccctgaatttcaactttgcccaagaccttctagacattgggccttgatttatccatactgacacagaaaggtttgggctaagttgtttcaaaggaatttctgactccttcgatctgtgagatttggtgtctgaattaatgaatgatttcagctaaagatgacacttattttggaaaactaaaggcgaccaatgaacaactgcagttccatgaatggctgcattatcttggggtctgggcactgtgaaggtcactgccagggtccgtgtcctcaaggagcttcaagccgtgtactagaaaggagagagccctggaggcagacgtggagtgacgatgctcttccctgttctgagttgtgggtgcacctgagcagggggagaggcgcttgtcaggaagatggacagaggggagccagccccatcagccaaagccttgaggaggagcaaggcctatgtgacagggagggagaggatgtgcagggccagggccgtccagggggagtgagcgcttcctgggaggtgtccacgtgagccttgctcgaggcctgggatcagccttacaacgtgtctctgcttctctcccctccaggccgtgcataagrctgtgctkaccatcgacgagaaagggactgaagctgctkgggccatgtttttagaggccatacccakgtctatccccyccgaggtcaagttcaacaaayyctttgtcttyttaatgattgamcaaaataccaagtctcccctcttcatgggaaaagtggtgaatcmcmcccaaaaataactkcctytcgctcctcaacccctcccctccatccctggccccctccctggatgacattaaagaagggttgagctggtccytgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatrctgggcttgaatccaggggggactgaatcctcagcttacggacctgggcccatctgtttctggagggctccagtcttccttgtcctgtcttkgagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctggggrccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctcccyagtcacatggccataggcctgctgatggctcaggaaggccattgcaaggactcctcagctatgggagaggaagcacatcacccattgacccccgcaacccctccctttcctccyctgagtcccgactggggccacatgcagcctgacttctttgtgcctgttgctgtccctgcagtcttcagagggccaccgcagctccagtgccacggcagraggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctrtggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgcacttatgagctttctgtgaatcagacatccctatgaagtacctcccctggctgtttctcatttactcactgtagcagcactgcgatgtgtgagtatatctgctgtgctcttaaactccaaatctgaggaaactgaggctcagagaggctactggtctcccacaatgtcacacagctcataagtggcaaagctggcttgatgggctacttgttcctctgaaccataccacctcaccacactctccccttcgagggtcacgctaaacttctgcagaggtaattcctccttaaaccagaagggttgctggtggcccacagctcacgcctagcacacttcatgagaaaaacaccctgtgcccagtgtggagcaggcattgagctgaaggtggtgagcagaagctcatccaccagatgttgacacagcccgcagccttgggcgacccacaggactcctcttatttaactggcatttggtaggagaacaggggcagagtcaaagacaagttggctttctggagagcccagggcagggaaggaggtggcagcgctgagggcggtcaccttagacaccatcgttttactttgaagaattgtctgtcacacacgagttgacagtcaggatgggagagaccccattcaaactagcataacctcccagagggaattcctgggctcccctgggaatcaacagggatcagtcaaggatgggcagagtgtcatgacaacctcattatgaggaagacaaatatatgtcacaagtccgtgatgggacaaccataagacctcagcttcactgtatcttccagagttttaaaaaaatgtattcactgtccaacgtgatcctccagacaggttctgcaggacgcagcctaggactcattatccccaaagtacacatggggaaactcaggcccagcaggtcaaatgctctgtccagtgtgggcctggaaggcaggtcttctccactgttaggcctggctgtccccaacagcacatacttcctcagtccatatgggatcacgataaacaactccatcctccaggaccacactgcatcaacctgctgtgccctaacatcagctgaaggccaagctgcggggcaccctgggtgttccaagtcactttccctctgcaggcaggaacctcatcctgctctgaaacagatgagagggaaacgcagaaaacagcttccagctcagccaggaaccttagagtcctgaccttttacctcgcctaggagtttgcaggggagagaacacacraatttcagattttaagcctaaataaaggaagccttagtttgaagtgcaagctctgccggacagggggcaccctgtgagccccatttgttaagaggacaatagtcagagagcttccaggctctcacaccagaaacaggaaatacagatttcacactgatctccttcccaggagcaacttgatcctctccataaatccgagcgggaagcatttatccaaacaacaaacaagcaaacatgagctgtgtatgggggatagagagaatgaaacccaggtccatcccggggagaatgctggtctatggcagtggggagcagtgaataaatgaggcgtacatccatggatctgggtggagagggtcagggtgtaacccaggacctttccagaggcatgagaaacagtcagcctacacccacagatgacctcaaacaccccaagtgctccttgaaaggctgaggcctttgtgttgctcttggttggattattcacaggcaatgaagtaaacaaggcacaccacaggactcagaaccagggacagcttccgcaggaacctgggtcagttctaaaaggacaaatggaatgaccctgagtagagaagtcagagaaaggcactctcactgaggcaaactccctccccagcagggacccaggcagcaactcggaaaagcaggagtgtcactattgtatcatatgggagagggcaggctgtgtgctctcagggaagttcctcaacttctctgtgccgtagtttcctcatctgcaaaatgtaaatcaaatttgaggtttcaatgcaatgacttatttctctaaagttccttgtccttgtcccatgtagcccagaaatcttcctctggcctagttgtggagcctggcctaagtcgcacattgctggagatggtgaagctgaccagcatgagaggtcagtttctagaagcccaaatcccaacaggcataagcctcaccctccaatatcagctctatcagaaacaaacaaacaaaaacatgtcttattcatttgtccttttcctcaaatgggtggcacttgggcagggcagaagggctggttatccaagcttggaagatgctgacagcagacgcttcaatggcagtaggagttttctgatcactgtcattggtatcacgcttactgttgaaatcgtgacatcaggaatgatgaaaggaactagagtcagatggtctggagcggggaagtgaggagctgaaacctccttcagtctggttgctgtgtccccagggtgggtagatcccctctgttcatcccacatgggacaagtagagcgggagaggaatcaaccctttctaaagggttgaagcattgagctgtgagcttctcggttgctgcagcacaatccttgcccatcctgactgaaacaaccagaattcatgaaatgcatcaaagaagtcttcacctactacgcaagcctggaagggtgactaagatctgaaaaacaccgggaaggctaaaggaactcccacaaggaaaccccattagaaagttctagttacaagatgctcagcacaggccatgcagaaatacgcccagatccggtggtgagcaaggaacggtaggaatgtgagcactgagtcacgcaggagagactcataggggctcaagccagcaaggggacggcctccaccccacgcactgttggccaacagcttccaggggcatttgctctcagaagtcaaagctgattttccacaattgaagtgctcactgtttgggatgatttaggaacaacaccaacaaaaaggaatgaacaatcagagctaatagaattgtgtttaaactctgctgggcttccttgacagagggcacggggagcaaacaaagtcagcagtgtgtcttaagtaaaaaactttttttccttttaattggcagttaataccctcaaaatatgttctgagattgatcaagtaagtgtctttcagcattaaaatattaggatgaaattgctaagggcttcttagcaaagtggaaagaacacaggaatcccaactccaccttctccttagcatacaatcctgagtgggctgttacagctctctgtgcctcggcgccctcacctgcaagacaggtaaaataaaactcctaggttactttcatgaataatatgcaaagcatcaccctaaaaaagtgctgctacttaaatgaccaccaaacattaatgaatactgtggattccaaaaatattagttaatgtgagtggtgtggctaccttcccccagtgccccgtgctctgtcagggaactaacagaggaataaattacagatattcacaagtttgttaccaatgaccctgagctaggaatcagcctgggatcttttcccaggtctaccactaatgtgccacctaacactgcggacatcctctcctctccctgagccccagtttcctcaccagagaatgtgagcattgaggtccctggagtcctgacattccatagagctctgagggcttcaggccggccccacgtcagtctttcacctgtgtgccctgtgcccactgctgatctggggcagaggaggcacagggaaagggcccaggctgctcttaaaaatcgcatctcacattgagaccgacgcatggagactgcggcagaagcagcagaggtgaggaccccgtgtgagtcccctgtggctgccgtagctgatttagctgattaccatgagctccgtggtttccaatagaatgcattcttttacagttctggaggccagaagtccagaacagtatcactgggacaaggtcagggtgtcaggaaagccgagtgtccttggaggctctaggggatgtgccacttcttcctcttccaatttctggtggctgccggcattccttgacttgttgcccctccagtcacggcctctgttgtcacactgccccctctttctccatctgtgtcaggtctccctccccctccccctcaggaggatacttgcgatagcatttagggaccacctggattgtcttctcctaccaagacccttaacgacatctgcaaggacatttcttccatagttggtaacatatctctggggggcgctgttgagcctgtagaatgccctactttaccagtgaggggatgatggggctggaagagggaaggaatgaaaggagtgtgaaggaagcgccaccaaggagagctgtggaagcccaacccaaagaccgcacctgggatgtcgggaagggccaaggtacagaaggagaaggaagagggttggaggtggagggccagcagcaccaaggctcggagccagggtgaaactcccccgccaggggatggagagaaatggtggggtcgttctctcaggcagtggcacagcagagccagggccagatctggaggtggctgtgcccccctggggggtgcagactcacagcccctccaacagggagcccctccaggtgagagcgaaatggagatgagcgcaaaaccccgactatcaggcagattctgcagcaaaaatgacttcagaggtgaactgtgtgtagcctcaggaacgggatagaggtggcccttgtaaacctaccctgcaatggtgtctaggtcccatgtcccctgttccagacagaggcaggccttggcctcctgaggagggacagcaggagggcaggtccctcactgagcctggagtctctctctctgtacagcaggcaccttctcccgaccactcccaccaccaacatttcattctattccttccctcagggggcagctacaatttctctcttagcccaaggaaaggaataaaacaaactgccttatattgaagtgaacatggctgatctgggcttattgggagccctcccaaggggcggggtctagttctcattatcttctccatcaaggtggctaagaatttttgcagtttcttataactcacaaagtactgtcctagaagctatatccccatgaggggaggtagggcaggtattatcaggttcgcttacaggtggtcaacagagggtcagagaaatcagtgatttggggagctcatacagctgctagatgtagcctggcatcagtcaccgcaggagggcccaccccggcctgagtgcaggcagaacgctgtgacactgagtgacatggacaagtcaccatcctgagcctcccattctcactaacagagaatcaccaccctcggcctgaaggacaggttgtctgcaggtgactgccggggtcacggcaacagcttcccccctgccaggcctgggacccgagttgcagggagtcaggtgtatggccttttgtggtgtctgtgtggtccaggaagagaggggctgcaccgtgtgtgtgtgtgtgtgtgtgtgtgtgtgtgtgtgtgtgtgtgtgtgattgtgtgtgtgcatctgagtatccgtgtctctgtgtgatgctatatgtcaatgtgtctttgtgtgtgtgtgtgtgtgtgtgtctctgtgtgttggcatgtaactgtaatgtctttcc

SEQ ID NO: 17661 - DNA, 149382 bp, Homo sapiens
  misc_feature (1)...(149382): n = A,T,C or G, or insertion/deletion polymorphism (see Tables 1-2)
ccagtgtcattcaggatcctgatgtcttccgtcttgttcccactgtgttggccacattttccctcacagttatgaggggacagcagtttcatatagaaattactgcatccagacaacaaaaaaacacaaaaggggaagggatttctgttttgcaactctttttattggagagaaagcattttgcagaagatctcaggagacttcccatcgagttccatcatcaggactgggtcatacgcccttgctctggctgtaagaatgtctgggaagtgagaatctcgcacccacagcctctggtggaggtgggctttgccagcaatcaagggcatgagatgcctgcaggaaggcagccaaccacacctgcctcatgcctctaaccctattcccctctaaattcccatgccaaagccttagggcattatctttgatagttacctggccaggtgttaactaactgggaactgggtgtttttgaaggacacaaggctttctgctgtcgaatttgtcaccttaattgtgatacttttaataaattagcttccagtctatcttaaaaccagatggattttcctgatgtgtcaccgtgaacatctctctttctccaaatctctcaatgaggaggcagttgatgagttaactgcatgggctttggtcccagatcatacagctcacatccaagcgctgtcacttaccaactgcatgaccttgggcaaggtatataatttctttatgactgaattgctcatcttttcaaggagggtaataaaattacctatttggtgggattggtattaacagtaaatgatataatacaggaatggtattgacagtgagccttcagtatgtattattgtatctgctgttattgttccctacttcatatccagccaaatctaagcttattagatgaccatttaagatcctctaggagctgggcacaataaaaattttcaaacttatataaaaattgactacgtcctaaactgcgagctccttgagggagggattatattttatgagcccaggatctagcacagtttttggccaaaagtagtttttctttattcccatgtgacttttgcttaagcaaaaggccttgtacagcaaatacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgaaaaatgtcaaacctatagaaaagttgaaagaatagtacaagagcactgatatattcttcactacatttgtgactgttaatatttttaacctctgcttgctattcatacatatattctttttttcccctgaaatcatttgaaagttgccaacatcatgacacttcactttcagcatgtatcacataagaacaagcacatcgtcctatgtaatcacagtagctttatcttatgaaatttaacattgattcaatattatttactgtacattttttcttggcagtttatgatcttagaaatcaagaagcctaaaatgaatcactgtgtgttttgagggtcttttggtagaatcatgttcctttctgggtgttctaaaaagttcctggatctttggggtgagattctgtttgagtttcagaacaatgtgtgcatgccatcagtttgatagctcatggtttgtgttccaaaggggcagctattagtgttacctgtccctgctattgctcttgacatcatgcagggacatcctcagtagctgctctttctgcccttggtctgtcatttgagcttgtgtttccaaagtcagatgcaggaagattgggtcctcacaacagggcggtggttggagcacctggatgccaagcctggatctgtcctatcatttgagggacatttgtgttcttggctatttgtgttcttaggctgccataacaaagtacctctgggtggcttaaaatgacagaaattgtctcacacagttctggaggccggaagtccaaaaccaaggcattggcagggtcacgctccctctgaaggctctaggggagaatctgttccatgcctttgtcccagcttctggtgttgctggcaatccttggtgttccttggcttgtagatgcatagcacctccattctcatatggctgccttctccttgtgtgtttcttgcccacttcttgaaagtacaccagtcatactggattaagaacccaccctactctagtataacctcatcataatttatccataaggaatgaccctattttcaaataaggtcacacttgaagtactgggggttatgagttcaacgtattcttttaggggacacaattcagcctataacagggggtcttaggctgatatctgtgagtctctgcttcctcaaaggtttttcagaaaatttaaatgaaatacaggagaattatgccctgcagtatttgactttacagcaggagtcccccaaccctccgggccatggacttgtactggtctgtggcctgttaggaacctggccgcacagcaggagaacgagggcattaccgctgagctccgcctcctgtcagataagtggtggtgcaaaccctattgtgcatgagaggggtctagggtggactgtccttgtgatgcctgatgaaacatcccccacaacagccctccaccatccatggaaaaattgtcttccacgaaattggtgcctggtgccaaaaggttggggactgctgctttaaagtcccttatataggatttacattaaaaattttccagtggtctccaaatgtcccttataccttcctatttttgggtctaggctccaagtaagaatcacgcattgcattttgtcatgcctttttagtctcctttaatttaggacaatggttctcaaacttccatgtgtatgagaatctcctggagagcttgctagagcaatctcctggtgccaaacttccacgtttatgagaatctcctggagagcttgctagagcaatctcctggtgccaaacttccacgtgtatgagaatctcctggagagcttgctagagcaatctcccggtgccaaacttccatgtgtatgagaatctcctggagagcttgctagagcaatctcctggtgcccatctccagagattttcattcaataggttgaggcaggacccatgaaatggcatttctaacaagctggtaggtgacacaaaagttgcttgtctaaggaccgcacttttgaaaaccactgatctagaacagaggttggcaagctttttctgcggagggccatatggtaaaatatgttagcattttcaggtcatacagtctctgttgcaacgactcaactgtgtcattgcaggcaaaagcagccctagataatacataaacacatgggtgtggccgtattcccacaaaactttatttacaaaacagctgccttaccacatttgacccacaggttattgcttgctacatggatttagagtagcacttccactttttttctctttttttttttggaggagagttgttttttcagcgcattaatattttgcaatagtccagttcagttttcttgtcatatgtttcacagtttgaatttgattgttttatctcaattagattaagttgaacttcttggcaagactacttgtgatagtgtgtacggtagggaataactgtgaaagactttgaaatggaccaaaaatattagtggtcaactgtaatggaatgctagctgtttagtacagtcttttgggttatctgattctatggggtcttgtgtctgccactgtctttgaggtattttacaactctgtaaattgtagactactgatggtaatatacacgatttttgtctttagaaatgcaaattgtgtctattgcgtacgcagctgttttttgacctatggttactgaccaattttccatctatagacaaccttatttcagcattcctaactgcttgaatatttgttggattctccttggattttcctttgaaccagctgtgacatgttaccggttctcacattaatgaatgagctaaggaatacctttgatacatgttcattctacatctgagtcatgattataccatcttttaaatattaccctttagcattttttattgcatcactttagaaagcagaaaatgctagttttttaaaaattggtgatactagttttaattacttgattaaggtggttctaccagatctttccattgtgaagaggtattttgtgttttttaaggaagtatactttgaaggtgatactttgagacaaagagaatattccgcttcacaataatttttcaccagatggttttagtatttactgatggtctttgcctgtatccattataacactggagttgcaaaacacaaaccctttttctttttttttttttttgagatggaatctcgctctgtttcccaggctggagtgcagtggcacgatctctgctcactgcaacctctgcctcctgggttcaagcgattctcctgcctcagcctcccgagtagctgggactacaggcgtgtgccaccacgcccggttaattttttgtatttttagtagagatgggatttcactgtgttagccaggatggtctcgatctcctgaccttgtgatccgcccgccttggcctcccaaagtgctgggtttacagtcgcgagccaccgcgcccggtcaccacaaaccctttttcgacgtccacagtttacacctgagctctccctttgacccactacaacactttcttttcttgggcaatatattaatagcacggtggttatgtcacaggcctgtgactggcttgggctcaaacccgggctttttcacttactagctgcaagactaactagttatttaatttctccattcctcactttccttatctgcaaaacggatgcaataaaggcaccccctcttacaggactgttaggattaaatgagctaaatcacagtgtccgaacacttcagtacttcgtacataattacttgctcaagaaatgttagctattattgggtcatgattatttatatgtgtttgaattccagctttgccacatcccagagtgtctttgagtaagtcactgagtatccttgtgcctcaattcctcatctataagtaggttcccatctcataggtttttaaagattcatgcttacatgcttagcagtgtctggtatggaataagcactaaaaaagatgagcttttatgatgatgatgattactattttcagtcatgattattttgtatatttactctaaaagaaagtgaatttttttagttcaagacttttagattcatcgttctactttcattgtggctagctcatggccatccacgtagtgaattaataaagctttgttgagtggcacttgcttgacagcgacacttttgtccactctttcaccttgctggatttgtgctgccttccttgctgtaggaagcccacgcttgggaaataacattcccacagaaggtctgagaggctctgacgggccaaggttgtaaacccccatgatttgactccacgggcagttaaagtgtgttcccaccccccacggatccgctgccactaggctgtgcgaaggcatttacctccctggcactttgatccaagttccctattttcccctactggtcgatcgaggttgggaacagttgctctaacctgggaagcacccgccacgatccagcagggcgcggtgggaggggaaactgaggcccggctaggcacccccgccgcgcccagcccgccgagaggctcaggccccgggaggcacctggagcctgcgccccgcccgcgccgcttcctgtcccgcgcgctgcgctcacgtgacccgggcctgggaggagccggggcgggcgggggtcacctgaacaagggagtcacgtgagcggggggcgggggtgggggggcggtgccgggcggctgtcacgtgacgcggttccggggccgccgtgccgtgtccstgtcgccgagcccagtcgagccgcgctcacctcgggctcccgctccgtctccacctccgcctttgccctggcggcgcgaccccgtcccgggcgcggcccccagcagtcgcgcgccgttagcctcgcgcccgccgcgcagtccgggcccsgcscgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcaggtgggtggcccgcccggacgcaggctccgctcgcggtgcccggggtgagcggccggcgtggggggcggggagcgctcgaggagctcctggggtctccaagtcgcctccgttccgcgccggggtccgccccgttcccgagggaaagttgcctgcgtggtgtccgcgagtcccgccgggtcccgtgcgcaggcggggggcgcgggggcacacgcggtcgtggcggtcctggagccccgcgtccggccacttgtggctgtcgctgagtcgggggtggctttgtgcggagcggtcgccccggcccttggggtcggcgcctgccctcgcgcggccgggcgtccgggaaagttggaggcagraactccagtttgctttgttcccgctgcgcgtttgcatcagagtttcgccagcggggcaccggtgaggcccctcggtgtggagaggctcaccggggcgttggagcccgcaggaatggtcctggagttgagtgtttgtggtttcatttgctgattgatttccccccgtgggctcattttctctttaaagaatatatatatatatatwtttttagcaggcggtgacttttgtcttctttagattgggggcagggggtgtcgtccagtgtgagctttcaagacttgacccttcacttctctgagcccaacttcctgcctggttgctcacatgatgtcattgtctccggggcggattattctagtggatcttgctctgggaaccatgattgtataacccatcagtcccatcgagggctgttcacctcgcgcaactgctagcagtccagggcctggggaacttcgaatttcaggaattttctgaccatccttttctggactgtttaggatgatggaaaattcagcttttgtttatttttttaaactttggtaaaaaggaagcaggatgaaaagttttgaacagacaacagtttctccctgttactgttacttttacaagttacttttacaagttacttttcagagtgaaacaaagttgagcctactttgggctgaacttggagtttgtggtagggtttatggggggggttcttatttttcccatgcatcagagatagttttattagcacccctgtgttcagaacatgcagaaattagtctaaggagggtgaggctgatctcacgatagaaactctttggaaaggcccatattttttatgctcccttttttggaaggggaagggtggatggagggagagtttgtgacactagtttaaagaccagttagctaccctaagatacatagttactcyagtaactagtatgatacagagaaatggtggcagcttaaacgaggtcaggctgagaacaacatttagaggaaggcattttggaataatggcttctgtgaccaaaaataagaaattaactcgcctgggcgcggtggctcatgcccggaatccagcactttggaaggccgaggtgggcgggtcacttgagtccaggagttggaggccagcttcagcaacatggcgaaaccccgtctctacaaaaaatatgaaaattagagccgggcgcggtggcacactcctgtcctcccagttaagggaggctgaggtggtaggatarcgttagccccgsaggtcgaggttgcagtgagttgtgatcgagtcgagttgcactctagtctgggcgacagagcaaggccctgtctcaaaaataaataaataaatacaataagaaattaacccagctggcctagtgtggttgaagtcttggtcttgttaacaaattgaagtttgttttcttcacagttaagattaaggtggcttcaagggcagactgatactttggctgattgatgggacccttacttttgcattaggttagtcatggcagtgtcttgaacctgtgttcacgaacttcatctccaggtggaacacggcctcttggtctagtaggaatggcctttgtatctttacgtttttctggccactgtcacacgtgggcatacttagcaaatgctgaaraggtttctgaggttgatatgcattgtgaatataataagatctgccctttgtagtcttagaatatcttaaaagttgtgtttaatttttctgccagattttcttaggatgacaaatctgccaatcatttcagagacggattttcacccacctctttccctgttacttccctgtagttgcacatgcagacttctccagaaccacttgcaatctctactttaaacccaacatgtgccaagtgaacttcctgtctgttcctgttttataattttttgaggcagggtctcaccgcgttgcccaggcagaagtgcagtggtgcagtcatagctcactacagtcgtgaactcctgggctcaggcagtccttccacctcacccttctgtgtagctgggattacaggtgtgtgccaccccacttggcttattatatattttttaaaatttttaatagagatgacgtcttgctatgttgcccaggctggcctcaagctcctatcctcaagtaatcttcctgcgtcagcctcccaaagtgttgggattacaggcatgaggcaccatgctgggtttatgttcctgttttaaactgatacctctccttaaatactttttgaaaacttttcttggggcgggggaggttatcagtcatctgtacttttatgagataaaactggctaaaatttccgtaaatgtagcatgtagttgaggaataggaatgtaagttgattttttttttaatttgatacaaaaaattttatcgtgtcaccaaggtgtgacgtgttaagctccattttaattttgttcctgggcatcagtttgctgaaatgtaaataactcggccaggtctccactgtgagcatgaaaagtcgagtcctacaaatgtccccgtttgtttttgctgcttggtcacatggaggcagtcccaaatgtacagaaggatcacattccaaatgtttgtaaattggtmatttcatacgtggaatgtgtttttccattgatagtattcttgttcattgtatggcccccagaaagtcattatccttgcaaaggttttggagcacccagacaccatatggctttaacagaatcctagccgtaaattctcattgtctctaaaagatggagttggatttccaggaaaactacctctcctcccaagcccagctctctagaacctagagagaatatttttcatctgcagtcgcttagacccacaagagggacatgagggcctgcttcaggggtgcctgcgaggcaccttgtgggggcaaagcttcaaggtgacctttggctctgagcactcctgggatggggtgcggttcctggtgcagttagttattgggaggaacgaaggagacagcaccatttcagcagcagctttaactgtgtccgtgcacgtggaggggcctgccctctgagttgtgcattgaacagcaggcaygacaaaggcwcatttcccaaagtgtatctggcttgaagcagcgctttaaataagtgcatggttttttttggagagactcagcaaagcatttttcaagtgtcaagtggattacttgccaggtggtcccagtgctgagttagaagttaatgattcttatgcaggtatttcttgggaggtgatattgctagtacaaagttagtagaaaacttgtttctgaggctagtgtgataggctgtgggactggcctgtagaaaagacctggggcaggaaggagtgttgaaggtcagtggagggcgggaatagtagagcaagaagagagggcattcaggargagaggagcagaggccaggccatgcaaaaccaacaacagtgtctaaagtgatctcrgcttgtcagtggctttacttattaccatatgctttaaactttgtaaaatgtcatattatatatgtaatatgcaagtttccaccctttagttaggtgttaacaagatgcttaatgggtgaggtcttagcagtgtgcattaatgataaaataatgctttgggatggttagatttaaggtagttaagagcttcaaaatttgtacaggacaagttttccccaaattgtttaggtataaatgctagaaagtttttattatattgaggacaagagaataatgaagccagctgggagttgaggttggtttagttactgtctctaaggagatttttttttccctgtaatttttccaaaggaacagtgcttatatgcctaatttgggccacatgttaaacctggatcacatccatttgtgtgtgtgcatttcaacagtaagtgtatgtggaagcctaaggttgttaattatggttacattagatctcatggrttaattctcagaacagcatcctgacagattcccaggaaatgaatgcctgcgttgggcctcacgtcttttgtcagcatttcatagagagagggatttttaaaagatggggctgagagaaataattgagatgttcccttccctattttgatcttggtatataaactattgtattggggaaagaactgagcaggctctagaactgagcctagtggcagagagtagcttatcactttgcaggtgctgttctttttcttcctccttttcttctttggattgtcctagccacagagagctcttgctaatgttgtaactggtcatgaatggtgtatgaggaggtgggcgtagcagctgtttgacttcatgggacccaccagactgtaatgccgaattacaattttgcatttccaccagtgatgtatgagagttccagttctatatccttgtcaacacctgtcagtgttaggtttagccattcaagtggagttgtaatggtatctcagtgtggtttcagctttcatctctctgctgactcatgatgttgagcaagaaaggaacatcttttcttgtatttattggaatcctggatgatgttcaccattatcatgtgcttactgactgggtattttttgtagtgtcctttaaaaatcatattttgtcccttttaccccttaaaaattgtttttgggttcttctccttattgagctttaggagctcctcatgtcttctgggtacaagttctttcttagatatgtgtgaggtatgagtgttttctttcagtctttgccttgcctttaaattttctcagtgatatcctttgaagaacagatttaaaaaaatttgatggactataactttttatggtttgtgcttttggtagcttgagaaatcaaccttaaaactrgtgacatttgacctgggtaattttttgtttggagggctatcctgggcattgtaggatgtcagccagcattcctggcctctactcactagatgctaagactatactctaccactccccctcccccagtggtaacaaataaaaatgtctccaggcatatcaaaggccctggaggggagggggcaaaatcacatccaattgagaaccactggcctaccccaaggtctcaaagattttctcctgtctctgcctctagaagttttttggttttaactttgattccttaactctaggatcaatttttgtggtttaatttttatatatgatgtttgaagaaaactcaaaccatatttttcctttgctctcattccatgaacagtcatcaacacagaagacctccgtaatcaaatgtgtggtcgtttttccccaggcaccaagcagtgacccctggccaattcaattcctgaccctgtctacctggagatagtgtcagatgccacaggtttggggctcagttcccgagaccgctccccaccccacaccagtcacaagtccgggcctctggaacttctgaccaactggcttcaatttggggttcccagagtgcctctttgggtctgattaatttgctagagtgacttacagaactcaggaaaacactgatgattagcagtttatgaggatattacaagggatacggatgaagagatgtttagggcgaggtattggggaaggggtgcggagcctctgtgacctccctggctcactaccctccaggaattgccgtgcattcaactatttggaagctcccccaacccagtttttatggaagcttcaggaggtcagcatttcttctcccgggtatagggtgggaccctcactggggaggatcttaagacccacagtccaaaagcagggaagatgagagtcctaccttggggcaggtggaaggaggggcaggtggagagattgtttcctgaggcctgacacacccaacattataacaaaagaccaatactaggactgtggaagttggcagccagaaaccagatgggaaaaaaaaacccatacatgtattatatatatttatatatatatatatataaartatatgtattgtgtatatattatataagcatatttattatatatatattatagtgtatattatatatgtattatatataatatataatatatagttatatataatatatacacacgcacatatataaataacaccacaaaaagggtaaaagtttatttatttccatgaatatatctagttctgtttactaatactttatgaaatatgcttacagctctgtttttaagtgagattgggctacagtttttttgctctgctgttcttgatggattttgttattaataatatgtttgctttgtggaaggagctagttagcttttagkatttttgtatgtggtgaaacagtttgtatataagatggacattttctgtttcttaaagtttggtagaattcaccagtaaaactatctggccctggcaggctcttaggtggaatatcatcggggaggacttttgattatggttttttctagttttattttcagttttatctagtttatttttctattcagattttctactttttcttgggccaattttggtaatctctattttcctagaaaattgtcattttaattgtgtattcatatttaataagtagcatgctactctcatatttttgatactctatagctctaggtaaatttttaaaattcctgatgtttacttgtgtacttttttcttaattatatttactaaagacttatttacctttttaaagtctttccaaaagaactagtgttttgttttttcatcttttcaccttttatttgcaattttattaatttatccactcagtaacttctacatcatttttctgtttctcgtttgacttgaatgcttagctcttttattttaaatcattttgcataattaagaaatatatttaaagcttcatgtttctttcttcggagtaccataccactcatagattctgatacttttttttttctccatatttcaattttgtgtattycctttttggattcaaaagttctatctgtttcaacttcctggacccactaaatttttagatttttatttttttcaggtccatggactttgggggttttaaatttattttttccattgtgcgggtaaatgtggtggaacttactgacatttcccttgtggcctaacacctagtcaagttgggagggtattatgtgtttggaaaaaaagttctctgtttgggtcaaagttactcatggtgctgttcagcttttctttgccctaactcttcttcggtttgtctgttgcttttattatttgtatctggctgccgctgtggacaggcaygtagctggatgtcgtttgctgctgtcrcccagcttaccagttctcccatggttcagatgttcttctgcttccctgttgtcttttgttgcagaatctcagctgatgtgtagtcacagctgcctgttctttctgcgtggacgctgtagcttctgtcaaccctctgaagatctctcttaaagttctgctctgattgctctattaattatttttccttgggcccagtttctttggtttgagtttgtcaccatgattgcatggtgctggtgcccttgcagtgacaggtgactcctgaccgtgcactctgcagtgggtctccacccgaccttggctgcctccttgtgcagctgcgtggggtagggctgggagcagttgttggaatttggctgtaaattgttttcagggagactaggggatgggcaggatgtgcctctgtggctgttcttggcgctttaggtcctttccaccctcccaatgtcacccccaagcgctgttctgccaagacacagctgctaaacccctgttgattgctgctggcagcgtgtggcctgagacgggggatctggattgttgagttggctgtgtccaatcacttcttttctctggacctcattttcctcctcaagaggggtgggacttagttttctttctctctttcctatttgaaaacctytcattagggagttagttttggaagtcactttcctgggcttgaatccagactcctcccctcacaggccttgggcaagtcacagaacctctgargtcttcctttccgtgtgtgtccagtcaggatgctaaccatgtttgtaggctaggcgtgggatgctaaccgtgttgtaggctaggcgtgggatgctaaccgtgttgtaggctaggcgtgggatgctaaccgygttgtaggctaggcgtgggatgctaaccgtgttgtaggctaggtgtgggaattggaagacatttgaatgcctggcacgtcctcggtgttcattggtgctgtagtggtagcagttgctttatctgtaagttacagatgctgccttacatcagggatttatttttataacctgtttctcgccctcccagagctctccattagtgtcttggggtttctgcctcaaccagagagcatttcttcttcatctgtttcatgattggcactccacgtaagcttcctcatgagaaagaaaggtttccactgtttaaaaaagtttcaaagccactggactccgtgatttccgggtccattttgcatcccaaattctgcagttctgaggtttgcagccttgaggagtccttcctcactcagattcccccaaacaatgaggagcttgataattcgaggtgtggagtttggatgggggccgggggtcaccstcctgcatgtggtggcttggtcccaggctaggctgggagaaagggggctgtcgtggttccagggcaagaagagccgtcctccctgtttccctgtggtaggatcaggaagtctcagctaacttctgcacatggtcaagggggtcctgtcctcacttaggcctctccaggcctccctggagggtggaggaatgggtgctgttgtaggtgggaacagaagtgtccaggccagtggcttggatgtgaaagtgcttcataaattccaccttgctgtgcaacttaaaaaaaaaaagtacggtcgtttaggttttcgaggtgcccaaagcaatgcgtcataagcctatttttgtctccgtgttagccagggcagaggggcactttcctgtgactcctccagggtggggaaaatcccaggtgctctgtgaacctggccgttcagccagctgcagacctttggtaggagttttctttttccttttgtgtgcttttcratcccctgggggcaaccattattcagtacatctggagggcaagttgtccaggaagaggaagcagatcctaggagtgtcgtccttcactgggagaggtgtaggaagtgagggggatggtggaagtactggcccgagctctgttttcaggagtgtgtgacagcaaaaactggcctttgcagttgagttgcctgtgggctatggcctagagggaaggccaggagggtcttgctgttagggctgccaccttcttcatgcctgctgtgtgctgggaggagagagctccttcagagcggacccaccrttggattttgagtgtgtgcaaaattaacttgttgctatctgcatggttatctgtactccagaatcagttatacattttaaaacagctgtttagtactgaaaaaactcccccaacactccctgcgccccaccctggcctgcaaatagagtgccaagccaccagaatagaagtgctaaagtagtgagtttcctagaagtggcaagcctgagactccagtgagtcaccctcattgttcccctgaggcaccctgcctccacctgctctctgctctcgaagcgtcagttataccagcacttctctcttctcttttgtctctttttacagtcacccctttagagtgacaggcagcgtgagctcatggccttgactttgctggacatgcggagggagaggagagctggtggcagagtcgggggttgggccctgaggatggggctgttttattggagagtccgctgtcaccaggcctttctgtaaaaggctggaagtgagcgagtgaaccaggcascctggtggggggcctgcatgtcagacccagcgggaagcatgtctgacttggttgagaggcagctaagggcccagtgtgtctrggtgggctgagccattgggagaatggagggaggggccagagagcacggaggattagctgtggccagatcacagaggctgtgggactttgggctccctctgggtaaaagccagagcccttgaggacttcagtagattggtggattgaaaggcacatgggccggtgctgtggctcatgcctgtaatcccagcactttgggaggccgaggcgggtggatcacgaggtcaggagatcgagaccacggtgaaaccctgtctctactaaaaatacaaaaaatcttagatgggcgcggtggcgggcgcctgtagtcccagctactcgggaggctgtggcaggagaatggtgtgaacccgggaggcggagcttgcagtgagctgagatcgcaccgctgcactccagcctgggcaacacagtgagactccgtctcaaaaaagaaagaaagaaagaaagaaagaaagaaagaaagaaagaaagaaaggtacatggaagattcgattgcttggattgccttagggaactatgrgatccctaggtgagggttgcagttgagcatggtagctgcttttcctcttcaggttgcctttaggctgcgatggagatagcatgagctctggagcaggacaggcttctttctaacatgggcttggccactttgtgaatttgtgatcagagacaaggtcacggacctcactgggacctccctaggctgtccattctgagtctgtaagaaggtggagaggggcagccccagctgggtgttaggctttgcggagcctctgctgtctgatgtttggctccagcatcttcaaagcaggggcttttctcctctgtccacctgattggcctttgtgaggaaccaccacctggcggtggcctcattagcatcatgggccagccagctgagctgacagcccgcaggttttctagaaaggcccaccttcccttgtagtttgcacactccaggaagggccctgggtctgggagggttttctgggaccttggtgacagggagagtagggggctgaacattaaggtctgaattctgcgctgggggctggattgtccttaaaggcggttggcctcagacatccacatggcaaagcagggagtttagcccatctacaactcttctttatacatgaggagcaaagtatgagaccgcccaggtaattgctctgattggaagaaaatcatcacggagcagggtttagggttgaaatactggcctgcatcctgtactgttgagttgatctgagccaaggatagcagagaggaccagccatttttgtggtagctttctgttgtggagggcacttgcccacctcctgggaacgccacaccctggtgtgtttgcccttgttctgtttcccctgctgctcttctgctggaagctctggactcacctgtctctgttgtggatggtgcagggcgggcaggccagagtggcatccttgtcctgagaggtcccaggaggcagttgagtgtgtatgtgtgcgtgagtgcgtgtgtgagtgcacgagtgtgtgagtgcaagtgtgtgtgtctgagtgtstgtgagtgcaagtgtgtgtgtctgagtgtstgtgtgtgagtgtgtttgtctgagtgcgtgtgtctctgtcttcatcagctcctaggagatgcctccggacaggggcctgcccrtctctccctccagttccttgccagtgtcatgtgacactcctttcagagggcaccccccgcccccagccaactcacctttttttgtaaacttagtttttaagcagtccaactctctctctggattcaaatgaaagctttagatcatagtctgtttcgatagctctgtgttcctggtggtggttttctcctcacaatgaccttgtaggctagctgagttttgtcgaggaagttgagctgggagagactggctcacacagcttgttagtcagcgctggggcaggaatcyggcccaggcccttcatggcacctttcttagggtagcgtgccccctctctattccaggtgacctctgttacgcagtccccattgcctgccctggttccctgggctctgacatcaacttagatgtcgtgtttgacttagggcttccagccggatccctctccatacaccgggcttccttccagaccctgcatacctctcagggaaaaccaaaggctgacgtttggcatttccctgcttctatttatttgtatttgtcggccctgtatctttgtccacagctttgtgggtttgttagaataggaagtgaagtacttcctatataagctctggccatgctgtgtcaaactcacgtgcttccccagccttcagctcggggtaggagtcttcatgcaaatcagattgtttctcttttagtgtaggcaacagcaagttgttgacgacagtggttaccttaggctcttgacattctgctcccaaggtccagtgtgggaaccctgcctccttgctcctcttccttgctgttttttccctttctccttagttaaggagactggtctggatttctgaaggtgactgtgctggatatgtatgagctgaaacactgtctgatactgttgagrgacagtagtgagccaggtgatttcttgaatactctgttagaggacttgcgtgcatgtcgaaagtaggagaatcttttttggatgttcaggttggaaacacttcacattctctttgtctccaacatgttagatttgttgcttgctgtagactcaragaaacatttctctagctagtgaccatgtatcttgttawgtgaatttcacttatgtgtcaccaactgggtttctgtcttttaaggaaaccaaattacagattcacacgtgcctacttttattattactgatcccatcctgcctttatcttgctttattaattgcaggccagtagtaaaatgtttaatagttacatgaccattagcataaccccaagattcacagggactgaggaaactaagatatattttaaaagagtttggatatatggyaataaatgaggaagggacagagtgatacttcatggagatgttttgtgttgaagggaaggaacccagttttctaagatttattttctttaagagattgagcataccatatattttgatcatagaattttacatactttagatgctagctgtttttaaaaggaaagaactccaaattacatcttgcaagctattgtggttttgcaagcattgagtgatggcatatatgaaaactctgagaggtgtcatattaagataycaatgtcagtttaaagatattctatatctgtatccctatgacattgtattttgaattttttatttttcatttttggacagacatttagaactcactcagtggagatggctctgcatctctgttttaagctttttgaactctaggcagctgtgtcggcctggggctacattgacttcttcattgcagcccctcgattggtttcgtctggaccagggtgggtttcgattgcggcccttgctggaacagtagcaggaaagtagaaacaccttcctgtctctgggttaaccagctgacagtctgttacttgtgtgcttccttctaattggtaatctgccaacacctttcaggatattatgaaatttcaagcaaatgaggttaaaatggaacctctgtacttctgaacaggcgtggactgactgcagttctccaggatagtttcagcagaagcagtgagattacagtcaggagcaaaacagtatctgagctttctttatgggaaagattccgactgtgtgcttggtttatatggttaaattaattgcccttgttaaattaaaaaaatagggtatgtttctgccacagactttgctttaaaagcagagatcttctaaagtcatttgccttgtatttgacttctgctgctccccgtttcctgctgggcctgatggtttgattgtagaatgtttctgagttgtgtcactgttggactctgctgagctgagtagtctcattaaaggagagtgtgcatctgagttgaggaagacaatatagatgtggaccttgtttgyagagttcacaagctgcttacatagaaatagcaaggacagtgcagccagtgggaaggagccggctgagggacttgatattatttccatggaaaccagttgggtatgggaagagaggttgtggaaggcaatgctctggtgtttggcaattcacactgtgcagaagagaaagcagaactggactgggagtatagagtagcagaagtttaagcttggggaagaagttgagcaaggaaaagcatatgatctgttgatcagcrtgatgtgatgtggtctgaatcttcagacagttcacagctttttcatagaggctgtcctcagatgggttcaaccattctgagaattctgcctttacgatayaagtagtatccatgacattaaaaacgagaagagaagcgttttggccaatgacggactgcataaactacagtctgcataaatgaccttggtcctagaagattaggatgaagctgaacaattcttatcacctagtgatgctgtagccattgtaatgtcgtagcacaatgcattagtcacatgtttgtggtaatactgctgtaaacgaacccrctgcgctaccagtcttatgaaagcrtccagtcaggtcctaggcctttaggtccactcactcactgactcacccagagccgcttccagtcctgcaggctccattcattataagtgccctaggcaagtgtgccattttaatcctttataccatatctttgctgcaccttttctacgtttagatatgtgtcacatgttacagttgcctggggtattcagtgcagcgtcatgctgtgtgggtttgtagcctgggaacaataggacataccatatagcctaggtttgtagtaggcgacaccatctatgtgtgtgcagatacactcgatgatgtttgagcagtgacagaattgcctcatgacacatttctgatgacgtatcgccattaagtgagtgactataaaccagtccccccatcagcagttacacttcctgaggtttcagttacccatggtcacttgcagtctgaaaatatgaagatattttgagagagagatgccacattcacataccttttattacagttataattgtgctattttattattagttgttaatcttttacaactaatttataaattaaacttaatcatgggtatgtatgtaaaggaaaaaccatatccgaaaccgtattcctggttccaggcctctactgggggtcttgtatctgtgattacaaggtgctgcgaagggataactgtaatttttctatatgactagcattttattgaatcaagttgtgtagatggttggcaatataataggaactcagagatctttatgccatacagagtctgtccttttaatggcatttattgtgacaagatttaaactaaagttttgtggaatgttttgccagtttttgtgttgtaactgaaactaaatgttttctgaaaagttaaaaccatttctttaaatggaaaataaatgaagccgtttacctaattggttaaggactcacccgtgggcctcacaccgcctaggttaattcttcactttataattccgtgatgttgggcaagttcctyattctgagccttgggatatttggcttcaaagctgaggaacttgggagggttggataatggcatcacgttctgtggggagatttggctcacatgttagctgtgtgggtgagagccgtgctgtcatgcgttcttagccactggccagtttccttctcaagccatcagtagagatgctgatcctgcatctgccagtcattgctccaggagggaagacattactgtcccagagtgacggtgtcaytggggataacagacacttcagaaaatgccaccactgagctgtatgaagtgccatggcagctagtgctggagctgtggattcagccggggagcactgtctggaggagctgctgcagcacatgtgtgtctctccagctgtcaggctggcctttggagtgcatttggattttttgagaatgagagagggaccattggctaactgttttacgctctgaaaaatgacatagaatagcaaagattttacttatttttgctgattttctagaacattttctgtcccagagtgatggttttgaagaaccagcgttcttggaaagatggttttgcatccagaagagtgattttaactaaaatcaggctgcctcccttgaggatggtcactgaattttgtacaactgggacaacggacagggatcctgggttgtttccagtggacaagccgcttctgtgggggcctttgcagttctccccgctcctctcctgtgtcccgctggtttccttcagttgagatggaatacagcatagagtcagtgacttttagaagacttgacagagtttcaggaaaatgctcactgggctttcttacctatcctgctgcagaactttttttttttttttttgagatggagtctcactctgtcacccagtctggagtgcagtggtgcgatctcggctcactgcaacctccacctcctggattcaagctattctcgtgcctcagcctcccgagtagttgggactataagcgtgcgcgaccatgcctggctaatttttgtgtgtgtgtgtgtgtgtgtgtgtgtgtgtktktttttttttttaagtagattcagggtttcaccatgttggccaggctggtctcgaactcctgacctcaagtgatcctcccaccttggcctcccaaagtgctgtgattacaggcatgtgccactgcgcatggcctgaagttctttctttcagaaaatgtattcaacacattcttttgtgtgtgtttgagtgaagacggtgtttccacacagcttgcagatactttcttccagaagcttgtttgttgctaacatttaacatcttactgttacagcttagttttctctttgattgaatatattgatctcttttttttttttctgttggcttttttcttaagtctttacttgtgtaagctcagataacttagtctagaatgtaggctttttctgggaatctcagctgaatggtttcatttgcttggctgttaaatgaaccatactgtttggaatagtttcctaattctggctgtacatgttcacttcaggtagagaattttctaacagacaaactttcagacaaaaaatttattattcctcaaagatatcattacattttatttagtctgtaataattttattgcttctgaaaccattttctagttctataatgtgatcatggtgcttttaaactttaatatcaagttaattttaagaatgattttagcttaggccattctaggggcttggcctttaatctgaaaagaaatttagaatcctttagtttcaaacatgtgatttcttaaaacttgttgtcagttatttatacgattttcaagtttattatgaaatagtctttaaaaaatatttactttagtggaaacatatctagtgatagtttaaccagggtgcataccagagtacataatagtttttggaatattcttcataaattttcagagagattatttaaaccacatgactgtttctgagctcctgttgatactaggggctaggcatattcgttttttctttttgagacagagtctcgctgtgttgcccaggctggagtgcagtggcacaatctcagctcactgcaacctctacctcccaggttcaagcgatactcctgcctcagcctccctagtagctgggactataggcgtgcaccaccacgcccggctaatttttgtatttttagtagagacggagtttcaccatattggtcaggctgatcttgatctcctgacctcgtgatctgcatgcctcagcctcccaaagtgctgggattacaggcatgaggcaccacgccctgccattagtttgttttaaaggagacataatgtccgttgaaacatcagaatgttttaagtactgacagcttgcaggtgtctttggagtgaagtttagaaacctgctgtgaccattcttcattttaaagctgtgactaagaactctgagatattggtgccttcgcctcaagtgctgctgatgggtttgaatggcattgaggttgccaggcctggaggagggctgccttgtgctgagtggttaaatcacccccctgaaaaaagtcagtgtttcaagtattttaataggctcctcctttcctactcccataaccacttacatttgataaatcttgacaaaacaagtatgaaatscaagtagagaaaataatataattgaatagagcaacacttttctttctagcaaccctgatttccagattatcaggacaatatccctcattttattcttttttaaatcttgattctgctccccaagcaaacacactctttaccttatttagatatcccctttgcaagaatggtggatttcttttaagaaaagcatagcaggccgggcgcggtggctcacgcctgtaatcccagcactttgggaagctgaggcaggcggatcacgagatcaggagattaagaccatcctggctaacatggtgaaaccctatctctactaaaaatacaaaacattagctgggtgtggtggygggtgcctgtagtgccagctacgggaggctgaggcaggagaatggcgtgaacccgggaggtggagcttgcaatgagcggagattgcgccactgcactccagcctgggcgacagagtgagactccgtctcaaaaaaaaaaaaaaaaaaaaaaaagaaaagcatagcattttaggtacgtgtggatctctttagcgttgattcctaccagttaactcattttaaatgacaccctcatgcaccaatatcatatacttaggattgtgaaatagtttaatgatgccactgccgctacttgaagtttgtctctgttatcctggagaaactagtcatggctcctgaataagagattagcatttttcctgagtagtagccaagtctttgtttacttgtttatcttgtatcctgcaacctggaatatacactccgagagggcagggcgtctttgttttgttcattgctgtactctcctgtgcctcccgcagtaagtacttaagaaatacttgtgaaacacatgaataaaggttaacgaagggcaaaggaaacaagcctttattgatgatttttctctgtgcccagtaatacttgggttattttctcatgtccttgagtcatcttgactctaggagacacctcttaacatgttcctgctgaaaaagctgagctgaggagtcataccccgagggtatcaccctaagattgggcacctgagtaccccagcctgctcttcaggtctgtagctgcttagtggctatcagaccttccaagtctccatgcttttgaaggcctatgtgtgcggtttggtttcttggcaggggggtttgatgggttcccagacctaggagttcttggcgcctcgtcttccagtgaccccaccagggctgctctttctcctccattgctgaaactagttcagggttggggaggagggcacgtgggggggcctggtggttggttttgtgctgagtcattgccttggtgcactgtggaaggaagctctgggaggtggacggctccttctgtgagggagtgcttctgtcgtcaagggagtactgcatagggtgaataacacagttatgtagatawatatggtggtcttacccccagggcctccacaactcctggatgggcctagcctaagcaattctgatttaacttattgcccctccttttagcaatactgttgagttaaataacagtttttgcattgaaaataaaaaaattttatttttgtagagatgggatcttggtatgttgcccaggctggcctgaaactgctggcttcaagtgatcctctggccttcgcctcccaaagtgctgggatacaggcacgagccactggccaggtctttattttttgcattttgcaaggacattttaagtcactttcttccttttctgtttttactcctgctgaggagatgatccccattttacaaaatggacaaaacattctccccagggaagggaagagtagacatttgagaataattgttttcacagaaccgggaaaccacctattttgtcccaagtatactgattgatgcattagcaataactcactatctgctttgccagaggtttgaacaatgagtgttaatgcttggtgtagtgaattttgtgtgatttcgaatctgatagctgactcattgcacagctctgtcttgcgagttcagatctgaactgtagctctaagaggtaaaagcagaagtggagctgcctttcatgccatagctagttttttaataaaatagagttaaaaaatcctttggcttttcagcattttggtgtgattggaaaggctattactatcttatattcagcatgagtcttgagcaattactgattaatatggtttggctgtgtctccacccaaatctcagcttgtagttcccataatccccatgtgttgtgggagggacctggtgggaggcaattgaatcatgggggcggttacccttatgctgttctcgtggtcatgagtgagttctcacgagatctgatggttttataaggggctttttccccttttgctccgcacttctccttgctgaaaaagaatgtgtttgcttccccttctgtcacgattgtaagtttcttgaggcctccctagccatgcttaactatgagtcaattaaacctctttcctttataaattacccagtcttgagtatgtctttattagcagtgtgagaacagactaatacactgatctgagttgatattcttaaattaatggtaagatatttcttttttttttttctttggagacagagtctcgcactgttgaccgagctggagtgcagtggcacgatctcggctcactgcaacctccgtctcccaggttgaagcagttctcctgcctcaccctcctaggtagctgtaattataggcgtgtgccaccacgcccagctaatttttgtatttttagtagagatggggtttcattatgttggccaggctggtcttgaacgcctgacctcgtgatccacccacctcggcctcccaaagtgctgggattacagacgtgagccaccatgcccagccagatayttctattttgataatctttgagtcctgaggtagcttcagaatggattgaaccacagacagatggtgttagtagtttctgccctggcttctttgcaacttaacatacttgactttttagtgtttttggctaaggaaagtgtattttctagtttgtggcagttttaagcaaatgtggcttgaataaaactagagagaagtttaatttttgataaatcagtgacattgacaagttgtttttcttcctttccagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtaagtagaactacctgaaattactggattggcaatatgattccccaattttgcaaaaatgactgtgtatagctatacgtatayagcgatacaaaaattttgaatgtttagaaatcataagtgtttataatacataatacacatttgttagtagttaaaaatgctaacggtttgaatgtctagtatgagctaaaactaggttggttctgtctagtggatactatacagacagctgttatgaagaattatgtagatgtgtatttgatattgaaagctgtctcctagatggctctcccttctcacccacacttttcttaaaccctgtttttacattctcccccagcccacatttccttttagtgctcccccgactcccattcctttgtaccttccagctttggctgtagttcccagacagtgtttctgctgtcaaagatggtcactggagttaggcttacattaaaggttaaataaatagtcctgaggattggcagtctcagagaaagaggtgcagccccttctttcctagggttcgtttcattccccaaatgtatgccttttgggtcaggatcgctatccttctgtgaagaatatgaatccaagtggattaatatatcagcaccaggttacatagagtggagtcagggcagatgcctgaaggaagggaggcagggcagacagaaaagcagaatgcattgcccttggatttggcaacatggatgtccgtggtgacctttcactaaggcagttagaataatgaggtttgaccacaatggatgctcgtgacatagagatggtatatgactagggactgtctgataactagaagaagatgctaggtgggcttttggatttgggagagaagcttactgtggtagctctgtcattttcttttgtgttttaaacattttaatatttttatagatttggcagttcaagtgcagtttgttacatggatatattgcatagttgtaaatctgggtttttaatacccgtcacccgaatagtgtacattatacccagtagataatttctaattcctcaccccccaacctttctgagtctccagtgtctgttattccactgtccgtgtccatgtgtacctattatttagtttctacttataagtgagaacatgtggtatttggtgttctctttctgagttattttacttaggataatgtgctattgttcaattcatgttgctgcaaaacatgtgatttcattcttttttatggccaacatgtggaatttgtccatagaaaagaatgaaatcacacacacacacacacacacacacacacaaaacacacaccacattttttgttatccagtcatccattgatggacacttaggtttattccatatctttgcaattatggatagtgctgtgataaacatatgagtgcaggtgtctttctgatgatttttttccttcaagtatatattcagtagtgggattgctggatggaatggtagttctatttttagttccttgatagatctctatactgttttccatagaggacatcctaatttacattcccaccagtgtatgtaagcattcccgtttttctacgttcttgccaacatcttttgctttttgactttttaataattgccattccagtgggtataagatggtgtctcatggttttaatttgcctttctctgatgattagggatgtggaacatttttacatatgcttgttggccatttgtatgtctttagagaaatgtctgttcatgtcctttgccctctttttaaaggggttctttttttctttttgaattgtttgagttccttgtagattctggatgttagtcctttgtcagatgcacagtttgcaaatattttcacccattctgtaggttttctgtttactctgctgtgcagaagctttttagtttaattaaatcttacttggctatttttgttttgttgcatttgcttttgaggttttagttatgaaatctttgtctaggccaatgtccaggagagtgtttcctgggttttgttctagaatattcatagtttcagatcttacatttaagtctccaacttttgtatatggtgagagatagggttctagtttcattcttctgcatgtggctgtccagttttcccagcaccgtttattgaatagggtgtcccttcgccagtgttatgtttttgtcaactttgtcaaagatcagttggttttaagtatgtggccctgactctgggttctctattctgttccattgatctgtgtgcctatttttatatcagtaccatgctgtttgattactatagccttcargtataatttgaagtcaggtaacatgatgcctccagctttgttctttttgtttaggattgcttttgctattcaggctttggctactcatatggttccatatgaattttaggattgtttttctaattctgtgaaaaatgacattggtactttgataagaattgcactgaatctgcagattgctttgggcattatggtcatgttaacaatactaattcttctargccatgatttttgcatctgtgttcattagggatattggcctatagttttccttttttgttgtgtccttgccttgctttggtgttagggtgttactggcttcatagaacaagttagggaggattccctccaacttgatttttttttttttttttttttttttcagggagtagtctcagtgggattggtaccagttctttgtacctttggtagaatttggctctcaatctgtctggtcctgtgctttttcttgggagatttttaaagtactgattcaatctcactcctttttactggtcttttcaggatttctgtttcttccgattcaatcttgggaggttgtatgtttccaggaatgtatccatttcctctaggttttctagtttttgagtgtagagatgtttatagtagcctctgatgatcttttgtctttccatagtatcaatgtctactttttcatttctgattgtgcttatttgaattgtgtctcttctttttttggttaatttgagtagtagtccattgattatgttcatcttttcaaagaaccaactttgttttgttgatcctttgcattttttggggggggtctcaatttcgtttagttctgctctgatttttgttatttcttctgttaggtttcaatttggtttgttcttttttttttctagtgccatgagggttacattaggtcattaatttgtgatctttatttttgatgtaggcatttagtgctataaacttccctcttaccgctgctttgctgtatcccagaggttttggtccattgtgtctctatttatattcatttcaaaaaatttttacatttcatcctaactttgtcattgacccaaaggttattcaggagcaggttgtttaatgttcatgtatttgtgtagttttgagagttctcctcttggaattgatttctagttttattccgctgtgatctggaaagatagttgatatgatttcagtttttaaaaatgtactgagactgttctgtggcctaacatatggtctaccctggagactgttccatgtgctaagaggaatgtatgtcctgtggttgttgggtagaatgatctttaaatgtcttttaggtccatttaatcctgagtccaatttaagttcagtgttttattgttgattttctgtgtygatgatctttctagtgcttgtagtgaggtgttgaagtctctcattattattacattgctgtctrtctcctcttaggtctagtggtaatgattttatgaatctgagtgctttggtgtggggtgcatttgtatttaggatggttatatcttgttgaattgatcccgttatcattatttaatggtcttttttttttcttttttaactattattgacttaaaagtctcttttatctaartgttgcttctcccgctcacttttggtttctatttgcatggaatatcttttcctacctatttaccttgagtctttgtttttaccagttaggtggttttctgtaagcaacatatggttggatcatttttttttttaaatctagttcaccaatctatatcttttatgtaaaggatttaattcatttatgttcagagttaatattgatatgtgaggttttgttcctgtcatagtgttaattgttaactagttgctttttagtgtcaattgtataattattttataagatgtgagttttataccttttgtctgactgggttaattcaaacctgtctttaagctattagattctcttttctgctggtctagtctgctgttcaagctttcaactgtattttgtaattcctacaatgaatttttcatttctggaatttctgtctggttttctaaaaaatagctttctctagtaaaattttaatttagatcctatatttttccgatttctttgtgttggttttttgactttctcttggatcttattgcgcttctttaaaatcaatattttgaattccttagctggtatttcaaggatttcattttctttagggtccactgctggagagttagtgtgagtctttggggatgttgcagcgctcttttttttttttttttttttaatacttctagagttgttactctgtttcattctcatctggataaactatctcttctttatttttgaatttactttggcaggatttttttttttcccttgagaatgtgaatataacgtatgttgtatatagttgtttgacttcagttctgggtactttcagtgacagagactctgagtttcttggttatagttggcctttttgtggtagctttctcaaatgctagtgatagtaatgatgtgcttgggtgtgtgagcagsatcctcaccgtctcccgcggggcctggaaggcagagttctcaggaagttattttgttctcccttgctttgcactttggcagcagaatttatattgggttgtgcaggccagcaggtggtatttatgggtaaaaaccagctgcagtggaatccgatgggtgggtctatgagtctctgtgcttgacctttgtttaatgggggaagctctgttgcttcaggcagtggagtggtctgtggaatgcacagtggcctgagctacctgctcagcccctgagtgggggacaaagctggacagaactgaactgccagttcttctcttggatactccagtggctcaagcaccagccctaacaggggtagcaggggtagctgtgtagaaggtgccaaggtgtctgcggggaggtgtgggggttgctccagctccatggcctgggcaggtgggagcacaatctgcctccctgtcacaccccgtcctggcgctgggaatattcagaacatgagaatatcgctgtctgtctcaggctgcagtgtagtgagtgctacgagagacacctgtccatggcttaccaccaatgtgtcttctgtagtgagcctcctccctcaacccaaagcacacacatttgtagctctcctgctctttgccgcaggaatgctgtgggtccgtgtagagagggtgaggccccacctttcgtgcaagtcctggctcagtggaagtcgtgcaagtccactgccagtggaaatgcagcttcccctaacagccacagaatggccactgtcctgtgtgcctgtgccaacctgtgggagcagccatgactgtgcccacagcagtgggtagagggtgggggaggagaagtcctactacccacatccgtgcccaagcactgagaccacctggctcctgggctggaagcatactcctcccttgcagggctgagtacagcacccctgtctccactgcatgtggcacaggccacaagccatgctcctgggcacaggaaagtgcatgctcctttgtcccaaggagtgcccccttggcatgctgtactctttcttcccttaggagcagcactccctgagggtagatctctgggaaccctgcagctcccctgggtccagccagccctgtgtggctgctgcagtctcagcaggtgccaagaaaggtctgcagggcctctggtgatacggagacatcagtgctgagcttccccaggcagtcctcccactgctgccgccactgccacccaggtccagtggagggtgagcaacctggcataagtggtagtctgatgtaatgccctcaggaagtccccaaattgctgcccgcaccagtgtttgggtttgtgagggcagaaaagctctcccacagttcgggtaccagcagtcgaccacagaggtgaggggcagcaacagcattcccgccacccctttcaaaggaataccaagtccctcagggctcctagccgctctctgcccctctcgtttcctgctttttattttttgccctcgtttcatcccaggggttctccaccaggctccagtgctctccacttgatactccattctggcgacggttgctcacctgtaacttgggttcttctgagaaccggcctctggcaactctgttcagctgtcttgaaacaaaagaaacccccacttgtcattttgcatggaaattgctaaacacagttaaaagagctttgtagaaagcagtgtttagagtacgaagataagggagtgcgaggtctgctgattgaggcccagctcctgtttgatttccctctctctctacaaagagaccatccagactgaaaaacctggtgagagggatttgaggcctgggattgagatctgagaaagcrctagattgttgtgaattcttgggtctgacattatccttggtgatatacttaggaaacttacaggtgagatggccagtttactcattgtgctcttttgagaactcacagagaaaggccacaagtaattctgttggccagtgttatgtaggtgttcagaaagaaggaaaagtagctttcttcttgattttattataatacttcaatatttttggctaatgaaagtatgtcttgagtttatggtagtatagtatggtatggtatagtgtaataccacatagactgatgccagatggaggcaacttacttgaaggataatttgtgagcttggcctcactggacaaagtttgagtttgaccaagttctgtggaccttgaaagccagggaggagaagagttgttatttttttgtagggagtggatccattacagatcttttgtgatggtaacggggaggtgatgtgatggaaggtgtttttaggaagctggccccgtggaataggaaacgatgcctacaggggagataccaaagataactagatgactaaaaagtaacttacaggttaagatgatgatgatactattataaaccagcagtttccaatctcattttttcccccagatatgtgtgacagatccctttcccagagcttgaaacttccagagggagtcatcatatatactttcaggactctcagtaacggctccctttcttcaactggagagagcagtttgtatgagtcaatgagagtgacattcacagtagcatagggataatcccgaatcaaatctaatttgcatatacaataaaaatacctaaattttgttgcacattcatgtgctaggcctaatgtttaaaagtaaaatatctcatttaattcattcaacaaccctttaaagtaggtgatttcatttccctcatgttataaatgaagaaatggaagcgcaaaatggatctgtgttctacagtgggcaggtctgtgcaaatctgcccccgaagtccaaggaagttgagaggctgaagaaggaggctgacacccagtttctcagaaagaaacatttaatacggacttatgaatagaagccacatctcaagaagtcacgagatgggatggatccctctgccatcacccactccagacccagggatcatacaccatagggaaggggtggttcagaaggaatgtgtaggacaattgaagtaggttttttgacctaaggggaggattcgtgataattacctgctcttacacaaggaacagtagataaactggaaatcttggaggccttcctggaactggggttaatcggaagtcagcagggctgtttggcctccagaatggcgttactttagcctccacaatgagcaccttgctggaggtggtgtggttatggatttgaatgtggacagccggctccagagcctgtgtactcactcagggctgtgcttttgtgtgagtcatggggtcacatcagacagattggagctgaaatggagaccaggatgggagatctgaatgtgtggctctgagaggacatctgagaacgaacttcttttgatcttgttagaaaggaaaaaatgtgaaccttcaaaacaaccacaagaactggagctccccgcagatcagaggaacagaagagctagcrtagaaatagatccaaatatgtatgggaacttaagataacttacaaccaaaaaattgggtgtaagtagctattgtctcttacgaaacaaagttcaatccctcctttagatcacatactgaaattacagctcagttaagatttgaaagtaaaaagacaatagaacattggaaaaaaaattagtaacatatagatataatctagaagagccttccttaaggaatcctggaagccatacaggagaagaggaacatttcttattacataccttttaatgactaaaaggtgttctaaagacaaaagacatacrctagactgggaaaaacatttccagcatgtttgccaatgtactattaggatgagagcttttcttaaaaattggtaagaaagacagacacccaggagaaaaatggcaaagtcaaagaacaggtaattcacaaaagaagaaatccagatgctcaatacaacttcactaataagccaggtggattagtcctttctcacattgctgtaaagaactacctgatacttggtaatttatgaaggagagaggttggattcacagttctgaaggctgtgtaggaagcatggctggggaggcctcaggaaacttaaaatcatggcagcaggtgaaggggaagcaggcagcttcttcacatggtgacaggagaggagtggggcggtgctacacactttcaaacaagcacatctagtgagaactcttatcacgagacagcacttggggatggtgctacaccattggaaaccagccccgtgatccagttacctcccaccaggccccacctccaacactcgggatcacaattcatcatgagatttgggtggcgagacagagctaagccgcatcaccaggtataaatgcaaatcagagcaattatgagatctcatttttctttgagaagttggcagaaatttaaatggttgaatcatagagtgctggcaaggagcctggaaatgggcacatttatttatacgttgctgtaggaagacggttgtctctaaatccttttgggaagataatagttggtgtgaggttgtttttttttttttttttttttttttgagacagaatcttgctctgttgcccaggccggagtgcagtggcgccatcttggctcactgcatcctccgccccctgggtttaagcgattctcctgcttcagcctcctgagtagcttggattacgggcaccaccatgtccggctaattttttttttgtatttttagtagagatggggtttcaccatgttggccaggctggtcttgaactcctgacctcaagtgatccacccgccttggccccccaaagtgctgggattacaggtgtgagccaccacgcctggcctggtatgagttttaaagtgccctgaagcaggggtcctcaacccccgggccacagactggtagcggtttgtagcctgttaggagctgggctgcacagcaggaggtgagtggtgggtgacagagtgaagcttcgtctgtatttacagccgctccccattgcttgcactactgcctgagctctgcatcctgttagataagtggcagcagtagatgcttataggagcgcgaaccctattgtgaactgcacatgcaagggatctaggttgtgaccccttatgagaatctagtgcctgatgatttgtcagtgtctcccatcacccccagatgggaccatctagttgcatgaaaacaagctcggggcttccactgattctgcactgtggtgtgttgtataattatttcaattacatattacaatgtaataataatagaaataaagggtacaataaatgtaatatgcttgaatcatcccgaaaccatcccacccccagtccaagtccatggaaaaactgtctttcatgaaaccagtctctggtgccaacaaggttgggggctgctgccctaaaattttttatagtgagaaacaaatattaagacctcaatgctggtttaaacaatattacattattttaaattgaggaatcatacattatccacacatccaaggagctcagaagaaattaaaaaaatcatacattagtttttccttaggcaaacratattacatatgtgaatcttagcaaatgttagccatcattttcatagggcctgtgaacaatatttggtcccatttgcaacctaattattttcacattttaaagtggtttatacattttatatgcatttgacccttgaacaacgctagagttaggggcaccaaccccctgcacagttgaaaatccacatttaacatttcactccctctaaccttagctgctaatagcctgctgttgatgggaagctttaccagaaacataaatagtcgatcaacacatattttgcatgttatatgtattaagtactatattcttacaataaagtaagctaaaggaaagaaaatattaagaaaatcaggccgggtgtggtggctcacacctgtaatcacagcactttgggaggctgaggtgggaggatcacttgagcccagaagtttgagaccagcttggacaacatagtggaaccccatctctgcaaaaaataaaaaaattagccaggcatggtggtgcatgcctgtagtcccaactacttgggaggctgaggcaggaggattgcttgagcccaggaggtggaggcctcaatgagctgtaatcaggccactgtactcctgcctaggtaagagagtagtgagagcttgtctcaggaaaaaacaaatgataaggaagagaaaattatgtttattattcattgagcggcagtggatcatcatataaagatcttcgtccttattgtcttcatgttgcgtaggctgagtaggaggaggaagaggagggactggtcttgttgttctggggttaccgaggtgaaagaaaatctgtgtataagtggacctgggaagttcagacctttgcagttcaactgcatttgatttccttttcaagtacctcagatgtctggcttaacagttaaaatttcagtgtaacaataattataaatttatgagtattattatttaataattcttatatatttactagttatgctaaaattctaaaatttctaattctaaaattctcttaaatgttctaatactgtgtcgtaagtctgaattaattgctgagttataaactttggattggagttatattaaacattgcagtaaaaataccaaatacattcacatttttttctaacacatcaaatattaatattatgattttaattaatcttctgaggattacagctctatatccatttcaggaagcctgttaccagcccatttaacttgaggtaatgtactcactaaggaacagtgttaattgaggttacctctggagcctggaattctgtttggcttcttgttggtgacctggtaggacacagtgagtcygactgtagttgccgtcccaggtgattcatttactttaaagagcctggcccctgacttccagtgatttgatagtgtctgattcttgtatgcactcacagaaatctacagcaggcactggattgatcattggattgtatctttcatctctttgactcataagatgtgaaaatgccttttcctcttaagtcttttattttcttaaaacctagaattctgttggatatttaagatgatacctggttgagttttggatacaactcatgtttttatctgatttatggtctctcctgatagtctggcaatacctgttaacattttaaaacgtatattcacataatcttttgtgactcaaacggatagaagaagtagtactatatgtagatatttgtacaaaaggtttttggtagcattgtttattgtggcaaatatgctggaacaatctactgtgtgggtatggttcaataatttatagtgtattttcttcttatttacttggttaaatcatctaaaattatatgtgtacattatattaaaacatagccaacagttaatgtttatttataataactatttgactatcagtcatatgtaggcaccggtttaggtactggaattgaatcagtcactacaacaggcaagaatctctttttttcatggagcttacattttagtagggtgggagacagatgaaaaaagcaatggctaagtagtatgttaaactgtgatgactgctacagaaaaggaaaggaagggtaatcaggagtactgggggctcgggtgtgtgtgtgaggatattaaatagggtaagtgtcactgagaatgtgacacgtaagtaaagaccttgagttgagggagtgagctgtgtgtctctctgggggaacagccagttcaggggacaagaagggtagccaaggagtgtgttggtggtagcaagaaaataaaaatcttttaaaaagagtatccatataaatagagaagctggaggttaaaaaattggatgagtatttttttttttaatttggcaaaatagcgtgaatagtatatgttgaaggaaacgctaagtgggtggtgcaggggagagaggaagacttgcttgagcacatcgggaagtaggacaggaagggttctctgtytgccttgtaggttctaattgccatggcaataatataattgctgtggccgctgcggtaggcaggagggctgcctgtgaagtcaggatcaccaggctttgtggcttcaaggaggccaaatcaccatgggcttgcttgggcttggaggtgcgacctggtgggcctgcagaatgcgacttggtggcctgactgagcagcacgtgagggcctggtgcagcctggcatggtggtacccttgagagcgtggcctagagggctccgaggtgcagcctggccagtgtggtctggaggggtctggcaagcgctatctggagcactcagaggtgtggcctgtttttccgggtgggtctagtgagtgtrgcttggagtgctgggtggtgtggcctggctggcaccgaggtccctgcggattctggagaacctcaaggtgcggccccgggggtgtggccaagtgtggtgtgtggagggcccttgtgtgcagcctggtggttcctgtgagcatggtttggagggcctggtgaatgtgtcctggtaggcctggtgagtgtgtgagcatggcctagagtgtcaccaaaccaaagtggacccgcctgcctgtgcaccagggaaagccaaacaccaaagcgcagggtttttgctggagagagtggactgcactgcgacgagacaggaggaaaggtcaaacctgtctccccaagctggcggctgggtcgggttttataagcataagcttattaccataaggtaatgaggtgtgttctgattggatcttgcaattagatgacaccagggctctatctgattggatcctggatcttgccatgtggtgtgcgcttcttatttcagtcccgctcctcagtccagcgcttaggttcctcccgtgttgcaagcttggttcatctgtgcaggctccggtgacatgatgtcgaactgggagccatggcagctgaaaaacaacgaacagctttgtacataaaagatgatacagcttggtctaatgtggttctaaggaggctctgccggcgagtcttaggggttccggcgggcagccgcgtgaacctggagcttggggtctgcagtgctgggaggccgaggcctggcatgttggggacaggtcttgggagctgactgggggcctggcgtggtggcggcagcccgcagtccctgcctggcccttgtctgggaggccgcggttctctgcggcctctcgcyggtgtcgcccttggccactgggctgcgaggaagccggcgaggagtgggtgtgcgccccgcccggctctaccggcgagggatgcagtggccgccagcgtggccgtgcggctgggtcactcccttcccgcttccagggcctttttctgcctccttttcaggacgtgacccgcacattatgagggacccgtaggggctcttgacacagaggggtcaccctatgtgtgaacaggttacgaggttgggggcttggcttctgaacttgccaggaaacaccgcatcccttttcctgcagcggccgccccccatcccccacccgccccattctctcccctccccaactgcagccttccgcgcctccttggcccctcgagcctccctgggtcccctgcacctccccatgtcccccacgactcctaggcctctcgcgcttccccaggaccccgcgcatcctgggcctcttgcgcctccccggtcctcagcgcctcctcggccgccgtgcctccccgcaccttttgcgcctcatggggctcccggtgccttctgcccgccgcctcgccgcgcccctcgcctcctcatgcccctccgcgccccatacctccccacccctgtgcctctctgcctatcccctgtaccacccggcatcctccgtgccccatgcgcctcacccctcacgcctccctgtaccctgcatgccccgtgtgcctgctgtgccccacgcgcctcccccctcgcgcctccctgtaccctgcatgccctgtgcgcctgctgcgccccacgcgcctcccccctcgcgcctccccccttcgcgcctccctgtaccctgcataccccgtgagcctgctgcgccccatgcgccttccgcgtctccagccctcatgcgcctccagctgcgcatctccctaggcgggtacctcagcaccgctgagcccacccccgcccctgctcagtgcctcccagacacgcccactgcgggcgggacagtgggagctgtccaggcgcggagctgtccaggcgcgggagctgtccaggcgcgggagctgtccacgaggcactgwccttggtttcagagcctctgcagggcttctgtgtccttttggctgagccgactgggcaaaagttttagaaaagaccctgggtgttgcagatggagaaggatgatcgtggctgacttttgcttgcaggcagaasaaccacggggccatcagcctggtgctgtgggggcgcgctgactcgtggtccgcccctgccccaagacttcaggtgtatatgggattggatcagctatcatcccgagctcatggcacgtacagtgagccatgtgttaatccatagactaacctttttccttttaaaaaattagttgttttgtataatgtagcgagcactgtttccaacaaaaatctaggatcttggcagtaaccactatctgttttactctttcctctttcacttttcgctaggagtaatcattagctcccatcttgtattaatttttttttttttttactgtatctaatttccaaaaaaaaaaaatctgtgtgtttgcaactaagttatcttcctatgtgtaactttttgggacttaagtgataacagtaatattactaaaaatcaaccrtattgttgtttttcactgtggtttattccttctgactgctgtgatattttgtgtggatctgcygaagttaatttatccactcttctgttgatgggcctttggtcatttccaggtttttgctcttctgaagagcatgagatattctttcacattttctgctgtgcatgttccatatgtgcatggttttctcttttatatagacctgagtggagtaactaggtcatagggcacacgaatgttcaattttaggacataatgtcctgctgacttacatagttgttgaaccagttaacatttcactagcaatacaggagagctctgagccacctcatgkctgacacttggtatttaatttttgccagagggatggttgtaaatggtataccattttggtcttgatttgaaattccttgatcaccagtaacattgaacatgtcttaacatatttattgatgtacatttttctttgatttgcttgatcatgtcttgttcattttatattgggttattgtgtgtgacctagattagaattttttcttttcattggatattaagatccaccattgtgtggctaggagtgggtttttccttctctctcctttccagcatggtgtgtgctttctcagtcagaggtaattcatcgtcctttatttcctggaattatacagacattcttttcttgtttgtttgcatgtgaatgtgtatgtagagattcttgatgctggttctttgccagttctgtgtttttcctagtttataacttacttccgttttctttaagctgttttttgatgagtataaactcttaaattgaataggtcaacctcattaatctttttgagtcttaagaaatctttctctatcttaagatttctgccaagttttgaagtttggattttgatgtttacatctttaatccatttagacaggggtgtccaatcttttggcttccctaggccacattggaagaataattatctttggccacctaaaatacactaatactcatgatacttaatgatctaaaaaaaatcacaaaaaagatctcataatgttttaagaaagtttacaagtttgtgttgggctgcattcaaagccattctgggctgtatgtggcccatgggccacgggttggacaagcttgtgtttagagttgatttttgtacccagtactgggtagggatccaattttgtctttttccatatggaaaactattttgtttccagttccgtttttatttccagttctgtttattgaacagcctcctcttttccctgacctattacttctgtcataatcaaagtttaattcacatttgtgtctctgtgctctctcttctagtcgattggtctctattctagtcttttgatcagtttattcctatgccaacccccatcatgttgatttttacatagactttttattctggactgttacagtaatgtcctggacaagcagagatgtggtcattctacttgtgggcctttctagagaatgttgattttgtagcatatgtgatgggaagtattgaaacatttcagtggctgagttatatatcctgatttgtatttttgaagatcacactggtgcaagatggatgaggaagtggggctggcgagggatgagactagtgtggaggcagggggagcagttaggtggccattgctggagcgcaggtagtggttttagcgggagtagaggtggagaaatgtggacagatttgagatgggcgtatagctgtggacctttctgatgtatagaatgcagcagacaaggtaaagatggcacttaatgtaatgtaatggggrtgccactctgagatggaaaattctgggaaaggacagttttataaatttataagctatcagatacattataatgctacttttaatttgcttttccttggaaatagctgtttggttatgtatgttttatagcctgttcactctcttttctctccaaataggtgactctgttttgagaagtgcaaccagatctctcctggaattcaacacaacagtgagctgtgaccagcaaggcacaaatcacagagtccagagcagcattgccttcctgtgtgggaaaaccctggtgagtccacacaggcacttgatgtatttctttaaaaaaaaaaaggtctgccccttggtgttctggctgtagaggtattccaggaagaatcagtgagcaaacttagaaacacaaataagaaaaaccctaccaaatgaccatcatcatcaagaaccaataagtaaacaaattctaaacttgttacaacttttaagtaaaacatagaccatgtcttttgtaaaactacaattcaaagtgattactgtgttaaaaatcagtgcactgtttaatgtttaagttataggcatactttttttttctctaaaacctcttcttctagcatttcattttgataggttttagggcagcatatttagttttttaaaaaatatttttctttcctcatttatattaaattagagatacccacatctatttaggagaarccttggcccgtgggtatggggttctcaagttttttggatattacctggtgtttaaaggggacatmattgtgtaaattattatgattgttcttattatgggcatattgtatgtaatttgttgattttaatctttagtttttggaaaggaacttgcagtaaataattgttttagctcttgggagaaggaattggtatacaaattctatgaatgttcttgaatcccagtaagaacccaatctttaggaaagtcaggttgagtgaaactctgtggctactaaattgctttaaaatatcattttagaatttgggactgtgactattgcatcttcaggtccacagtgtcttatctgaagaactttgaaaataaaactaatattgttaattttggatccgcatataaattgcatcgttgtgcatattgagacccaaaaaagaatctgttcgcagcagcattaaatgagatttatattacagaataaaatatatagctcctgttttaacttcagctaatttcctttatgaattctgtgttcaccataccagaaatagaactgtgaaggataactccctagacttgcacgtgggagtgaagaggccagttcctgctgtgcttgtgtcatcctgcgatgctggggttgacctgtttgtagtccactctggttgcggttaacaggaggggctgccttggagggttggcgtctggtgggtgtactaacttggtcagatgcagatgggctcctcatgggagccttttcacgggaagcatgaggtcacgttttctggctttcgtttgctggcatttgcttaagagaacatttggagtttgagaggagaatgactgaggatttcttcccatgaactcactcaatgtacttgcacagctggggcggtagaattcctttggattagttacacaaaatcccaacatgattttatgaagctttggtctcagaatttgcagatttgggaacctcttgatgaccccgtttaactaaagcggttgcatcccctgcccttcttgctgctgctttctttattttagtagcctttactgcattctcattttaaagaagaatctttacaatgtgtggtatggtaacattataattactatttttttttaatagggaactcctgaatttgtaactgcaacagaatgtgtgcactactttgagtggaggaccactgcagcctgcaagaaagacatatttaaagcaaataaggaggtaacatgggaacttcaaattacatgcttatgaagtatactctggggaactttatctttcaaatactgattctaacctttccgggtgaaaatcttttttagcttccaaattgcatttgagcagagataccatgtgatttaatttttaaaacttttctgagtggttcttatttttaggacagggcatttaaaatatcacaggatgtgatttttggtccagattggaaatagaatggctcatccatatagggcaagttagttcttggtttctggtgctgtgcaactcagtaaactaagtgacgtgtttgggcttgggcttagagtattcactctacctgcaggagccatctgtttctgacgctgcctgcttcatcttcctttgcacctggctttccacctgtgttgtaccccgcttttgataagtctcctttacctgtttgcattgttaaatctctcygtccctctcctcagccttgggatgacttctggctgcaatgtgagtccaggtcaggtatcccttaaattcttttccagctcacctcagagactagattactaggttactgttactattacgtccaccccttattatttgaacccagcattccttggtcaagacattcttcttgggtgcatgtatgtatatatatctatatacatacacactgacctatatgtattatgtgcaacatgatattttgaaatatgtatacattgaggaatggctacattgagctaattacatatgtgttacctcacatatttcgtttttttttttttttttgtgaggactcttaaaatctactctcttagtgatacgcaagaataaattacattgttattaactgtggttgtggtggtgtttaatggatctcttgggcaggtcattcttgttgactaatggaatgtccccttccccagcctggawtccctcatgttgcactgctacttgattctccctggtcctggggaagagcagactgtgttccttctgccgcttctccatgcccaccaccccagatcctaaagggaatttcctgttctcaccttgataacaatcttaattaattgattatctcacttttctctcctactttctgtttttaagaactttcaaaggttgtaaggattcaggaactaatgaatggtcataatcagtaatttttactagtggcctaataccatgcagtttaataagacaaaaagaaatgtttatttaaaaacattaattcagattaaattatgaacaataaatcactgatattttcagatatggtcatctatgaagggaaagacagtgtcatatggaagtggaagtggtaaaatactgcccaggaaagccataaggagcattcaatgaaaaaaaaaaagtttaaagtggaaagaattaaggctgatatttaggagacagtgtcaaatgtaagcttcatttaaaaacttaggtgaagctgttagatgacatactgttagcggtgggaaaagcatctcaaagcagacatctgtttggggtttgggggtgagggtgggagcacagtgtgttcattctcgcagtgctataaagaaacacctgagactgggtaatttataaagaaaagaggtataattagctcacagttcygcaggttgtaaaggaagaatggcagcatctgcatctggagaagcctcaggaaacttacagtcatggcagaaggcaacagagtatcgagcacctcacgtggccagagcctgaggaagagagtgggagggggaggtgccgcccactttgaaatgaccagatctcacaagaactcactcactatcatgataatagcaagaagggggtgatggaatctgccctcatgatccagtcacctccccaggccccgcctccaatgttgaggattacaatttgacacaagatttgagtggggacacacagtcatcctgggattacaggcatgagccaccatgcccggctaatttatatatatatatatatatattttttttgtttgtttgtttgtttgtttgtttatttgtttgttttgtagagacggggtttctctatgttggccaggctggccttgaactcctgacctcaggtgatccgcctgcctcggcctcccaaagtgctgggattacaggagtgagcccctgcgcctggccccacacacagtcatcctcaagtgtccagttggccggatctgagttgcttcctgtgggaggtggaggctgcggtgacagtggtgccctctgctctcctgttagaccccagacctctcagtcccacagatactctcctgggctctgattttccaacctgatcatgataccctttttgttttgttttgtttttgttttatctgagtgtacctcttatgtcacgttgctgaattgacagttgtgtcttctaccacctaggaaaaaattgctttccaaaataaaatgaatagcaacttgttttcaatgggtcagaaatcaccaactacagcccatggttcaaagcctgccctggcctgtttttgtacaaccccaggactaagaatggttttcacatttttacaggattgttacaaaacaaagaggaatatgccacagagacctatgtgacctgcaaaacccaaaatgtagataccacatggttctttgtaaaaaaaaaaaaaaaaaaaaaaaggtgctgatctgtgttctaaatagtttttggggtgggaatggggaggtatagtctgtgtttttctcaaaacaatgacatttaatttctcttagaagcagattgaagatgcatgagaaacatttgtactttgtactctcttacctcttcaggtgtaattggcagctggggctttattcattgagttttcatttattgagagcctattgtgagctaagcagtaggaattttgttaaattttggaatgctttcagggagcctatagactaatggtgtgaaggacatatccatattcattaactcatttttttttgtcttatggatagattaaatggaaagaactgaaaagcataatgactgctaaaaatgtagtgctgtcactgttagcaaatcttaataaagcgtatgcccttttttctgctttcagtttgatttgattacaccttacaggcttggtatgataagtttaaaacatattgaaggtttatgtacttataaaaacctcatcattccctaaagaaaaaaaatctcaatttggtttagtgtcattgtagtcttgctttctacatcttactaatgtctcatttatttattcattttgctctgtcacatttagaatgattttgatgggcaaaaatcatggtagttacaaacagccctttaaaactattgttatactttgttcagtggattctggtagaggctttaaggtaattatttctttaaagcattgtgtaaatatacctcctactgtagtgcccttgggaacaggcaaaattcagaactggcctgctagcagtcttaccagggttataaaagtaagattattatatataaaacagcattaactcaatgcgtggtgtgttgcagctggcaaacaacctcgctccccaggctgctaaattcgtggtcttatgaatgtctccattgctgtgtttgctgtagcaggaagtgggagggtgttccccagtagccttgactgtttaccaatgcacactccagttctgtggagtgctgtgtgaggcatgtcttctcttccctcctggagtagggagacagccagtagttgctacctgccccgagcagggtgcttgcagatcttgcckatgtggaatcctctaagtgtcttggtgaaatgcagctgttttcagaatgaagagttctttcattttcccttcttgccatatgccatcttgctcccttttccatcataggcttttattttgctggttagagaattgcatcttgtcttgcatcctacccagtccactgactcactcccctcttgggttaatgttttcatatgatcttgctgtgggatgacaagctttagatttgcaggataatgggcacttgtggctttttactgtaacccaattatagtctgtggcaataattttcttttagttgcctttctgcatgaatctggtggtaggcttaagctccatgtgctggtaccctctgarcactagaggttctaacttcctccattattagtagaaacacttaggtgtctgagaagtattttaggcgacaggcaactttgctttgaggatatggtcaaaatgagttcaagtgcctttgaggctgtgagtaggtgtaggtcgtttgattcactctattagctctccatgaatctctgacagcaggactggggaaaaaggttagtgggttagagcattcctgcagatttgatagcctatttctaagagaaatttgaaagctaaatattaagcagtyaacttttgtaaatagacctgtctgtgaattgcttcagtctaaaagataaaattttgggaaacttatccacagaaaataataaaactatctactttgaaatgatttcagagaacatgaagttttagaatattctttggaagaggtaattaaaatgatgccagtgtattattttggaaataaaacttacaggaatgtttcacatagtcatggttcacttggtgaccagggccttttttactctgggggggattcctttctgggcttgagttcttgctgtgatgcggaagttgggtgcccctacttcatgaaactgtaccgcaaagatgtgggtgcccctacttcatgaaactgtaccgcaaagatgtgggtgctcctacttcatgaaactgtaccgcaaagatgcgggtgcccctacttcatgaaactgtactgcaaagatgtggcctcagagccatggtttctgtcctgggcagggagtcttgcagcctggggcagtttcaccatctgagcacagaccctgatatagtttggattttgtccctccccaaatctcacattgaatttgaatccctaatgctggaggtggggcctggtggaaggtgattaaatcatgggggtccctcatgaatggtctagcaccatccccttggtgctgtcctcatgacagtgagtgaattctcatgagatctggttgtttcaaagtttctggttgtttcactctcaccgtcttgctcctgcttttgctgtgagatatgcttgctcccacttcaccttctgccgtgagtgaaagctttttgaggcctccccagaagccgagctatgcttcctgtacaacctgcagaactgtgagccagttaaacttcttttctttataaattacccagtctcaggtatttatagcagtgcaaaaacaacctaatacagactgcttgggactgggctggcttttttggcctgctgccagcgatgggccacaggtgggagactcactgagttaagggcattagaacttggtgggtcctgctattgcctgctatgctgtggagctcaggctgcacctctttttaccatgtgggctctttgatgtggtagaggcgcctctgtccctccccagaatgttgccctggaggcccgctgatcaccrttggggccagtgcttgtctcagctgttggagagcctgaatatgtgcttgcctgacccagctccacccagctttccttcctcaatctgccttgctggcagaacacaagacagtgatgcttaggtgtcccatggccccacccattgtctgggacatgggagtagcctcctcgttaacaaaagccaagcataaatcctgttgccaccactgcagctgcctctttcctgcaagtaccacttcctggccaggagatgaacttgcgtagcccatctgctgagacaagtgcacaattgcacagtgctacggcaggagacaagctttccatgacctcagttaccatcatccctcaccacaccctggctactcagaaggccctgagcctgctcaccagcctggtatattactactacaactgatgtttgagaaagtcaccacacaaagcctatctataaccaaggaattcatacagtctttgacgctgaaagcgtccagaagcaaagccaaataaaactatgcaacatacattatagtcacattctcagggcggggggaaccctctagtcaaagcaaaagtaaattcaaaccaaaaagtgacagtttctctagatgagaaggaagcagggtaacaattctggaaatatgaaaaagcagggtgttatagcaccctgaaggatcatattaatcttccagaaacagatcctaaccaaagtgaaatgcttgaaatactagttaaagaattcaaaatattaattttaaagaagcttaatgagatacatgagaaagttgaaaaccaatacaaagagatcagaatatcaatccaggatataaatgagaaatttaccaaagagatgttttaaaaaaatcaagtagaatttctagaaatgaaaaatttattataggaattataaaattgagttgaaagtttcaaccatagactagacgaagcagaaggaagaatctcagaacttgaagacaggtcttttggattaatccaatcaggcaaaaacaaagattcaaaggaaatgaacgaagtgtttgagaaacgtgggactacatgaaacatccaaacctataaagcatagatattactaagggagaagaacaaacaaaatctggaaaatgtatttgaggacataattgatgtaaacttctttagtttagcaggagatctagacctccaaatataggaagctcaaaaaattctaaggaaatatgttgcaaggaggacttcaccacaacatatagccatgagactgtatgaggtcaacatgaaggaaaaaatcctatccacgagaaaagtatctaatcacctataaagaaaatcccatcaaactaataggggacttctcaggagaaacttaagagccagagagattgggtttctsttttcaaggtgcttaaggaaaaaaaatctgtcaaccctgaattttgtatcctgccagaataagtttcatgtatgaaggaaaaataaagtctttctcagacatgcaaatgctgagggaatttgtcagtactagatggaccatacaattaatgcccaaaggaggtctatacagggaaacaaaagtttgatacttgctatcataaaaacacacaaaagtataaacactcttataaaacaattattcaaacaagaccacaaagcaactaggaaacagttagcattatgacaggaataaaacctcacatattaatattaactttgaatgtgcatggattaaatgctccacataaaagatacagattgggagaatggatttaaaaaataaaagacagaatccacccatatgctgcttacaagaaagccagaactaattggtaaagacatacactgaagctaaagggatggaaaaagatattccaggcaaatggaaatcaaaagcaagcaggaagacccacctatacttagataaaactgactttaaatcaacaacagtaaaaaaaaaggaaaaagatggtcattatatgataaaaagattattcaacaagatgtaacaatcttaaatatgtatgcatgcaactctagagcacaagattcataaaacaactgctggtagacttcagaaaagaaatggacagcaatgcaataatagaattcaatcactgagaaagaaaatcaacaaacacggcacataaattggattcaggaccacgtagacctaacagatatttatagaacattctccccacagccgcagaacatatattcttctcatcagtgcatggaacgtttttcgagatggactatatgtcataccaaaaaacaagtctcaataaattgaaaaaaaccaaaatgataccaagtatcttctcagaccacagtggaatgaaactagaaatcaattcacagagaaactctcataactatacaaataattggaaattaaatagcctgcttctgaatgaattttgagtcaacaatgtagttaagatgraaattaaaaaaaaattgaaacaaatgaaagtggatacacagcataaaacctgcgggatacagcaaaagcagggctaagtgggaagtttatagtgttaaatgcctacatcaaaaatagagatcacaaattaacaacctaatatcacacttcaaggaactagaaaaaaaagaaaaaaccaaattgaaacctagcagaacagaagtaacaaataccagagcagaactaaatgaaatggagaccaaaaaatgcagtacaaaggataaaaaaaatgagaagttggttctttggaaagataatattcatagactgttggtcagattaaccagaagagagaggattcaatcagaaatargaaagtagacattacagctgataccacaaaaaagatcatmagagacttctgtgaacatctgtgtactcacaactgagaaaatttagaggaaatgtgtacatttctggaaacattcaagttcctgagattcaaccaggaagaaatagaaattccaaaaagaccaataacaagtattgggattgaatcagtaatttaagaaaaacaaaacaaacaaaacaaaacaaaacaaaaacctcccaacaaaaaaagctcaggaccagacagattgacagctgaattctcccagaggcacagggaagaactagcacaaatcctactgaaactgttaccaaaaatcagaggagggaatcctccctaactcattatttgaagccaatattatcctgataaccaaagccaaacaagcacacaacaaagaaagaaaactagaggccaatatctatgataaacagattcaaaaatctcaacaaaatactagcaaactgaatgtaacagcacttcagaaaaataatacatcacgatcaagtgggttttaytccagggttgcaaggatggttcagtgtatgcaaatcaataaatgtgattcaccatttaaacaatttaaaaaaaagtctgaccatctcaggagatacagaaaaagcatttgatgaaattcaacatcccttaatgaaaagacaacactcaaaaaatattagaagggacatacctcagaataataaaaggcatatacgacagaaccacagccagcatygtactgaacagggaaaagttgaaagcatttcccctaagaagtggaacaagacaatgatgcccactttttcatctctcctattcaacatagtactggaagtcctacctggggcagtcaggcaagagaaagaaaacgcatccagatcagaaaagagacagtcaacgtgtctctgtgtgctgatgatatgatcttatacctagaaaactctaaagtttcctccaaaagtctcttagatttgatacgtgaattcagtagtttcaggatacagagtcattgtacaagaatcaataacatttctacacaccagtaatgatcaagctgagaatcaaatcaagaagtcaatcccatttataatcactaaaaaaaaaaaacccactagaaatacatttagccaaggaggtgaaaaatctctacaaggaaaactgtaaaacactgatgaaagaaattgtagatagcagaagtgggaaaacatcccatgttcrtgaattggaagaatcaatatcattaaaatgattatattgcccgaaacaatccacagattcaatgcaattcctatcaaaatgccaacgtcattttttatggaattagaaaaagtcctaaaattcatgtggtcccccaaaaaatcttaatagccaaaccaatcttaaggaaaatgaacaaagctagaggcatcacaatacccacctacagattttactggagggctatagtaatcaaaacagctagtactgatagaaaaatagacacacagattaatggaacagaatagaaaacccagagtcaaagctgcatacttacaaccaactgatctttgacacagttgacaaaaacatacactggggaaaggacaccctatttagtaaatggttctgggaaaactggacagccatatgcggaagaatgaaactggacccctatctcttaccacatataaaaattaactcaggtcggattagcgacttgaatgtaaggcctgcctgaaactataaaattcccagaagaaaacccaggaaaagctctctcggatcttcgcctaggcaaagaattcatgactaagacttcaaaagcaaatgcaacaaaaataaaaatagagaaatgggactttattaaacttaaaaacttctgcacagcaaaatacatagtcagcagagtgaacagacaacatacaaaatggccaaaagtgtttttaaactctacattcaacaaaggattgatattcagaatctacaaagaatgcagacaactcaacaagaaaaaccacaatccctttaagaagtgagcaaaggacgtgaacaaacatttctctaaagaagacatacaaatggccaagaatctcctaaacatactccacatcactaatcatcagagaaatatacaaattattataaaaccacatggaatactatgcagccataaaaatgatgagttcatgtcctttgtagggacatgaatgaaactggaaaccatcattctcagcaaactgtcgcaaggataaaaaaccaaacatcgtatgttctcactcataggtgggaattgaacaatgagaacacatggacacaggaaggggaacatcacacacctgggactgttgtggggtggggggcggggggagggatagcattaggagatatacctaatgctaaatgacgagttaatgggttcagcacaccaacatggcacatgtatacatatgtaacaaacctgcacgttgtgcacatgtaccctaaaacttaaagtgtaataataataaaattaaaaaaaaaagtttaggaaaaaaaaaataaactgcatatatggaacgtaataaaaaaaaaccccacaatgagataccatcttataccagtcaaaaatggcaattattaaaaagtcaaaaaacaacagatgttggcaragttgcagaaaaaaaagagaacacttatacaccattggtgggaatgtaaattagaatgacctttatggaaaatagtatggaaattaatcaaagaactaaaaatagaactaccatttgacccagcaatctcactactgggtatctacacaaagtaaaagaaatctgtctgtcaaagagatacgtgcactcgtctgtttattgtggcactattcacagtagcaaagatacggaataaacgttaagtgcccaccaacggatgactaggtaaagaacacacacacacmcacacacacacacacgtctatcatggaataccactcagccgtaaggcagaatgaaatcctatgttttggagtaatattggtggaacttgaggccattatcttgagtgaaataacttagtcagacaccacatattctcacttataagtgggaactaaataatacatacacatggacatagagactggaataataaatattggagcttcagaaaggtgagagggtgggagggcagtgagggttgagaaatgagaaatttcctaatgggtacaatgtacagtattccagtgctggttacactaaaagcacagacctcaccactgtgcaatatccatgtaatacaactgcactcggtcctcctaaatctaaataaaacaaacaaagaggcacccccttaaagctcagggtcttgccaactctaacagtggggtttcttgatgttttttaaaataaaaagaccattagttcataggtatgagagactgtcataaattaaaaccaagtaaggatggattgaaatacccacaggaggaactcatcttcacagtttatggaacaaatatagaacaaatatttactgagctcccactatgttgtaggcatcatctttagcctgcagtgacaaacccttgacctcaaggagcccctattatagtggggggaaaatgacaaaagtcaacagatggcagtacctagtatcatacatcacagtgctgtgaacaaaagtgaggctgagtatgggagacagagagaggtagagagtgctgttttaggtaaaggtgtcagaagaggccttactaagggygatgtttcatcagagacctgaatgaagtgagggaaagagccatgtgtatatttgggtaagcacatctcaggtagagaggacttttgagtttcaggagggtagaattgcatcaagaggtgagtgtggctgcgttgagtgaggagagtggtaggttagggcggtgtcatgaaggagttggaatttccttctcagtgtaatgggaagctgctttgaacagggagaggtgtggcctgatttaattctgaagtgctaatcctgtgcttgtggagacatgggctgaggtagtagggcactgaagctggaattggggggccagttaagatactattgcaggcaagagattatggtggcttggacagggtggcgatggtggaggtgataagtagggagtggatccagggtttagtctgaagggagagctggcaggacttgccgatggttggatgtagacgtgagagaacttggcggtggggcagggggaccttaaggttttggctcaagcaactggttgaatgatggtgccatttgttgagatgaggaacactggggtaacagtaggttttgggggagaaatcaaaggctcattttaaatttaaatacatgaaatttgagatggttttgtgtatccaagtgatgatgataaacaacagcaataaataacacttatgccaacctgccaggagctgtaccccaagcttcacatacattagttcactcaggccttacagcagccccatgaaggaataactgtcattattccagtatggcacgtggggaagctgaggcatggaggttaacttcattcatggtcatgcaaagtgttcatgccagaggttgaaccccaagtgttctgcttcgagtctgtgcttataaacgtagcttctgctattgttggctgtgtaagcctgcagttctgtggaaaggtcaaggctagagacatgaatttgggagtctttggcagacatttataaccatgcacgaggtcaccaagggattgggtgtagacaggaaagagggctgctcagtaagctgtggcacacctctggattgagagtcagttagagggaaggtgagaagtgtttccaggaggctgaaaaagagctggaagtggggcagaagaaaaccaggagmctgtggatgcaagccacaggagaaggggtttcatgaggtggagaatgatcagtagcatccagtgccacaagagaccatgtaacgggaaggctaggacacgagcactggatgtgtcagcagagatgttgtgggtgagctggtaagcggggttttgctggagtgggaggcagcaagctgatgggactgtgttcaagagagaatggaaggcaggaagaggagaagacgtgtagggacaattgaagaaattttgctctaagttgcagagacatgagatgatagctaggggaatgtagggaccaggaaggacgtttgtgaggtggtagatctcatggcatgctgacggaaacgatccagtgsagagggaaaacctggtgatgtaaagtgagaggagatgattgcacaacagtcctcatgtaagagagaagagataccgaaaagaacgcagaggagccaagacgtttattgacctttgcctgagttcgttattaggggacaccatarcatgatagtccctaaggaatggagagcagtgttgtgtgacattggtcataagcttttctgattgaccaagatgtatactgaagactcacttttttcttcctcccttccaggtgccatgctatgtgtttgatgaagagttgaggaagcatgatctcaatcctctgatcaagcttagtggtgcctacttggtggatgactcygatccggacacttctctattcatcaatgtttgtagagacataggtatgaatctttgtggggctgagggggtggtggtgagggatttcttctatggcttcratatctttgcctttctacctttatttctgttttcacatccatgtttctgattaggccctctaataaagcttttgtccccaaaaatgttctatttgcacaacccacctcttctcccccagtagattccatgcctcctccccaacccctgtagattccatcctaactgttgatccattccatgtgggtgttctctcggccagacaccttgggtttcgggattctacagaagtgagggtcggtcttgttctctgtgtgtgcctgaatcccttggctctgagttacgggctgggtgaaaaagaaaaagggatgatcaaggacttgggtacttggtcgggatgcatatttggcccaagctgacttgttcctttctctgtacttgccaaaactggtgtgagaagctttagcttaagctttagaatctttgataaattaactaaagaccgtaaataaatggtctttatctaaaaagggccatgaaaagttttactaagcctttgactagccttcagctggttttactaagccaagtttctaaaacccagcttgatgttcccctcagggctatgaattgttagtcctgtaggccaggactgtctttctgcagtgctagccatgagtaaattctgctggtgattaactaatctaaaggtcatttttagtgttcttctttgttttttatttctcaaatagtacataatgctttgcccttagaaaagtttggagaaaattttaaaaaataaactcaatacatggaagtattgctggatagtagatgagtattaatttatgattattctttaaattatatatatacattatgtactatcttgtttatgtattatttctaaacagttaaaaacagtaaatataccccattcagggctcaccaaaagtaaccaatgataactaggtttttttgtgtgtgttagagtattacatctttcttttgttctccaaggataacctttattgattttttggaaaaagactaatacagtctttgtcttaaatgggtctgtaactcaagtttggttatagagttgatgagttgtagattattgaattctggaataatacgctattttgatttggaaaacatttaggtttctggtctcttaacattttacagatcatctgaatttgctgagtattttcttacaagttttttctttccaatttattggcaatttgagtagagcttgaatgactttgattcacagtagrggtgccctagtttttactcagacattctccattcccaggaaattgccctaagtctcaaaccaagattgaatgtgaccctcaaaacctcttggatagtttcggacttgccatcatgtgcttacctccttgcatcctcagggcgcttgctgtgtattctgcctttggtataccaagtggattgtcttacactgagtccccatgagggcaaggagcctatggcacagcagatactataggtggaacaaagcagtccatttgtgaaatttcataattccacataatttcataattgtttggaaggcttgagagttaaaggtttgcttacctcttcactagctggtgcaaaggtagataaccctctccatctttgattaataaggcaggtaaaacttaagggaggtaagattattcactcactcattcgtgggagaagggttgtttgaatcccttctgtgtgctaggcactaatctaggcactggattatagcactgaactcaccacagttcctgttttcctggaactttagttagataggagaaaagatagatagtaaacaaataaatcccaaagtatactgtgtaaggtattgagtcatggtcatagaaatgaatggtaaagagcaacctagctgtaatcatagctgttgctatactggcaatctgtaaagcctgcgggatgttctggacatattctgggtatgttttcatctttaatcctccaccaaacctgtgcagtagcacactggcaattggatagttttgtagttagaccaacgttatcgacatagtaagtggtcgatttaggatttgaacccagagctgtgggttctttccctaatctcctaattgttccagtcatctgtggagtgcctgcattttctagtctctgtagcttgaaaggggatagtgctaatgttgttgtacctcaagcagaggatgggtacatttcttgattacaaataacatcatarcctgtttcctgtgcacctcttatataccagtgcagagccagtactttacagtccttcatcctgagctttgtttgcagagggttaatggcttgcccaaggtttcagaatagttacttagggagacttttaggaattcaataatgtatttaaagggaccctgggtctaagggtacgtgtgattatcactcctaacacctaatctgatttaatgtaatacatgattttcagacacactacgagacccaggttcacagctgcgggcctgtccccccggcactgccgcctgcctggtaagaggacaccaggcgtttgatgttggccagccccgggacggastgaagctggtgcgcaaggacaggtcagtcaaggcctccgatgctgttggcgtttttaatctccagcaaggacctgactttcagggagctgcaggaacatcctttttcagcaaggcttgggatagtccctgcagcattrctgcttcacatgtacttgtaagattgttggtcattgctgtgagtcacatagtctagtgtgcttgtctactttttaatcatttgtctcttacagcagtaaaaatacatctcatgatccagtccatagtacatacctgtatttgcctcatgaaataatgcctatcttaaggtgccatctgatatttttcattctgtggcacccgtgaaattgattttgtgtccattgtgttctcatcttgggagggcaagagacaggagggacagtttgctggtgaccttcactgggatgtgacagggaccttggttcccagtggggaatggtgttccttataatgtgttgtgccgtgtacatatgctcttgtactgcctttgtatcttgccttggcagacatacgcatttctctagtgtgttgcacatgaccatatcctgaacttcgatcaaggattcacattttctccccattcagaggcctttggtagacaccttgttgtgcttgctctagtctggagctcgtggcatgtctgggtggttgtagggagcatgtgcaattataatggcactctgtccaaagaaaaaacttgagcgtaacctgaggggaaaagtgtttggaattttctatgtgtgtgtctgtattagtttgctcaggctgccataagaaaatacgataggctgggtagcttaaaccacagaaatgtatttcctacacagtctaaaggctgcatgtctgaagaaggcgtcaccggggctggtttgttctgaggcctctctccttggctcgttagatggccgttttctttctgtgtcttcacgtggccttccctctgcgggggtctgtgtccgaatctcctcttctgataaggacaccagtgattttttggattaaggcccactcacatgatctcctttttccttgttcacctctttaaaggccctgtctccaaatatagtcacatgctgagctatggcttaggccttcaacatacaaattttgaggggaaacagttcagtccataacagagtctttaagtgacacattggtaattcttaatatgaatgagtttgtgtgacgatttagtaacatgtgggacactgagcaagtgtgagcttctcttgtgggaaaaggcaggtcatctgtgatcagctattctctagcaggcagccaggggcactgggccctttccacactgagtgcagtaaaccctggtggtgggggccatgttggatggtggtttgggtggtggaagagaaccccagttcagtaactgctgtaactgctgggcaggtgctgtggggttaagacaaaacaaaacttttggctggcacttagaatttgttgtataaagaggaaatgattgactagccttgtgggcaaaaatgcacctggcctgcttgtctgcctttttttttttttaattttgttatctcatttacaaccgttttttgcttgttttagtcaaatggtgtttcttcctttttttaaaaaaaataatttttttgttccttttctctttccttattctaggacatgaagcagatcaaacaggttttgtttttgtttttgcttttgtttttgagatgggtcttgctgtgtcacgtaggctggagtgcagtggtgtgattttggttcactgcaacctccgcctccctgttcaagtgattctcctgcctcagcctcctcagtagctgggactagaggcgcactaccatgcccagctaatttttgtagttttagtagagatggaggttcgctgtgttggccagggtagtctggaactcctgacctcaggtgatccaccaccttggtctcccagaatgctgggattacaggcgtgagccatcgcacccagccaggttttcttaatatatcaaatttatgtgctggtcactttagatatttgattttttaacaaaataacactcactggagtttacttaaaacttttttttttttcaaatggaaataaagtcattttataccatatctacttttatattttaatatttcttctgttaccctctcctcccccccaagtgaatgtgctgaatgctcagggcaacatatgaatttggatgtactttatacttttgtaatactcttttctcaatgtggctctcccaggcttgtcctgagttacgtgagggaagaggcaggaaagctagacttttgtgatggtcacagccctgcggtgactattacatttgtttgcccgtcggagcggagagaggtaagtgactcgtctcctgatcactaatgtggcgcacagtagcctgggttgcccatgcgaacgcgtttctgggcttggggcagggtgggcctggatgcaggaagctgggagccatgacagaggcactggtgggttctcaggagaagacaagcttcctgggatagcttctgtcacatgcagctcactcagggagagctgtttgcattttgccttttgcttttttacagcaatccggaggggcctccacatataatgggatggtgttttgttctagtctctgtgagattattttaagtagttcacggacagatttttttttggtagttgggttgttttagtgaatagtggaaaaacgaagtagaatttcaagcctgtgatttcttatgagaagcctttccctccctctctcttcccagtctgcccctaaacccccatccatgccttctcccctctttctcatcacaggccagtttattgctgtgccctctgctgttgatgaaatctccagcgcagctgtaaactcttcgagtgtggctgctgagacttacttgtccttgagtgcccagcgcctgcaagtgttttaaccaggggcaggtgctgatggaaaggaggcgtcccccagggagggaggggtagggcagggctttcctttagtttctttctgccttcttagtaatagggtgaagtagggaggggctgaattcttttgccagagaaccacactccccttcccccaagcaaatgtggaatttgctctgacgtcaggctggcagctggcctggtgtgtgtgggatatggagacagtgcagggctcagctttccactttctgtccccagacttccacatcaagtgctgtcagctgaatgaaggccggagtgtctgatgtttgttctgaatgtgaatggggaggaatatttattcacacttttcatttgtacctacagatgtgagttgaaatcttttaagcccagtgagatgttctcaggcggtagtggttttagtgttttccctttttatttgttctacatttggtaagaatcattttacactgtgagaaccaagagaattgggagttttcctcctttttcttcgaaggggtatgaggcatttcttggtgttagaagaagaggctgatttgttattagtggagcaagaagttccctctgttttttttttttttttttaaagacagtgtcttgctctgtcgccccggccggagtgcagtgccacgatctcacttcactacaatctccgcctccctagttcaagcaatcctcccacttcaagcaatcctcccacttcagccttctgagtagctgggactacaggcatgtgccaccacgcctggctaatttttgtatttttagtagagacagggctttgctatgttgcccaggctggtcttgaactcccaggctcaagtgatctgtccacctcggcctcccacagtgctgggattacaggtgtgagccaccgcaccggccaggtttcttttcaagcttaactgttcactgggcagaccttgtgtgacatgtgcttggacactgtaatacttgggaggtttgtttaagcatttacatttgctcattgaatgattttaggagctggtatttagtaaacactcaccttgtcatatagatcattttaaaaatgctttatttaatttatttattgggtttacatactgtaaagttcagttttttttaagtacaattcagtggttattagtatttttttttagaactgtgcaaccatcatcacaatctaattttgcatttccatcaccccaaaaagaaacctcctgcccattagcagtctcttcccattcataccccaagccctggcaactgtccaccttcttcctgtctctgtggattggccttttttggatgttttatgtcaggagaatcctacactgtgtggctttctgtgcctggtttctcttacggagccctggggtctgcatcaccatgtgtcagactgcactgagccacgtgggcagaagcatcgattatgagtcaaacagaagagggttgggcctgcagctctgcaacttactaattgtgtgcgacctgtttgtaaacctggcacctagtgcctggcgtgtagcaggtgctcagtgagtatttacggaatgaatggtgctgggaagcagcacggctatgcccggtgctaagcccagtaagtcgtgtctcctaagggtgattaaaaagctggcagtgacattcctggtgagcagggaccccatcagcccccttcatggctcacatcaaagacgaatggtggagctcctgctctgtagaagcaacacaatggcagaatcgggtttgtgtctgggtggtgccctggcttcacccaggagcaggtgtgggtacagatatggtggtgcccaggatcccaaaggggttgtggaccgtgtctctggttgtgcacgcatgtgataatgttcactcagtgtcagggttgcaccactccagttgagcacctcgtggaaagcggtgaatggaccatgcaccctgcacggcctgttagcgcttgccgatgtcctagtgattgccacgtgccactgagtccaggtgcttgctggccgaagcttgagtgtctctctgaaggtgactagactagaaagggaatagagtgtaaagaggaaatggaggtgttacgagtcaaatggaaaaaaaataacagtttagaaaaaaattaaaagtaactttactgagttgttataagtcaaataatcttaatgtgttagaggcaattatgattcaaaaaacagaaacagcaaaatgtagaaacctaacaacctgtctttgagcttttcataagtgtggaaaatctgcattaagctgcatgaaacattttttattttgcttctttcacattgttcctgatagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggtaagcaggtgctttctgcctcctggcgctgcttaggaagaaggggatcgagagagggaacgggacagtaggggccaagtcagtccatgcatgcttctgggttggagagagctgtagtttgggctggtgtttcagaaataggattcaggtttgactaagtaagactgtaatcttctaatacctattcatataaaacaagcctcttcttgttaatttccctgtttttaggttcrtcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccggtacgtcaacaacctctgtgcgattttcctttttctttgtatttcttgagatagggttgcactctggcgcccaggctagactgcagtggtgcaatctcggtgcattgcagccttgacttccctgcctcaagtaattctcccacctcagcctcccgagtagctgggactacaggcaggcaccaccatgcctagctggtttctgtagtttttgtagacatggagttttgccatgttgcccacgctgatcttgaagtccttgcctcggtgatcctcccacattggcctcccaaagtgcgtggattagaggcgtgtgccttgggactggcctgcataattttcaagtgcgttgtgtgtattcttgtgaaacataactccctctccttttcttcctctttccattttccgtaaggtamgggagaatcagttactccagcattccttcctagtagacttcggcaagttgccgtttgtcactaaacaatcaaatgtttttcctggctttagagtaagaatgcttctgttagaactgttcactttataaacttgctgtttgtacggaacctactgtaggaaaagtatttaatgagtttacagttgatagggttttttattttaaaattcgtttttaaggagttttgatttttctctggcagtttgagaatctgaagcaccatcaacataacagaaaattttaaacaactaaaaaaatgcattcagcacatttcttttgacccttaacttggtagttgaccttcataaaagcaggatgaaaatgcagttttctgaaaatgtgttaggggcagttacgattcaaaaattaggaacagaaaactgcaaaaaccccagaactggtctttgagctttttaaaagcatggaatatctgccgagaagctgcattttaaacattttatttttgcttctttcaaattgttcaggatcagtatagtccaaggcccctcaggcacggctgtgttcatggcggctgttaagaaggctgtctaattcttgggcgttatttattttgtacgaaatctaaaagtgagaacaagagaagtcttcatgctcacagcaaaaccttcggcactttcttccagccagttactactttgaagcragaggatgtcaagtccatacatttggaactcatttcctgtagatatttttccctagctggctagagagcttgctgttttagatccgtagtgatttgttgatgctacgcaaaaggcttaatgtagacatttaaaaagattcaagtttttttcttggttctcccaaacacatttgtctgtgtattcacaaaaatctagatattcggatggagacctcaccttgatatattttggaggtgatgaatgcagctcagggtttcagcggatgagcgtcataaactttgagtgcaataaaaccgcaggtaagtgtgcgctggagttcagcccctcctctttgcattcatgggcatgtgcttgtgtgtgtgcacaggcgtgttcttggaagtgaacactgaatggaggagtcagatgccctcctttggactggccagctctagcccccagactgggttttttctgttggagtaacactttccccacccccactgccccagtggacacacacacatcctgtttgtgttttcctcggttttctctgtttgttttgggaatgggcccagcaatgagcttgttgggaaagttttcatcttgaattttggtgcacactaaactacagcaaggacagattcggcaggggcgggatggcttgtcaattttgattgagtgacctcttcttttatgtaatgagtatcaagataatcctttttgcaaagtggtgaccctrtggtagagtttggatctggggattgcagaatgtcactgggtgcrttgaagctgaaggcgtgcatttctctgagtaatgagaagcacccttgagtcaccaaggcactggcatatcaaaaagcggtgccgctgtccatatcttgacgattgtagacacagttgtagctgtagagagatgatgggattcygtcatcatcagagacctgccccatctgttgacccccaggctgtgactccaggcaccctgcagggcatcccaccactgctcagagcaattctagggcccattctggtttccagcctaagtgctgccccacccagagggtctttctggcccttgcttccgtgtgttctgtgtgtttttctacagcagagctttgggtggcttggttacaggatgggttgctacaggattcactgtgggatgagggagaggcagctggacatgatgtgaaccatgctctcgaagcctccggagatcaggtctgcgttgggagagacaggcacccctgccctggtagcaccgcacccctgcgaacgtcctagcaagcaggcaaagaaccagcccagggtcttgccactgggaaggctttcaagcccaaaatgccccagtaactgctgttgtggcacctgcccctgggatgcccttgttcacaggtctgccattgctgtccttgttctctacatggccccttttgttactttcacaatacacacattttttaagtacctatttgcttaggccctatgaggctggagggtgttgtgaggatagatggctctctaggtgttcacagactagcagcagagagagataaggagcatgatgatggaggttcagggcagtgctgctagagtagagcgagtgcttagtgttgtcgctccgctgctttaccaggagggaggcaccgaggtcagctggctggggtctgggctgggtgcaggggtcaggcagttcagagaggaggaagtgctgcctgagccacactacattgaggagcatgccagtcccgtgttggggtggctttagggcctgggcctccagacattcaaaggcatggaccaggggaactgcgagcaggttagaggcgtgtatggggaatgtggctgaagatgaccctggaacggtgagtgtgcagtattgtaagaaacttgtatgtcctgcagaggagctggattatatctggaaatctgtgaagtcccaaggattttcagcaggggtatgacatacatctgactcgtgaatgagaaaatcagtgtggcctctggatggacctcgcatctggtctgagcactccctgcacccctcagcttctccatcattctctcatcgccctcacctcctagcctacctacgctactagcctccttagccatgtctgcaccctgaatcacgtctctcctacttggtgtccccagtccccagggatgcagcctgtatcttccccatgtgcccagcccctctgatgcctgaccttggttctggctcccaggtcaccccaactggctctcctggactccggctggctcaggctgctctgctgtggtctgaatctccctgcaactttgtgatgacctcctttggcctgttctgttcagggctttttattaatgacttggccgagatctttgagagtgtgctgatctcatttggggatgctgggaagacagaatcatyatccaaaaagatcgaaatggacgagcaggatatgagaagggcattatatcgtttcagacttacagggaagaggtgtggacatcgatgagctgccaaccaaacaaaaaacacaggagagaaaaaccaaagaacagaaagaaagaaaaatagaaaaaaaaaagaagacccgcagtagagtggggagatcttgccttgtagttatgagcatagatgaggccacaccctctgggtttggttcccagctgccctagtttttagttatgaaatcatgggcccagagggagctaaagcccagatgagctgaggcttgacaaaacgggtgaaggcctcccatagctccatttttccttttcattataaaaattttcaaacatggaacattaaaacagaaatttacatgcctgccactctgacagccattgatgttttgscagatttttcatgtaagccatgcgtcattgatggctcatatcaccccaccctgatgccaagaacgaacattcctttatgtaaattcagtaccatcgttgtacttaacaaaattaacagtgacatcctgatgttaaaaaacccatgttttcctaggctgttttcattatgattgtaacaaggagcctggacagagagatgtcaggtgttttgtgggagggttttgagctggctctcaggcaggagttggattaaaaaatacttacatttccttccagctctgtaattcagcactccaaactctgagagcaaattgtgtactgtaaaattagttcattattattttgctcgaatttaaacttagagtttttggagaatatcccttggtagactctgtttattagatagatgtatttttgaaggtgaacgagtgttaattggctatgtaatagaagtgtggtttaagttggatctctaggaattattcatgtgaatctaggttcatgtacttttcaggatgcaagcgcatcttttggtcataatattttttaccagtttaaatctagtttgttgtaaagcgatgctttattattggtgatttttttaaataaagatgttagataattttttggaagagcagaattcattaggataggctaataaactactcacaatttaagtggctcagcccattaaaggtttattttcttagttcagtgctagtctttggggatggggctggggtcgggggtgcgggctctgctccatgtggtcatttggagacctacgctttttccatcctgtgtttctgccatctgcagatgtgacttccaggggctctgcaggatgggaacatcaatttgctttgttttattttttttccaggccagaaataagtcacttggcccagcctgaatatcaggggaggctgggaaacggagtttagctatgtgtctagaggaaaaattaaactagttgggtaagaggtagcattgtttttgccacagagaaatgggtgctgctgcctcctccttaggcagagagctccttggttccatttgaaaaccttccttccccttttgctggaattgagagactgaggacacaaagtggtgtgctggagaataaactagagcctgtggtgccagactggcaacttggggattgtgtgagtgagggagagattgtgcagagctaatcctaacattgctgatgagtggacagaaaccataggcctcatgaatagtgatttctgaagtcaaagcccagtatgcttaaatatcaacccaagtggtttgggagaggggagcacagcttactgttctgctaaaattctttgaggaattaagtaagaatacgtgtaaggtacgtagcaatggttatttacaaaatggactctgcctgcagattattagtatgtctcagatgtaaaaccagctcaaaagtactaggacgatttgtagtagtatttaattatttgtaaacttasacgtttttcttcacgtttgcagaatacaaatctttgtcagtagtgaaatgtgaatctagtaggattaaactgtgtgtaaaccttgtgggcgggatgaagagaggcagaggcgcgtcactgttgctgttagttgaccggcaagctcaggggcccagctatggtagctgcctctgggttgtcagctgcgcccaggaggtgaaggtggaaggcattccttaaagacagtggcttagtgtacttattaaaaaccaaaccaaaccagccaaccaaacaaacaaaaaacacaggagagaaaaccaaagaaaaaaagaaaaatagaaaaaaccccacagtagagtggggcaatcttgccttgtggttatgagcacggatgagggcagaccctcagggtctgattcccagctgccctagtttttagttatgaaaccataagcaaattatttagccaccctaaatctgcaaaatggtgctaaaattgtacctttgccatggggttttgaggatcaaatasattaatatagtcatgtgttgcttaacaataggaatatgttctgagaaatgtgtcattaggcgattttgtcattgtgtgaacatcatagagtgtacttaacacacacctagatggtatagcctgctgcacacctaagctatatggtgtagcctattggctcctgggctacaagtgtgtatagcatgtgagtgtactgaatactgcatgcacttgtaacacaacggtaagtatttgagtatctaaatatatctaaacatagaaaaggtccactaaaaatacratactataatcttttgaggctaccgttttatatgcagtctgttgttgaccaaatgttgttatgcagcacgtaactgtataaagaaagtacttaaacagagcctgttcttctgcagcttgcctttatgtagccgaggtgctgagctcagtgcctggctgagattgtgctcactacaggtttgccgctgtggctggtattataattatagtgatgataatattaaagattggatagaaattacaattgaaatatcatttgctcttggtacagaatcttacttcctgttttcttagatcattacctagcttatgataccaaacctcaagaaggcagatcacatggtgggaggctcagacaaggattatgaaaccatcaggggtgggaaaaggagtgttgtgcccacggacccctagcctggaaaggtgcagggataggatttccagcaaggagcaagtcagcaaagcctctgaatctcagcgtccatgggatggggacgtggcctgtgaagagctggttttcagacttaggcctgaactattcctgctgatggatgggaaatctgggtggctcactcttggtggaagaagaggcttgatttgaggagggtgttacagacaggtgcactgacggaaccacagaatttcagcactgtttggagttgtgctgctaacattgtggggctggcataggaccttggcgtgcttcactgggagcgactgactrtagatggcttccactcttgttttactttagggatgagtcccagagaacttgtcttgttcacagtcgcatcactaagtcagcagtgcacagggaactagagctccatttctgtcctcctttctgtgagtccccagtgtcacccagagatgttcaggagcctctgggagctgaccacagcccgggagcagaggatcccactcactgctcttgcgttcctcctgcctgcccttttaatcttatctttggagrtgctgtacacagccttctgtcaatgtctcccaaggtgaaaggcatgctggcctgccatcgaggacttagggttaagcatctgaagcttaatagaagcctgtgtcaactcagatccccatggtctctaaaaaaacctggacctgaattttttaacggagcagttggcattggtcctgttcagtttcttccttgctccttagctgttcctcaattttggtcacgtatggagtttaaatttctcctcttgaattgtgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcaggtactgccctccttgccatgcgggtcttagtccacatgctcatggaacattttcccatgagtacttttggaaatgcggttacyattttctttgtcagtgggttgcgtcacagccctcccccagttttttcatgtggctgtgtgaattattagaaggagcattggactgggaggtgaaataactgaatttgagaccagcatttttgaccttgtgttttcacccttttacacactgcctctcttccatctctgaggtgggatctgcagcctctgccccctggggttcttctgtttggatcctctaggcagatggatgtgcaccttgggctgctgttcaccgctgcctcagcgtgcagtgggcttgtactcgaggctgagcttgctgttgcacggcaggcaccggatgaggtgccaaggaggcagcagcgccccccacagcacaacccctgtccttgggggcctggaatttagcaggaaacagagcaggtggaataataagaatgggagtctcaagcagggataatctgatgggggggatttctggttttaccctcttggcagctcaaattaggtgtacagaagccagttgcctctgtaagggggagatgacccgaagcagagagaatgacttgcctcatgtaattaccacccagaacagtcacagaactgctggcggtatgttctcgctcgtaagtgggagttgaacattgagaacacatgggcacagaggggaacagcacacaccatggcctgtttagggttgggggtgaggggagggaacttagaggatggatcagtaggtgcagcaaaccaccatggcacatgtatacctatgtaacaaacctgcacgttctccacatgtatcttgtttttttttaaagaaaaataaaactgccagggtgacagcactgctgctcctgtcttctgagtcccacctggtttgctaaataccaggttagaaagaggaatccctcttgtggagtgtttgagaacctgcctcactgtgaaccgcctgggcagggagtgctggcagtgctgttgtggttaaacaccctgtgtgctgctgggaacggtgccatagttaattctggcacatgtgtgctagtgaagacattgrttttctgtgaagtggaaagagttctagctgcagagttggagacctggctgaggactggtgttgccgcatccaaccacatttgcttgagcgagctgctctccaggcccgggtttcttacggtgaactgggtggtgctgttagattccttaagttaacttttttttttttaaacattactgtgtataagagacaacctaggatctatgagataaggagagatacatttttcaatctrcagacttcctgacatagctctggtttcttggaatctgcagtatttcgtggtatttgtgcgtagatagccctaagtaaattatgaagggagagctaaaaccattccttactgcttgaagaagtcccttaagactttacagcccacctggctccaccccagacttccagtgtttagggcaggtccttgttcacatgcacagtcttgtatggtttcttttaggctgttgacattggaaagtacttctccaaatgtactgtatcaccactgatgagtcatggggttttgccttccaaaccccagtacccaacctgcaaagggagcattttcaaatgagaacgtgtatttttatatctttacctcctccttgacacactttgtaagttactccttcagcgactgttcgccgtgtggtttgctttttgtggatgccctcgcccttgcttgctgtgctggtgacactcagctggtgccccctcacgtcctgcaggtgcctaatcagtgtctgatcacactgaccagctcaccagtcttgtgagttcagcggccacctgtggtaccttgcttgtcttctgtggtagcatgcattgcatcctgcactcagtctgcagatgtgtaagaggttgctggtttcttttagcttcacaggccttcacaggggccgagcggggtgtattagcaatggtgttaagcggggtgtactagcaatgatgtaccactctactgcgtcccaagacacaggctggcttcttgatttgggttttcagtttctaatttcatactgtggggcttgggagaattttgccgttcagttctctgtcccccagttggrcctactcttctgaagaagtattgggatgtagtttgtttctgtcacattaaatgagaaacctgagaatctcggtgaatttttgtgctttcagtctgcccgggttccagaaacagcgctggggattgagtgacgaagtggtttgggaactttgagcccttgacttttggcttaatcactatttattctgtgactcagagaaatcagcattgcttttggctaaaatacacttttgttttgttacagaaccagagcagaattgggaagctgtggatggcagtcagacggaaacagagaagaagcattttttcattaatatttgtcacagagtgctgcaggaaggcaaggcacgaggrtgtcccgaggacgcggcagtgtgtgcagtgggtgagttgtgcctggatggaagatctaggtgatgcttttctagggcatccagtttggaatgagttagaagatctttctgtggttcatctaagcctcctctttctataatcacatgaaggatggtaaaaatttttcattcataactcaaatgtcagtaattgcttgatgcactctggaatcctgaagttggctagagctccctgacatgggctaaagccataactgggaacagaaggaaccacgtggaaaatactacatcatctttttagtttgtaacctgaagaataacattgccagtgtttgtgtacaagtgattttattttattttttaacaactttattgcctagaatcgttcaaaagttatggcttgagtgaagtgtaatctcagctgtagccctagtgtaagaggggcttgcatgcttcgcttccttttgctgtcattgttttggtcccgtagctgtcatgcagagacttctcaattatttgatacaggtatttagcacttcatttttgtcatttatgactcactttgaaaatgccaggctatgagaatagtgagaatctgttaaaagcattcaataaggaattgtgagcctcgttggattttaggaattatctcggtattcagaattgctggtgtgtctttaaaagcaggttcaggcatgtccatgtctttactaagaaggactttggaacagagttttaatcctttataacaaaaagcaagtgaacyaagaagtaagcggcctcctgcttgggttgctaaacaggtttcgttaatttctgctttggatatgagacacattctcaccctttggctgtgtggctgtgctttcaaaagactttgtgtcttggggtagctgaagccctgacagtaggggacaatgtcagtttacagttggtgctgatgcatgttgcaagccatttggtctttcttgccctggaagggcattgtgcatccttcatggcrctttctggctgaacctatggatgaccctggaggaccccaatgtggctgttaatgtctagccaaacgtggcactctagggaaacccatccgctgccttggtgggttcagggggctggagaagggctgcacttgctgggtttgggctgatttctttctttctttctctttctttcttttttttttaagtcacttctttbcgtgatgatcatttttaaccacatcttctgttttctccccctttctcttccagataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtaaaaattttaaaaaagatgaaatcttttctggcttctgccagaggtcctgcattcttcatakctctgttcctcatcagtcactgcaaagctgatcagacagattggcatggtgttcagcattttgagttccagactctggcgatgggagataggtcatttggaatttttccctcatcccctcctcaaaaccaaatcagaaatggagaaaccagatggtgtcagaagggagttgtgggtctcagcgctgtatcctcttcctcgggactgatactcggccagtcatgtggttacttaacttccttcaaaggggaaaaaaatcataaatggtttaaaacattgcccgtgatctcaccacttaaacacaatgttaattttcattacctttatttatagatgtatgttgtttttaccaagtcaaaatttttatggtaacaaatcttaatgtttctcaaagtgtagtattttgtaaatacttttctatgtttcacagttccattaataatttttaggaacttccttgttgacatggtgtggttttactatttttgaacattttccttattgttggattaatagcgcgtttccagtgttgctaattgtgctattatgtatcctctctctacctcccattgaaatatttcctttggataagttcccagctgtgggataaagtcagaagctagggtcattttgtttgtttgttttatatggtaaaatatacaacataacgtaaaatgtaccatcctaactgcttttaagtgtgtagcttggtgacattgttgtgtaataccaccaccatccatctccagaactttttgatcctcccagactgaaactcagttcccattaaacacgagctctccattccctctcttctactttttgtctctacggatttgactgttctagatacctcatataggtggaatgctacagtatttgtagggctgttttttgacccttctatgcattatacctcatttcccactgtcccttccaagtctacttctagcagagaagaatgaggtaagatattttaggaatgaacggattagtgatccccatctcttttccccattgacaggtgatctggaaagtgcaccagtgttgagaacttctggggaaggcggttgcttttatgagtttgagtggcrcacagctgcggcctgtgtgctgtctaagacagaaggggagaactgcacggtctttgactcccaggcaggtctgtgtccaagcaggacctctgctttaatgtgacttggaaccacttaaggttttttccttaacattctgtgtgaggttttcaaggtgacccgccttagaattttattcatgctgtttgaacaaaattctgaacatccgatgtttgaggcttatttgagatactgaaaataytatcttaaattcattattgaggtggttttgctgaatgcaaaaccttcggaacacaagggaataaattatgtttgaaaaggctttcgtgtgaattctaggcaagaaacctctctgagggagaccttacaagaaggccataatatcatgctcgtcctactttgaacatgctgttgtttattagcccagcagttatgggctttgaatagcgctttaggctaacccagtagaagggaatggtggagttggatccatctccaaggaaaatgttagtaatcgcggttctggtggcctcaaggggcagcgtctcttctgcctcctccacttcttcctgccgttgggaacctcctgggaagaacctctccctttcaaactgtggggtgagaccactctgttaactgtcggactgaccttccatacttttattgtttttattctttcttagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaaggcaagtagcttctcagttctgtttcattcttaggcattatatgctaagaaatattattttcaggaataggtgtgttctcacttaatgtcattgctttatgacaagcatttaaatactgatgagacctggtctgaaaactgaaggatgttaggagtttaatttcccagagaaaggagcaggcccatccttgggaaagaagggtggattgaggtyatgcctcactattgcgcattttgtgcttctcagtgcctagatatctctgtgcgtatttctgcattctgcgtaactgcagttcaaatgaagtgagttgtctaaaccagcggtgccaagaggagatttgggtcccagtgttcctgctgccgttggagaccttgtgtgggttcctgtggtctgcagcccgggcctggttctggtgactcctcacgtcgctcacgggccctcccttcagtgtggcagccttggagtgcttctgcccctcaggtctttgctgagagaaacgtgtrtttatttcagtgatgagaagacttggaacttgggtctgagtaatgcgaagctttcatattatgatgggatgatccaactgaactacagaggcggcacrccctataacaatgaaagacacacaccgagarctacgctcatcacctttctctgtgatcgagacgcgggagtgggcttccctgaatatcaggtaggaatgtttgtycctcatcgcgctccctgaggatactcatgcctgtggtgggcctttcatttaagcagagcttgtatcagtctgggtttccagccaaatcatcaccgtcattagatttgccagggtgcctgggcagtattagtattttaagctgtttatttagtgggttgtgcaccttaatracagcccacaagcctgtcagttttgggtacaaaacatacaaaagcataaaaaaaaatcctgaattaacccccacttagcagaggctaaattttcatcctgatttgttactggacartcttctttttaataaaatgaagggagatgggcagactaagcttttcttcacagtttctcattgggaacattgctctcgtccttttttgaatcctggttttatgtcacgtgtctttctctttttgccatccctccgcgcatctgccgtggattaggaagaggataactccacctacaacttccggtggtacaccagctatgcctgcccggaggagcccctggaatgcgtagtgaccgacccctccacgctggagcagtacgacctctccaggtgaggcagagtcagctgctctgtttttggcctggtacagatgctgaggttgcaagtgttgctggtgagcgtgtgactgagctgatgatggggagtgatgctggctgtggggctgcaggaccaaggtggggcattttcagcagagtgaattctaataacwgtctggtcgcctttgggatagcaaccagtcttggccacagcagagcctcrgcctttagcttcatcatttaaaacaatgactgtcagtgcagaggcacgggggacagttaaggtccactgcatactgagttcagcgaaggtggagtgtaatcctggtgcgtcatgcgcccagacaagccaactcctggtagtgtgattggtggagcatgttttatttggtagctttacttccccaactacatagaaataaatgagactgaaatgtgtaagctctttaaaagcatatacattttgctttgaaattttagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcaggtgaatctgttttcactgcttgtctcctttgccctcctaattccatgacttagtgggaggaggtggttattctgggacatccagatcaaaggcagcacagctgctcgagagaaaccctctgagtaggagtggggcctccatgtgaactcatctgcctcctgtaggagcagaagtgtgtcacacaggaatcattgttcacatggagaatgctgtgttgcagacttttgatcacacaaagggcagaggaagcaccgaatggttatgtctagcctgaattcaaaagtgtctttaggtgctttcagcagacacctgtgaaaaakagagttttgcttccaaaagctcttgtttctggattgattagggggaaaaaccgatttgggagagttgctgtggatgaaccagattcaagcacacgctctcattcgctgcagttcgtccctgggttgaatgcagtcaccgccagaacatttacccgtctcctgtggtcgttgtacgtggtgaatcttaaaagagatgtctctggacatctgtattggcttctgtaaaaatagcatgttgggaatgtacttttcttggtgtatgctaatggcagcttggaggtttttgaaaggaaggtggcaagtgtgctctggtggttaggaatcgagttcctggttgtgtttacctctgcacatgtgtgttctttactggagcaatgagttcagtgtatagtcagtcctctttattcacagattctgcatctgtgaacttgcctacttgagaacacgtgtaactccaaaatcaccacgcggaacactttctcagtcattgttggaacgagtgtagtggcccaatgtgcatagtacccgacaagcctgttcctggttgaagttgaacagggggacactctggcctcttgtttctgcctcaccctgagatgagcaggggatggagagggcgaggcagtgcagtgcaaaagctccagccctggggccagttggacggggtctgaattccaactctggcatctcaactcagagatgctccagagctggaacttccgcgctgcactgcctggtaaggtctccctaagagaagtttcttgcctagaattcacactaaagccttttcaaacatgacttactcccttgtgttcggaaagtttagcggggcagccttaggtgagccacttaacactccttaacctcgtttttccttctgtaaaataaagagagtagaatctgtcagcatgagttgtcttgggatttcagatttataatctgtgtgtaataggtttgtttgcctgatgtgcggccagtcagtacrctgagacattggggattacagccgagaaagagtttaattgtagggcaggcgaatgaggagatgagaagaaacctcaaattcacctccctaaggaatttgggttgagggacttaagggatttggagcgggccaaggtgtggggattgtttattggtagaagagtgcagggtgaagtcatcggatggggagatgaagaaactgcatttggttccctgtagggaggtcttcatagtggttagtgtcagccgttccaccggaattcaggatctgaagaacatcttacacgattattgaacgaaagccttatgattccaatgccagtgattctttctgtagcaataatggggatgtgactagtatctagtgctatgtgactttcagttacaggccagcatgcagcctgattggtgctcaattgcatgcctggaacgcagcatgcagttgttgttaactctttgaggatggtttcctattccatatgtaataaggggatttccccaggagcagtggttctgtattcaataattcattgtttgctgcagctttatagaatgtaaccaccaccaataacgaatcgactgtatcttcagggggaaaagcctaacaagactggttttcttgcagggctccttcactgaagtggtttccatcagtaacttgggaatggcaaagaccggcccggtggttgaggacagcggcagcctccttctggaatacgtgaatgggtcggcctgcaccaccagcgatggcagacagaccacatataccacgaggatccatctcgtctgctccaggggcaggctggtaaggcactgctgctggctggtgaccttcactgctgcattttttgactgagcgttgccttatgtgtctcttaacagcagcagtcttggggtgggtggcggagctaggccagtcttagttctgcttaaggtcagtgtgcggtatatatgttcacaggcagggagtgatttgtggtaccttcatggctgcgatttctgaagtgtaagcctcatcttttgctgcggagtttgaggctctggtgacatacactgtttcctggattttttttctgagtcgtacagacattatcttgcctcttagttcttgtgagttgaggatcgtggcagtggaacggggcttagagatagkttggtcctgtaggggccaagggaaagcttccctttcaccctttgaagtttccctgaaaatcagctgtcaacaggagaaaagacattaaaattttgacgtgcatagcaccggggaataaatagcaggagaaagatgacccagtagcctaatgcaacacagaaggttatgtaccctatttcacaggggagagggagataggggatgtagacagttcttttgacggggcagcaaatgattatttgggagaaagaatggacagaaattaacttgcaaatgattctctttggagcctgaatgaggaaggcattatcttgtgcacaagtctgtccaggtgtgattgctgtcctcagtcttcttttgtgggatagataatgagatttccgagtttcttttggaaagaagccttcttggtcaggtaaggaaattccagagaaagtctctccctgtgcttgagggtggaggtaacaaggcacggttcaaaggatgaccttgattctcaggcagcttctcagcatgtcaaagcactgatccttggggtattgctttctgagccccagcagtccaaaccacaaagaccacagataggaatctgaggcttggtatagctcaggcctgtgggtgaacgatgagggctgtatgtgtaatacaaaacaggaataagaaattaaggctgagggctgggcacagtggttcagatctaacccagcactgtggaaggccaacatgggaagatcactcacttgaggacaggaattggtgaccagcctaggcaacatagtgagaccccatctacaaaaaatttaaaaaaaaatttagccaagtgtggtggctcatgcctgtagtcccagttactctggaggctgaggcaggaggattccttgagcccaggaggttgaggattcagtgagccatgattgcactgcagcctgggagacaaagcgagcccctgtctcaaaaaaaaaaaattgggaggcagaggtaggaggattgtttgagcccaggagtctcagactagcctgggcaacttagtgagaccccatctctacaaaaaattagccaagtgtggtgatgtgcacctgtagtcctggctacttgggaggctgaggtgggaggatcacttgagcccaggaggcagagattgcagtgagctgaggatgtgctactatactgcagccccttggcaacagagcaagatcctgtttcaaaatagtaatcatataaacaacttcagcaaagtctcaggatacaaaatcaaggtgcaaaaatcacaagcattcctatacaccattaacagacaaagagagccaaatcatgagtgaactcccattcacaattgctacagagagaataaaatacctaggaatccaacttacaagggatgtgaagaacctcttcaaggagaactacaaaccactgctcaaggaaataaaagaggacacaaacaaatggaagaatattccatgctcatggataggaagaatcagtgtcatgaaaatggccatactgcccaaagtaatttgtagattcaataccatccccatcaagctaccaatggttttcttcacagaattggaaaaaactactttaaagttcatatggaaccaaaaaagagcccacattgccaagacaatcctaagcaaaaagaacaaagctggaggcatcatgctacctgacttcaaactatgctacaaggctacaataaccaaaacagcatggtactggtgcaaaacagatatatagaccaatggaaccgaacagagtcctcagaaataacaccacacatctacaaccatctgatctttgacaaacctgacaaaaacaagaaatggggaaaggattccctatttaataaatggtgctgggaaaactggctagccatatgtagaaagctgaaactggatcccttccttacacctgagacaaaattaattcaagatggattaaagacttaaatgttagacctaaaaccataaaaaccctagaagaaaacctaagcaataccattcaggacataagcatgggcaaggacttcatgactaaaacaccaaaagcaatggcaacaaaagccagaatagacaaatgggatctaattaaactaaagaccttctgcacggcaaaagaagcatggatgaagctggaaaccgtcattctcagcaaactatcataaggacagaaaaccaaacactgcatgttctcacttataggtgggaattgaacaaggagatcacttggacacacggtggggaacatcacacaccagggcctgttgggggctgggggggagggatagcattaggagaaatacctaaattaaatgatgagttgatgggtgcagcaaaccaacatggcacatgtatacctatgtatcaaacctgcatgttgtgcacatgtaccctagaacttaacatataataaaaaaaggtattaaaaataataataataaaatgaattaaggctaggaggtagaggaggtgagtgggattgatgttggccctgagttccttagccaggggacaacagcagactgtgtggagtttgctctgctcttctctccatggaaatgctttggggccattttatacagtcccaattgcttctgttttttaattggggtaaaatatatataacattaaactgaccattctgactgtctttgggttacatatattatacacatctctggtgtcctgtatttatcaccagtatccatgtccaggacttttacagggtcttgctgtgtcacccaggctagcgtgtagtgggtgtaatcattgctcactgaatcactgcagcctcgacttcctgggctcaagtgaccctgtcacctcagcctcctgagtagctggaactacaggtggagttacctgtagttatcaaaatggtttttaaattttttgaagagatggggggtctgtctatgtggcccaagctggtcttagaactcctaggttcaagcagtcctcctgcctcagcttcctaaagtgctgggattataggtatgagccaccatacacagcctagaagttttttgatggtctcaaatctratttggaaaggagagctttatttctcataaagatttgcagcctgcagggtggccatttctgacaggctgggaagtgtagcctcaggccagaagccagaaacaagcgctgggagggaggaagactaagacacgaatggatgctgaacaggttagtcaagtatacatattcagcaggttacaggagcagctatgcatattcacgaagggatggcacacacatgcgtggtaggcaacatgtatgcagcatgtgtccccatgttcattttgggttgaagacataacatttaaatatattacagttgggccctgtatgtcgaaaggtgaagcagaggacatgaaggccctctgtgtgcagcctccttagaaggccaggaccacctgggagttgtggtctcttatcagcagggaatgctggtcgattgttgtgttgtcagaaccacaaaaagggatggacgttgtcaggtggtaggttgataccagcagcagagtctttcaaaagggtcggcttctgtttagcacttagggaagaaagcctagtggttaacgaggaaaggggtgtaatggggtatgtctcacctcccaccccgtcatggacaggaatgcaatttttaagtttctctggagtccccttggctaagagtggggtgtgttcagtcagttatggggcttaggattttattttcatttcttattacctgtagttttaggtttataccagggtcatgtgtttttgagaaattatcaaatggttaggagagtggagagactggaagccatgttcattatcaactaaattattaacaatcccttgttaagggtgtgtggcagcttcctcaagccccactgaaatgagccagcaggatgcgttctttccctgcagtggcccagtggacgctgcgtcactcacctgcctggtctgctttgtcattggctaacactctttttcctgagagacacttcctttagagttgaagatctcggtgatcagggaatgaatgacgggcaggctgagcttggcccatgctctctgcgggaggtgttctacccaggttgtacacactctccttgggttcacctgagcttgggccgcccacttcttctctcagtctcaggaaggatccaggtttggtgttccacggggagatgcctaggttgcccagttcagcctgctggtctgtttttgggcacrtctgtgcattccctgcctgtggactgccccctccttctctggtttcttgttgccattgagacactgggtagttccagaaagttcttggacccttggttttccagcttttctgtgataccatatttagtttacagggtagcttcacattgttgtcgtgtctctcagcactcatatagggcctgcagcacaggaaatacactcactgaaggaagaaagggccgctctcccaggggtttgcagtcacagaactttcacaggctaaagctcagtccctttcacaagcacattgtgaagtggaaggagcaggtgtgtttttattctactgctagtgttgctgaggcctggagtgggtgggggctttcaagggtagagagcccttgacggccaagggtgtggactcagtgttagtggctgttgttcctgaacccgtgaccctgggcaggtgtcttaacttccttgtgcctcagttttctcatttgtaggctgtgtttgtgggtcactgtgaggcgcagttgagaaatactaacaaaactcatagtgcagtcctggtgtgtgataaacactccctgatcggcagctaccattgcctgtgtggtggtggtgctctcacaaagctaatggctctttgggggagctttttatggaaacatacacaccgaagggcacacagatgataaygtgacacagctgggtgagtgtccataaactacacatcaagaaagaacatgcttccccctaggagccctcctgtgccctcttcctgccactgctgagcatcctcctgacctctgacagcgcaggccattgttgcccaatcctgagctgatgtcagtgaatcctacgtaccgttgcctttgtgtatggcttcttgcattcaactttttgtgtagggtacttttcagaaccttgagctcagacctaggtttggatctgaattctaccatttactgctggcacgatttctatatttctgaatatccaagcgtaggagattattttgtcttcatagggagaatgagaacattaaattctaattaggtaatgcacattaagtgcctagcttattggctgactcataataaacatctagcagattttggctatttttatgtctcaggcgagtattcttttggttctatcaagttccatgttactgtattgacttttaccctggatttgcccattcagaacagccaccccatcttttctctcaactgggagtgtgtggtcagtttcctgtggaacacagaggctgcctgtcccattcagacaacgacggatacagaccaggtacgtgtgctttcacctggccctcgtgctgagctgcctgctggacatcctcaactcaccccagtgttccagctctgaaccgacccctgccccttctttctgaatcagttactatgttgcattgacaatgggtgtctgcaggtcacccagagttcctctccactccgcagctcccagctcctgggataagaaccaggtccctcagtcttactctctgctcactgtagtttccttccttttgtttccattcctttgtgccttccatgtggcagtggtatcctggtgggctctggggcttctgcaccaccggcagatgtctgactagtcgatacgtcactccacacctaaaccatctcagtgcctgtcccctagagggtagagcccgtatgttttaatgtgaccctatccatagagcacagcctgcaggtgttaatgtgatcctgtctatagggtaaggcctgtgtgtctctcacctgtgcataggccagagcccacaggtgttaatgtgatcctgtctatagggtgaggcttgtgtgtctcaccgtggccctgtgtgtagggcaaagcccacaggtgttaatatgatcctttctatagggtgaggcctgtgtgtctcaccgtggccctgtgcatagtgcagagcccacaggtgttaatgtgccacttgagtctctcagtgcctactggctcctcccgccttctgcccgggtccatgccctccacttgttgagtgcaccctgcagggcatagtagtaagctgctcagtgacgttctctctgacctccccaaggtagtgagttgttttcacagcaccgtgtatatttctttatggtgggacctgtttgccttcccacttcctgttctaagctacactgcagactctggcagcagagaccaaggcttttccaaaccaacggccccagcacagggtcctggctttgtaactgctcagtgagggcaggatgccaggcaccctgttcatggacaatgtttctggggctgtggccaccgtctccttccctgcattcagtggacagagggaggcccagggcaaagttaaatatggagaggagaggatatcatttgacagtcacctggtcatacttcccatgattaccttaagggaataattgagacagaaaacagaacatgagatttcttaagatgtttattttctttaagaaactaatttatgagtcttatatttcctctccaactttagggagtagcartagtcttcttagggaaatgcagtagccttaacagcttccaggtgagtgtaatttctgagtctgggctcacacttggtatacttcagggtggtgtatttgaagaggctacatgtagggctacatttttgatagggattttgaaagtaaatggagaaacagttttgtcaggtgcatacttgcaggtttctggaggtgctgtatgtatgttatgttcctgtggaattggtttgaatgcgcccctttttccccattttgtttcctgtaggcttgctctataagggatcccaacagtggatttgtgtttaatcttaatccgctaaacagttcgcaaggatataacgtctctggcattgggaagatttttatggtaagagcgatatgatgcatttccagtttgctttgaaacagggggagagtgcattattgaagtcacctgcacgtggtgatatgagagaattgcccaggccactgtggtggcagctcttactcagaaggagatgggaaaatccagatttaagggaaagatgaagtaaaaccatttaccaccattctggcacagttcagacgtgaagactgttattcttcaaataataagttgttctctttaaggaaacactttctaaaggtagtgctgaagcctgtactcattgtccattggtctctccttactgtatcttcacaccagagagcataattgacttcatttttacaactataatataataatttttaatggaataacaaatttaagaaatgtagggtaccactttatatttacttgtaattaacatgatttcaatgatacatactttctcataattgaaaatattataacattatgacttctgtgtcttccctctcttatatatggtacattattacatgcagtagatcttacacatttatagatacggggatgtatgaatttaaatgatgtatagatactaaaccttaaaggcagtttatagatactgccctttggacttatgtactaactgtactaacatgccagaaagtggaaagttggcaagttaactaacaaataagaaatgtttaacctagtgggatttggagttgctagggttcttgtctrtggtgagatacgaggcataaatttgtttgtatggctcttaccgtctgacctgcagtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaasgtgagctcagagccatgttgttttgtagctaaaaagggccctggtggctctgtggctggccatgcaccttcctgagtgtaggatgtgcacatcccccgccaccatgggctgtgctgtccaccttgctgcaggagccatcacggtggtcttcctgcgtttgacctcgcagaatacaggggtcccgttatccgtggcttcacttttgtggtatcacatggtccgaaaataataaggtattttgtgagaaagaatgagagaaaccacattcacgtaactgtcattacagatattgttacagttgttctgttttattgttgatctcttgctgtgcctagcttacaaattgagcttcatcctctgtatgtgtgtataggaaacagcatagtatatatagggttctcaatttcaggcattcactgtgggtctcggaacatatccccccgcagataaggggggctgctgtagcctgtattcaacacagcagtcagagtgatgtttctgaaacatcacatcatatcacttcccagctcagagccctcggaggctctgcactgtacctagagtagaagccagtgtccacagtacggccatgggacgcccgtgggggctctctgagatgatcaccccctgctgctcttcccgcttggcccgctggcctccctgtttctgatataaacaaagtgcactgtctcccaccctcccctcttgaatctttgtacttgctcctcgctctgcaaccagcacagctgcaggcaggggttttcgtctgcttcattcattccgatacatggtaggaacttagtatttgttcaataagccaacgaattagagttacattgtcttctaatgcttggattggtaaactcgtgggatttaaatattttctggaagagtaggaatgccaggatgttaggcttatggtagaaacctgtcataacataggccgctgttgcagtgtgtaaagctgtcatcacataggccaccattgcagtgagtgtgtaaacctgtcataacacaggccaccgttgcagtgagtgtgtaaacctgtcatcacataggccaccattggagcgagtgtgtaaacctgtcataacacaggccaccgttgcagtgagtgtgtaaacctgtcatcacataggccaccattggagcgagtgtgtaaacctgtcataacacaggccaccgttgcagtgtgtaaacctgttgtaacacaggccactgttgcagtgagtgtgtaaacctgtcataggccactgttgtagcgagtgtgaccactttgttcatgtcgagtccctcgatacacacttggtgccctggtgtcattgctcccacgaacggctgtgaagcttgttgccagtggcagccttgtcctgttgctgcactgtgcttgtgggctgcgccatgaatactgttctgtctcttaaaatctgggccttcttgctttacaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccggtaaggccgtgcggcctaagaactgagaggccggtcaagagtcagtgtgtgtgtgagtggatatgaaggtgtgtttctgtgtgtatgtatatttgtgtgtgtgtggtgtgtatgcttggttatgcaggcagcgtgacatttctgttatatattctctttgaatgatgcctagagttgtaatgtttttcttgaagagaatctgactatatagttaatggttttaagctatcttttgggatcagatacatcttaagaacagagaagaaaatgcagaggaaacacatttcacatgtactgtcagagcttcttatttgagggtgaaaaaaaaagaaaaagatgttaaactccctaagctgtgccctggaagctgacagtgtatacaggagaccttgacctctgggattgaccctgcctgctctgcaacagtggtacttccttgtcaagggcagtgggggtttggcttttttctttaaagagtctttagggactcactatgttgcccaggctggccttgaactcctggtcctaagtgatcctcctgcctcagcctccaaagtagctgactacaggcgcatgccaccaggcccggctgtgaagggcagttttgagggacagagtgggtgtgttttgtaggcaaagcctctcagcctcccgtggatttccttatcctcacagttaggaatgccaggttcacgcctcctcagggcttatttagggtgaaaggcagttcttgagtgctcacaaggaggcagagttctccagcgtggttttttgttgtgtttcagacctggctggaaatgagtacgacctgactggcctaagcacagtcaggaaaccttggacggctgttgacacctctgtcgatgggagaaagaggactttctatttgagcgtttgcaatcctctcccttacattcctggatgccagggtgagttctccttggtctcttgattggcgtctgttcattttattagagcatttgactcaaggtcatcgccttcctcatgcccaaaccacttattctgttcttccaggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcggtgtgtgttcagaccagcaatgagatgttgtccccgggtgactccatttcccatttcccttgaacctctgaatcttctatcttgtttaaaacttgcctgtgttttcgtggagtttcagccattgctagggtttgacgagaatgcactcatttcttcaggtcttaaatgtttaataaatgttacgtagtttgcacatggaggtcaaagattgggtactaactgtggctatcatttatttaatttttttttttttttttttttttgagatggagtcttactctgtcacccaggctggagtgcagtggtgcaatcttggctcactgcaacctccgccccccaggttcaagtgattctcctgcctcagcctcccgagtagctgggattacaggcacctgccaccacgcccagctaacttttgtatttttagtagagacggggtttcaccatcttggccaggctgatcttgaactcctgaacttgtgatccacccgtctcggcctcccaaagtgctgagattacaggtgtgagccaccgtgcccggccccatttgattaatttttaaaataaacaggaaacaaatcaggctgctgatttatattacagggctcaccagcatttcagcttcaggatggttgtgagtacgtgtttatctggagaactgtggaagcctgtcccgttgtcagagtggaaggtaggactgggcctgtccctacaagtcattttaaatgtatagagtagcagacgttctgaacgatgccttagatatgagaccgtgtgataacagccatagctggggtcatgagacacacgctagggggaggataatttcttttccttgagcttttttttttactgaagcatattgctaatttcacgagtgacattttccttgtgtgcctggattgatgggattttggcgtctgatgcttgaagacactaatgtggggtttggttttgtgttgtttgatgaagcaagtctttattcggggacctagactttcctagaaagctgtttgccaggcgatttgtattatatataaacaaaatcatgtggaaatggcttttaatgcccatttatagctggtatttacctaaccaaaaattgtaaaagtttttttttttttttttgagaccgagttttgctctgttgccaggctggagtgtaatggcgccatctcggctcactgcaacctctgcctcttgggttcaagtgattctcctgcctcagcctcctgagtagctgggactacagggtgcctgccaccatgcccagctaatttttgtatttttagtagagacggggtttcaccatgttggccaggatggtctagatctcttgacctagtaatccacccgcctcrgcctcccaaagtgctgggattacaggcrtgagccactgcgcccggccatttgtaaagctttttgcttgaaaatgtgaatgcgtgtgtggttgcagttgcccttcacttcttccatgttcttgaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtaccattgtttgtcgttttccttttgttgcaaaggaatggaattaaaatattaaaatattttgctgaagatgaattttcccttgagtcagaaacatgagtgttctactgtaaaaaaaaaaaaaagcatattaatgatatttcggattttgcttgattttcttaaacagagtacatactgaaggatgttggtagagcatgtctattttattcttagttagccatgccagttactgactctaaggtcatatttctcttctttattacaacgttgggacacagtgagctagccagtgttggatgttctggggtagtacttgatagcattgagtcacagggaatgcatttagtacgaggtttggctgtagaaattacagggcacgctgttggtcattcatgctgtttcagcagttgggcaagatttaaatacatttaggaacttgtaaaaatgaagtcaaagtagctggtggtgagtacgtggacagccctcaggcacagtggagaaagtgacattcccttaggtgatgaggctaaggaatgcctcatgtcatcatacacgggtcagtctgtgacgttgcagcagccttggacaaggggaagcctgattttattcccaaagtgtaatgtgacaggagtgcatggtatggtgctgggaggccagggatactttgtctcacactcttcagggtgtgtggtgtcacatgtcttaggctaagtttgacagcctagggacccgaaccaaaccttgtttaatgttctccttctttacaggtctcctgactcagaagctaacttatgaaaatggcttgttaaaaatgaacttcacggggggggacacttgccataaggtttatcagcgctccacagccatcttcttctactgtgaccgcggcacccagcgggtgagcatgtaccgacggccctcagcggggtcttctccccaccctcaggctgctgggatcatattagaaagaatctgtcctcagatctcatcaaatctcctggttaactgagtttaaaataaccatttacagaaaatatgttgaaactttcatcagttagtattgattttcatgaacgtaaccattctttactattttcattcttaaaactcaaagtataaactaaagttttgcattctcacttttatatatgtgcctcttaacttttttagccagtatttctaaaggagacttcagattgttcctacttgtttgagtggcgaacgcagtatgcctgcccacctttcgatctgactgaatgttcattcaagtaagtccatggatgtgttgtctcttttggacagactaacttggtatgattttgctttaataattagtggtcttgggtgcaggggattagattagtcagttaatttacctaggactcggtttgctcatattaaaatgaggagtcgggctaggttaactctcagctccgtcaccacctggagctgctgtggtgactgcatggggaagggattggagctgaagcagagagtggacccctggcactcttgcgtgatccacatgtcagtgagcagagtgggccaggagcggtgtggtgacccctgcgatgaagggaggtcttcgttgcatgtgatcgtccacagagctgctctcaacagctttgccagatcgccctctggacacctggggtcccatccttagagattttggttttgtgggtctgcggttctgttttttggagggatgccctgtgttctgccgtgtgaaacacccagtatgagccacttgatcactgttgactttcctgggggaaagtgcaggtgattctgtttccttccggcctttgtcctgttgtgtcatcggttatttatgtaggtgaaatcatcatttaagttttaggaacgtatgtaaatgcaagcatttagtaatttatgttcagtgactttaaatcataattttagtaaccttaccttttccagttaacattttgtaaatattttcatgtgaaacaaatttgtttctcatttctactggatgggaaatgtcctcagtagatatccccagttcacttagcagttctctttctgccatgtgaggctgccttcagttttctgatatttatatacaaggaataaaattttgattttctttgcacataaagcatttttcctagagatatgtgtatgtgtgtgtgtgtgtgtgtgtgtgtgtgtgtgtrtrtrtatatrtrtatatatatatatatatgtattttttttgagatggaatctcgctctgtcacccaggctgaagtgcagtggygtgatcttgtctcactgcaacctcctcctccctggttcaagcaattctcctgtctcagcatccctagtagctgggattacagacaccaccatgcctggctaatttttgtggtgtttttttttttttttttaatgagacagagtcttgcactgtcgcccaggctggagtgcagtggcgtgatctcgactcactgcaacctccgcctcccgggttcaagtgactctcctgcctcagcctcccgagtagctgggattacaggcgcccgccaccacacctggcgaatttttttgtatttttagtagagatggggttccactatgttggccaggctggtctcgaactcttgacctcgtgattcgcccgccttggcctcccaaagtgctgggattacaagtgtgagccactgagccagcctattttttgtatttttagtagagacagggtttcaccatgttggccaggctggtcttgaactgctgactgcaggtcatcctccgtctgccttggcctcccaaagtgctgggattataggtgtgagccactgcgcccggccttcctaaagatatttttatgctaagtttttaaaagtagaattaaatcagaggagaattttataatctcataataaaagttaatatatgtctattgtaattgagagtccaaaaatattaatagatgaaattacccaccctcacctctccctccccaacccctagcttcactccactttttactgtttcttcttgtggttctttttggaaccttctataactctaaacctctgtttgtcagcttctaatggtgtctgttgactctcttttaaaagatgaaagctgtcctcacctgtgctgttctcctctcctctttcctctgccttggctttgttagttctatttctgtttcttctgttgactacttttagagcatttggtgatattcactaagctctgttcttgtcccatcaccttcaggcagctttcccttcctgccacctgcccctggtttgggcactcctcctctcgtgcgtgcagtactgcagctgccactccgaggtctccttgccatgtcccttgtcacacgtttggttagtcccacacagtaattagaatgatcctcttgagatataagtcccaccatgtcgctcttgctgaaaccttcaatgcagtgagcgcccatctcattgggacctacaggctgaagttcttcctctgatggacatgacccccgtgttgtctctaataacctcactttcactctgttccagccacacggggtttctgtctttctcgggtcatgtcgggcttatgtgcctcgggccctttgctcatgctgttctctgcctgggatgcgctttactgggtgccaggatggtcagtgattccatttctctcagagtctattcacaggtccccttctcggtcacgccttctctggctccactgtctaaaatttcaacagctgcctctgccccccgaacttcatatcccccttatctgccttttttccttcagctcttacttccatcaaatacagtatgtatttttaaaagtcttatcttgttcacggtcattttcttccacaggtaattttggtaaactttgtaagattgatgatgtttaatactgttttgtttaatacagtacccccagtttagcacacagcttttgaatgaatgaccagtttttattcccctctgaagcgctaagagctgccgctgaggtggcatctgtagctgctcccgttcctgctccgtggtggcagagtgtgtgtctcactcactgttaatattgctcctggcatggggttggttcccagttactgtctgtatttgggatttgtgtagttagtgaacctttagcctgtgcagaaaggtcagcaagcccattttaatttcagaatttcagtaactgctggcggccttggttttaaacaacaggtggcgtgcggctgccccgggcatggcccctgctgtgtgtgctcctagcatcttggctgcttacctttgtcaccagcaagttccacttctcagtggcctgagcacagacggcacgcactttgcagacttgagtttttctgttaaaatttaaatttttttttaagtgagcctaatagtttcctgaactattatgttcagggaagttatgttgttgctgattctgatggggkgtgtgtgtgtgtgtgtgtgtgtgtgtgtgtgtgtgtgacagasacagagagaagtcgagtctaaagttctgtcaggcttagactatgcctgaatacttgaacgtttctagacagagtgcccaatgtttaaagagaatacgaccaagcctaactaactgcgggttttcttcttttcagagatggggctggcaactccttcgacctctcgtccctgtcaaggtacagtgacaactgggaagccatcactgggacgggggacccggagcactacctcatcaatgtctgcaagtctctggccccgcaggctggcactggtgagagagggcctcctcgtggggtggtgtttgcagtgagtgtatcacaggccagcactggtgagagggggcctcctcgtggggtggtggttgtagtgagtgtatcacaggctggcactggtgagagagggcctcctcgtggggtggtgtttgctgtgagtgtatcacaggccagcactggtgagagaggtcctcctcgtggggtggtggttgtagtgagtgtatcgaaggctggcactggtgagagaggacctcctcatggggtggtggttgcaatgaatgtattgaaagctggcactggtgagagagggcctcctcgtgggatgstgtttgcagtgagtgtattgaaggctggcactggtgagagagggcctcttcatggggtggtggcttgtcatgagtttatcagggaagatcaagtaggatggggattctttggaggcgctttactctctgcagcatggacgtggttcggccgagaaacagcaggacgaagaatgatttaagggtgttaacagttgatccctagtatggcccagggtaaatcagtgctgaggactgctgggaacatgataaccctttctgaacatgaggagatgaagatataatagatagaaataatagccatggtgaggaatccttcttagcaggtagaagatggggggtgtgacgtggagrtcttggtgtgtgcctgcgtatgttgagagttgtatggtcggtccttttgtgatgcagggacagctcactcaaacctgcrgtggttggctgagactggatgtcagctgtacatgggaaaccaagggcacctccagggatcttggtaccactcatggcccctcggaaccctgaagatgaaactcatcccatgttcgtggagtttcatacagccccacctgyatcttgggtggctcacctcaaaggcggtgtggttatttttagctgcagaaggtggttccatcctctgtgtggtttgaggctgtggttccacttccccttgctgcgttgtgctgtgcagacttcgacagtggctgtacccctgtggcatgggactagttcttcacccagggcacatggcacaggcattttagggactgggaaacaggcagaattcttggtagcttcttgaataaagaaggtgcatggacgtaggccatttaaaatgttcctctgtcttaatttgggaatataaccttcatcctatatggggttcagaaagaatttcgactgctacagcctagctattcctctacactcacgcccgcctgccccagtccatctgtgacaaaacagcatgtaagtgagtgagaactaacgtgatgtcattgtcatctgacttatgtgaaagaaatagcaggtattttgaagtgactcttagaaagcgtatgaagttctgcagcgtgtgtgacatttattgcctgatgaagttctgttctagcctggggagtcactaaaggcaactctttcttgtgtctggtgctgcagagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtggtaagggactgttcctgcaccttctgctgttgcagctttgggaattgagcccatgtgcagggcggtgagccgcacgtcctcatctgccttgggatgcgagttctagagcctgggatgatgcgcccttaccagaggttgggggaacagcgtcgccgcggcctgcaatctggggaaccctcgtgctgtctggctccttagaagcttgcctggcagttcccgactcagaattggttctcttcagagtttgactcagacccctaaaggctgtggaggagattgttgtttgactacatgcccttttgtcttcacggcggcagcttgggaagcacgagaaggttggctgggcccgggtcacaggtagcgctgccacttcccagccacataacttggttaattactcaggtagtctgccctgctcagccgttcataacatgaggcatacttgtcctgcccattgcagggtttcgagagaagaggtaggaagtgccaggtgtcatttctgacacacgggagatgcacagtcagtgagcatgagtgcctgtgatcagttcttcccttacttgtttggcatgcacgtaagcaggtgtcgactgcatacaggtttttctgtgtgtgagattgtggtgagccccagtgctagcgtgcatgacragctcggtggctgagttgggcattaactcgggcaagaccagctcgctgggtgtcagggtggctcgccccatgctctccagcggtgggcagcagtggtaggggagcttgggatggggggctccaggagcttcaggcctgccctcttgcctggagcggcagggaagtttcctcttgggaagattgtgcagaggcttagtccagactcatgagctgctggggcctctgagcattctcctctgtgacctgagaggctcatggccgaggacaaaagggctgccccacatgtggggggcaaaggtgagagggtgtgtggggcccctgtgcccagggcccagaaggctgggagggaagggtgaaggggtgtgtggggttccccatgtccagagcccaggaggctgggagggaaggatgagggtggtgtgtgggggcctctgtgcccmrgacccaggaggctgggagggaaaggtgaagggtgtgtggaggccctgtgccccagacccaggaggctgggagggaagggtgggggtgtgtcgaggcccctgtgcccagggcccaggaggctgggagggaagggtgggggtgtgtcgaggcccctgtgcccagggcctgggaggctggactgcagcgtggcttatcagggtgcccagcaggaatcatggggtttacctgggaaggaaggtgctgctgaactcatcatgctaactctgcagtggacatgaagcgttttgagatgagcagagtaagccttggctggtgccagtgggaggatgcgtggaatgggctagttctcttggtatatctttttgttttgactgtgataatggattttacctcatttggtttttagaattttatcaatgatttacacattygtgtctccctgtagcccttccagcatcctttgcacgcctgtccccaacccctgtcctgttcctcagcctgagggagcttcctggtcccctaagtgtgttgctgcctgtgggtgtttcacttacctgcaggggaagcccatggtggcagctcaggacacattctgaccctttgcttttcctaatctgcgcctcatcccacaggcacatggagacagaaatgtcacatgctgtggagtttttcagagaagcttccacttgtaagttgaaatcatgatagacatggagtttttgcgtgatcccttcaggacctgtctgtgctttgttgtagaactccaggcccatgttcatcagcgccgtggaggactgtgagtacacctttgcctggcccacagccacagcctgtcccatgaagagcaacgagcatgatgactgccaggtcaccaacccaagcacaggtgagaggtggtgccagtcgttaaccccagcgcaggtgagagacggtgyccccaccaaacccagctcatcaggggagagacccaaagagaagctatgggcagcaggcgccctgggcagaggtgtcatggtgtgtgggtgtgtttggcctttctctggatgggctgctgtgtgttctcctggctctccttcagtggaggagagaatgctcccacagagaatccatccctcctgtcactctcctggtgtgagaggtgctcctgactggggttactgacagtgtcagtccagcagctctaggctctccagggcaggttagagctagcccctggctgcctttcagcatcagtgtagtggattgccaggagtctctcacctgcccttgtgctgggcacccagaaaggcacaggcacagtccattggcagcaagaggtgtgctgggcaggctctccccatgcccaccagactcttagtggctgctgtggtatggcccagcagagggtgctgtgagccacgatcttttcagctaaggatgggacatctcatggatcaagggactgacagtctcatgatacagcctggctgttggtggaggatttaggacaggggtcgtggtgagaagtcagaagtcccgatgctgacataatctgtgtgtgagctcgccgatgatgagcctcccaagtctcagctccctggagtcactgtgtccccatcttcttccaccctacaggacacctgtttgatctgagctccttaagtggcagggcgggattcacagctgcttacagcgagaaggggttggtttacatgagcatctgtggggagaatgaaaactgccctcctggcgtgggtgagtgctgtggtctctcgtgtgttgtctgactctcccgtcctctggggttgtcctcagtctctttgcatgctaatggcaaaaaggatgagcagagccaggaagctgagacgcttttgtctcctgcagcagtcaccccatgtgggggacacatggtcatgtgatggaatgaacattcaatgtaaaacaatggttaaagccggattggacacttgaagttataagtgttggctatgaaattgatggtcctgacttgcgaaagttctcatcagaaaattggccatcgagtctgtgattgtgttttctccgcctttcccttgtggtgcaggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccrggccaaccaataggcccatgctcatctccctggacaagcagacatgcactctcttcttctcctggcacacgccgctggcctgcgagcaagcggtgagttttcagatgggcaygggagaagtgcatgtccagtgcctggctgcacccgggccccttcgtcaggttcacttgcccactagtagatgcccagctgaactgtccactcctgatcaccccaataataaagttgactggaagtgcccagtgctatgtaatgaagcattttgacacctttctactttttttgttgttgttattcagcttttaaattcttatggatgacctagtggtgattaggaaaatttttttgtagactcaaagcagtctttcctacttaacagaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacgsagtgccctgtcctgccggagccgctgtgtgcaaagttcctattgatggtccccccatagtaagtatgacaaatccaagggtggagataatttttgcaagacttttagtgataacctttgcgttgtttcttgccttcagtggggagttgctcaagcataaaaaaaatggagaaagtaagtgggactgtgtatgttctgggtccgctactggaagattaaaggtttgcacattgaactgttcgctgatgatggtagccagccagtctttgagcatgggaggtaacacgaatatgtgtgtagggactctacttgtcatgagcctcagggttgacccaaatcaagaagtttttaggtgaagtgacaggaaagcacattgccctagcctggtttctttgtgtgaaatgccttgtcttctgtagttaaaacgcttgcgaaatgcaaacagtttctttggcaaggagttataattaagggcaagagtacgtttgctaatagctaaatattttgccttaaaagctttggttttatgcattaaaaaattattttgtagagatgggagtattgctatgtcacccagccaggctggcctcaggctcctggccttaagtgatcctcctgaagttctgggattacaggcatgagccacagtgcctggcttactagcatgttttaatagaaatttggatctttaaaaattgtctccatgagttatattcatattttgtcaaatccttggtatgttttaatatttgaatgtatctcacaagtcgtctgtatttctgtctgtatcatctattatgctttaaagatggatcctcttgtaacatatctagatgtcctttagaaagatggccattatatgtggcagtgatatggggagatgtcaggagtgtgtaaggagatcggccacagcctgaattagcacagctccagctctgtgtgagatggaggcctggacaagctgagtctccccaggaagctctttggtagcgtcctttctgacagcgcagaccggggatcctcgatcgggaatcattgcctggccacccattgtcaaatgttaaaagatgtagaaagttatttaactggagaaggtgtggtgccacrtggtctgaacgtgccccacagtggtgaatgaagagcactgtagctgagaacaaaatcatggggaagctgcttatacacacactcacacccacatgcacacacacgtgcatgcacacacacattcatcacatacacagttcctggccattcacctttatttactttttaaaaataaaaaaagagttttktgttttttttctcataatactcagactggtcttttatttatttgtttattcactcaaaaatatctcttgggcagccgctgtgtgccaggtgctgtgctaagcaatgaaaatgaacagtgaacacctcctgtcccctctcccaaggacatagccagtggttactgctgggccacgtcagtgggcagtcccggggcagcactgggcagtgagggtggcaggtcagcatggaggttccggccttcccctgtcaggtggtgggaggaccgtgtagcatccttagaggtttttcaggttccgggcttccctcatcagctgatgggaggactctgtagtctccttgatgtgactggagagattcctattgcttaggatctttgaaaattgaagatacctagaaatagaaccaaccttagaactaacgttaggatcaaaacgataaccactgacatacggaggttacacagcatctgtcaagccttccaactggagttggtataaacccagtttctttagatgctgctcattctcagaacctatgaggtctggtttttgcaattctgtatcaattcttaaytccactaaccttgggaatggttaatttcctgaaatactgtttgccctcgctctttgtttaggatatcggccgggtagcaggaccaccaatactcaatccaatagcaaatgagatttacttgaattttgaaagcagtactccttgcttagcggacaagcatttcaactacacctcgctcatcgcgtttcactgtaagagaggtgtgagcatggtaagtgtgggcctgtgacgatctagatgctcaactgcgggttagtgagccaaggctagacaaccagaaagtgcgtgtcaggtccaaggatactcttattcaaaatgtctgccttgggtaagatggtacgctagtagtgtgtctgaataatttaaaccactgattgagggctgagtgagctcccccgcagttaacagcatatagaaacttgctgtaatttaaaaacatagaacacaagtatagaaatgacattcagctttgactgctgatgcataaaagtgtcataacttttgtttttactttaacaattactgattttattctaactgggaagtcagaaagacatttgggcagctatagtcactcaggacatagcccagaagttaacaagtaacaaaagacccctggaatcagaatagctacaacaaagtggcaccttttacttataatgaggtattgacttccattttatgtgcattaaaaaaagaataccagcttccattataatgagttcggtattggttatagtctttgaggacgttttcttttgatccctgctctgtgagataaattggtagattatggcccctattccacagggactcagagtagctctgcaggggcagagccaggtcccagctactgcacaggggaacagctctttgctccagggacacagcaccacagcctgtcgtctgtgcttctgaaatctctgaagctctgaaaacttggggctcctttgacatgaatggactgaggctatttatggtgtggatttgtcccacctaatgtggatattgatacatctagctgcagaaatattaatatgtttgatcacaggatctgggggtgtgagaattgyctcttaaaatcctaataaagatgttggattccaaggctcatctgacccctaggagttcaggtgatggattaggatctgttgggtgtcttgtaattctgataaagacatccttctgatgtttgggcctggagcaggtttgtaaagggactgttagacatrggtgtgctgacagtgacagaaagtgacctggcagccgcctgaccagtgagagagacagtatttgagaaggaggaggaaacagtcctgctgtttggggctactccacaggggcccagagcacctcaaagcccttggatgtgttcatgaatcttagagtgtagtgacagtcctagttagtaaggaaaggcagagctgtattcagtccayccattgcatctgtttataagcgtattggcatatttttataggggtgtctgggtgtgcctctgtagatgcacacagcatggggcaacgtggattttgccttgcggggggcttctgcattaagttcttcgttctttaaaggacagtcttcacttctaagacccacctcatcatgagtgatgctttgttatctacaccaccagctaaagagtgtggaactatgccttgctttgactctgctgccaacgtgacaaatcgaattagctaatgtgattttagttaattctcagcagctgcacattgagggtgattagtgtttacttgattttagaaatgaagcatcttatgctgaatgtgtgttctagcgttccagaaagatttttagaagatttttcttccccagcagttttcattttcaatggaagtacttttaccactgaatcatagggaaaaagatgcttaacattaattacaaatggaattcctgagagctgcctcatctttttttgttgctgttgaatgagggagggaataaataaagtgattctacaatacttggcctatggaatatctggccatgtggcatcttgccccttgaataaatgtctcccgtgtctagagacagtagattggagcacttgtgaggcagggtctcagtttcacagacctctctcatgacatataagccctccccctttcttcctttgaacccgtagcacagaacattgaggctttctctctaagtagaagacaagacctggattcagccagggagctcacaggatgtgtagggggcaagggcagggtgatgtctgtgccttgaagatggcattgggtctttcagctgctgttgtctagcatcccttccctctgagaggccgctgtgggttatgcacagcccctgtagggacgtggtgtgtcactgctatctatccctatgccatggggtttttaagacccgtgctcttcctggcaacagggaacgcctaagctgttaaggaccagcgagtgcgactttgtgttcgaatgggagactcctgtcgtctgtcctgatgaagtgaggatggatggctgtaccctgacagatgagcagctcctctacagcttcaacttgtccagcctttccacgagcacctttaaggtaatgcgttcaccctgggcgttgctggtgcaggtgtaccaggtgccaggtgctgtgaggctgctgggagtgttttggataatgtggtacctgtgagctgagagggtgtatgtggccactgggcagcatcttggtgctctcgtagggcatgccaggtctcaggaaggttcytggattgcgtggccaactcagcgcagctgacacttgcgttgtacctcatggctctgcacttaacgctttttgatgataagtaacctcatgaggcgggtagtgggaccctttgtatcagacagagggcaggtggggcagcccggagacatgaatgtaaggtatccatggggrcagggccagctcctgggtggctgaaatctacagggatttaattcctccaacctggttgaagatgatcaaggcagttgtttgctgattgtggcagctttgggaagagggaggtaggaggtgccctggaattgagaggcacttgggcatgtgcctccatgccatgccagagccctggcgtgtgctgattctttgggctgctggtcttactgatgtggtgtcgtggtcactggtgcctgggggcccctgactccctaagcctagatatctagatgttaccatgccagtgcctggactggggtacggaaccccagcacctgctgtggcacggcggctggtgagtgatgagcctggagttttgggcccaggtgtcaacaccctggctcctgtgatggagccctctgcctgggtacaggtcctcccgacaggtgtgcagtaggtgtgagccttctgggcgctgggtgggccaggagagtcaggtccatgcttcagcgtgcagcgtcggctctgctcattcactcacttggcccgcacaatgtcttattacacaggtgagggaggtggggtgaccccactgctgggtcccttctcactgggctctgactggagacgacagccagagcagtggctggctggcaggggtggccgaggcccccagcagggagcaggaggagcaagcaagctgggcctaggggttgggggaggccccccagggaaagcctagggccaaggcgattgcgtggctctgatgcacacagaggagtctttgctcttcctcatgaacctgcctccagcatcagctgcaatagtggttctctcttcactttgagacctgggtgctgccactctgctgacggccacgcatggtttttgtccaggtgactcgcgactcgcgcacctacagcgttggggtgtgcacctttgcagtcgggccagaacaaggaggctgtaaggacggaggagtctgtctgctctcaggcaccaagggggcatcctttggacggctgcaatcaatgaaactggattacaggcaccaggatgaagcggtcgttttaagttacgtgaatggtgatcgttgccctccaggtaaatatttgcaatgaggtaaataaacttcaagctcatagtaaactagaaattagacatagcagcagaaagaagctgcggagtggagctccacggtcctatgagtgctgtaaccttgggcgtgaatgtgagctgttcctctgtacacccccggtgtgaatgctggtgtgtgaatcacgctgtgttctctcagttgcctggtgagttttggcaggtgaatgccggttgtcacgtaggtgctttaggatgggcagcttccttagggactgctgctgcattctgaggtgattgtgcctggcgaggcacagctgccacactgataatgttcttcttctttccagaaaccgatgacggcgtcccctgtgtcttccccttcatattcaatgggaagagctacgaggagtgcatcatagagagcagggcgaagctgtggtgtagcacaactgcggactacgacagagaccacgagtggggcttctgcagacactgtgagtaggacggctccgcgtccccacatggcctggggccttgatactgtcaaggctcgattcacactgagacctttgtggatgccccagtcagtggcaggaattctcttgcataaaatattttcttactcgggctgtttcccacagagaaacgtttgaattgctctgtgggattgctgggtaaccgtatctacagaccgtggtagagctgccgtgagatgctgtgctgggtggctggctaggcccactcactagctggagggccttgtgtccacataccaggttttagccctggtggttcagattatgcctcaggaaaatgaatgtctgctatgggtcttcaggattctgaagctagtgaggattccggtaaaccaggcgactcatttattgactttcygccatgtggcagcccaggtggggatggaggtttcttggtgagccacactcagtgccttgcccctgcggtgctcaggaagtttcatgagaggagccaactgctgtgacttgtgtctacggaccgtgagatgagggaaatgcatgaaaaattactaatttttggccaggcgcggtggctcacgcctgtaatcccagcactttgggaggctgaggcgggtggatcacgaggtcaggagattgagaccatcctggctagcatggtgaaaccccgtctctactaaaaatacaaaaaaaaaaaaaaattagctgggcgtggtggcgggcgcctgtagtcccagctactggggaggctgaggcaggaggatggtgtgtacccgggaggcggagcttgcagtgagccgagatcatgccacttcactccagcctgggtgacagagtgagactyggtctcaaaaaaaaaaaaaagaaaaattactaattttcataaatgtccagtatcgggggaaccagcccccgatttttcaacgtaggttcttttctatttccctaagtgttggccggtctgagaaataaggggaaagagtacaaaagagagaaattttaaagctggtgtccgggggagacattacatgttggcaggttctgtgatgcccccgagccgcaaaaccagcaagtttttattagcaattttcaaaggggagggagtgtacgaatagggtgtgggtcatggagatcacatgcttcaaggatgacaagaggtcacaaggcagaaggtcagggcaggatcacaaggtcagcgcgaaactagaatcactaaataacttccatgtcccactgtgcacacattgtgagggttcaagagcagagaaccggtttaactagaattcgccaggctggaatttccaaatcctagcaagcctgggggcgctgcaggaggccagggcgtgtttcatcccttatctgcaactgcataaggcagacacccctagagtggccatttaagaggcgcccctgccttccycccgggaatgcattcttttcccagggctgttaattattaaaattccttactggggaaagaattcagcgatatttctcttacccgttttcggtaataagagaaatatggctctgtcctcaccggcccacagtcagccagactttaaggttatctcacttgttccttgaaaatcactgttatcctgttcttaaggtgcccagatttcatattgttcaaacacacatgctttacgaacaatttgtgcagttaatgcaatcatcacagggtcctgaggcgacatacatcctcagcttacgaagatgatgggattaagagattaaagtaaagacaggcataggaaattataatattgattggggaagtgataaatgtccatgaaatcttcacaatgtatattcttctgtcacggcttcagcaggtccctccgttcatggtccctgacttcccgcaatagtccagggaccaaaatgggatgtattaaggaaccaaacgtgttaaatttacgaaggattgctatagctttgttttgaggcttattttgacaaaacgttattccctattttctgaatcacactcctgttttcaagtacttgtaggtattacattattatcttaaattttttttttttttgagatggagttttgctcttgttgcccaggctagagtgcagtggtgcagtcttggctcactgcaagctccaccttctggtttcaagtgatactcctgcctcagcctcccaagtagctgggattacaggggcccgccacctcacccagctaatttttttgtatttttggtagagatgggatttcaccatgttggtcaggctggtctccaactgctgacctcatgatccgcccacctcggcctcccagagtgctgggattacaggcgtgagccaccgcgcccagctatcttattttttttcgtgatcattagtagattggtcaaatattgaatacccgtgtgaggaatcacctagggctgtggggttattaagaagtacgatgaaaggctgtgtgccaaggagctgggtctatttggagtcaggatacacatgagtgaatcaacatgagatgtggccagggcagcacgtggtgtgttgccagatggcggatggagtctgcaggtgctcctgaggcagcatggggaaggcgtgcaggaacgtgccctggtgcaggccttggtctgacattctcccgcctctgctcccctgaaggggtggcctgcccctccacacttgtgggtatttctagtcgggtgggatgagagactgagaaaagaaataagacacagagacaaagtatagagaaacaacagtgggcccaggggaccggcactcagcacaccaaggacctgcaccggcatcggcctctgagttccctcagtttttattgattattattttcattattttagcaaaaaaggaatgtagtaggagagcagggtgatgataaggagaaggtcaacaaaaaacatgtgagcaaaagaatctatatcataattaagtttaagggatggtactatgcctggacatgcacataggccaaatttatgtttctccccacccaaacatctcagcggagtaaagaataacaaggcagcattactgcaaacgtgtctcgcctcccgccacagggcagcttttctcctatctcagagttgaacaaatgtacaatcgggttttataccgagacattcagttcccaggggcaagcaggagaaagtggccttcctccatctcacctgcaagaggctttcctcttttactaatccacctcagcacagaccctttacgggtgtcaggctgggggacagtcaggtctttctcatcccacgaggccatatttcagactatcacatggggagaaaccttggacaataccsagctttccagggcagaggtccctgcggccttccgcagtgcattgtgcccctggtttattgagactagagaatggcaatgacttttaccgagtatactgcttataaacattttgttaacaaggcacgtccttcacagccctagatcccttaaaccttaattttatacaacacatatttttgtgagctccaagttgggtcaaagtggctggggcagagtggctggggcaaagctacaaattaacaacatctcagcaaagcaattgtttaaagtacagggctttttcaaaatggagtctcttatgtcttccctttctgcatagacacagtgacagtctgatctctctctcttttccctacactccccagcaaacagctaccggacatccagcatcatatttaagtgtgatgaagatgaggacattgggaggccacaagtcttcagtgaagtgcgtgggtgtgatgtgacatttgagtggaaaacaaaagttgtctgccctccaaagaagttggagtgcaaattcgtccagaaacacaaaacctacgacctgcggctgctctcctctctcaccgggtcctggtccctsgtccacaacggagtctcgtgagtgccttcccagtccacccgcggcgccacaccctcagcatgtgaacttcagactgcttgacgatggttggctcttttgggttctcaagatgsgaatactatgcccatgtgaggctgatggtggttgagttgtgactgttcctggaagcagcccgcagtgtcaatcctggcacagagggtggttctgaggtcagagtgggggcaggagctttggtgactggaaacggagcctctggagctggaagaacctgggcggactgagttaggctgggtttgatttgcgtttgtgtgtagctcaggttgtgggaggcrtgtgggttttctcgggtctttggcaggagctccttaggctttgctggctggggtcagcccatggtcctgaccactctgcgtggggagcgcccgcttggccaggtgctcctgcaagacatcaccgaggagcaggggcatggactcacagggtttaagtggttctaagtgaggtgggaaacttgccgagattctagccactgcctctcccagccccggagcccttctttctactgtaccacgctgtgtccagggtggccgcaggtgtggacattccactccgcgtgtgtctggttggtgagctcccttcttcagtgaagacttcttttgccctttttttttttaattggaaaagctattttagtgctacattcagtgatggaatggagcccttagttatcagaacctttctctgaaagtaaagtgaagagccctcctgtgtcagggcagagacgtcacttgcatgccttttacctgcccctttgtgtcgttttctaggtactatataaatctgtgccagaaaatatataaagggcccctgggctgctctgaaagggccagcatttgcagaaggaccacaactggtgacgtccaggtcctgggactcgttcacacgcagaagctgggtgtcataggtaaggcctgtgggtcctggtccttggttcaaggagcagcatctgaaccgggaaggtgagggtgttctcaggatggcaaggagagtgagcatgtgctttggtggaaacctccagatatgattgcctgtcactgtctcacaggcattttggctctcctggcacattaaaataagtgctgctttgtattatatgagactgcaggtcctagtctgtgtgtttagaggggttgggctatctcggggaagtgcgtctatccaggaggaagtctcagaatgttcagagttcctctgaagttcacrttctagctgtagatcaagtgcctaaattggcataaacacacgtgtttgyttaggaaagccaaacagttgcatgaggacttggtacaggtagttcagaggtacatctttgtaaaatgtcttaacaatttttcacgggaaattgatcttgtacttggttgctgagtgaaagttgttttctttcattatttaaaggaggaaaatagaggtttcttagtaagagcaattaggatttgttggagggaccagtaaaggaaaatattcacctttgcctcttaggctggagtggggtttcccgagttgtcctgattcagccacagggctacttcagattagcttgagatgttgagatggagaaagagaattccgagaaaactactgccacccttgataaaaatcacacacagactctgcaggttggtaggtggagggagagctgccatacaggaagtggcgcccagaccgccagcctgagacccgccctccctgggaggttcttactgctttagaggtcagttattgctgccactcccacactgccccagaagggggaaggagggaaggtcgtggagggttgctttttcccctgtaatcttgcagtatatatggatattcgactagtctttccccaacttcagccaactgaaatgactaaaacacttaaggcttcctaaaagtttgaggcaggaggagcaaaagagagtagtgaacacagggggtgacatggaactagatcatctgacttcttagcggtgacctgcaggccacctccatttggagagcaccattttgcaagtccagcctcgcctggcgggaagagctcatgctttctcctgggrctggcatttggcatcctgagcacctgctgaccggaacgagaaataatctggtgtctgacaccaaatgagctcttaatctttggcgccaacaagacagcatctaaggacaaccacggtgcccccattgtccgcttagggaatggacccctgttggggtgggaggtagactttttgttttcrgaaccaacatgtctcaagcagctgtgcttaatatatgtttaatccccatccactccatggggcagcgttgtcatccgtttcacaggctgggcccctgagccgaggaggttgagcctcctgcccaatcagtaagggctgtctacactattaaagttttttcttgtttgatcccatatgccagaagttttaaaaattttccgtaaaacagtggaattcttttttccaaaattttacacagaagcccaatatttaaaacaaattcagctggagcagctttgagtttggggcaggcctgagagcctagagtcccacctcccacctcaccatccagcagccctcagtacctcagcctgtgtcctgtggaaaacactcgggaagtgagcactgtgcccatgttgcctccaccgcatgcccctgcctggaaggatctgtgtgtgtgtggtcagggtggaaggcacctgcttcccctggacaccctgcgccatgccctggagacatcatctgtccatgcagccaggctgggcccagaccgttcccagaacagccccctgcgcagccacaagcagcctcttggtggtggcttgagagttggaacctggcggccatgctgccccagtgatacctgcagcttaaagcatgtactcacttttctctcagaccctgcgggttcgagggctcaggtttttcttttaaygggtcacttttaaaagcagacagtgctcgactgaaagctagaagaccctagaaaaccacagttggtttctgtttctggcttttcactttttccattctgtgctctgttattactgggaggctcacatgagggtacctgtcaggaaagcacctaatatgatagagagagtttacacaattggagcgataatgaaggctgccattacccggggtcccactgttcacatgagtttgttgggcactttctatacatgcccgaaacctgcccactttggacagtgccctgttctgcaggtaaggccctcaaggctcagaagctcagcaacccagggccacaaagtacgggagtaggagggtttgggtttgaccccaggtcttaggctgtgacaattgtgcagtgggccaggtgaccacccctgagtgtgggaatgcaagaacaggtcgataaacctttagggagcccaaaatttattttcttctggcctttaaaccagatttttactcctaacattgaagctttgtttgtttgttttttgtttttgtttttgagatggagttttgctcttgttgcccaggctggagtgcaatggcgccatctcgatcttggctcactgcaacttctgcctcccgggttcaagcaattctcctgcctcagcctcctgagtagctgggattacaggcacctgccaccgtgcccgaataatttttgtatttttagtagagacggggtttcaccatgttggtcaggctggtctctaactcctgacctcaagtgatctgccctctttggtttcccaaagtgttggaattgacaggtgtgagccactgcgcctgcctgaggctttttataatgcactagaaataatgtcagttcaatcatttgtgtgtttcaggtgacaaagttgttgtcacgtactccaaaggttatccgtgtggtggaaataagaccgcatcctccgtgatagaattgacctgtacaaagacggtgggcagacctgcattcaagaggtcaggagactgggggctcagagcgggactgtgcagtgagcatactggagggaattcctccttggggttttcatgggcaggttttggctgagtcttaggagctcagggccagagccgctgattgtgctgtattgggcggggctgctccaggcagggaagacctccagatacagtgctgagacactgttacaagaccagtgcaacttctctgggctagcttgtctcttgaactaggtttagcactggctgagcagtacttaactgacctctacctttgaatgtcatagtagaaacaaaggggcgtggatttgtcccacccgaggtgttcaagcagcctggctgggaccctcgagcagctgggacctgcatctggacctgggatgtgcttggattatattcaagttttcccggccacattgcatctggtgccagggagagcttggccaacagagggtgcatgtgagctgctgtttgtgaacagaactgattccttccagacgctgagtttggaaaaggggtgactcagaaattgccaaaggatttatgaatgtatgagtctgagaagcttaaacaaaaatctaaaaatctaggagcaaattttccaggttttgaatgttgcacggtttacaaattttaaaaaatttatattgaatgcttgcctgctttgtcacattactgatgtgtgcaccacagtcatcttccctgtccattgtggtgatgaaaagaagtgagtaaaataaccaccctcgctccgagctgccgtcagtgttgagtcgggaaattctgcctaggcctgcgcagcccggggagtgggggcctcgggacccaactgaagtctcgcagcaccttgactgaaagccagtgagctgcttcaagggctccgcagtgttcattgttttgcagtcttcccttatgtctggctggggaagtgactgtagcctgtgcttccctcctcctaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttattttaagtaagtaaaacgttttccttctgagctgtgaaatgtgttcaaaattaaaccagcaatgccgctctttccctatcggggagcactgcaggataaataggtctgtgttttagttactgttgctggagtcatcgtcatcttttgcttaaactgaggaaaagcgttactcaatcattaagttttaacaccaaagatggtgaattctcatgagtgtaaaaataaatcccccgtccttctccctctcttcatgataatctcaggggttgaagccgaagccttctgacatgtttgagcaggaatcttctgggcttaccagtgtttagaaaataagtttctcagcagtgttactggggctgctcttgggggtggtggccgaggtgcacagacagggcgagggccgtgtggtgctggatacggcacctgaggaaggtggattagcactcagaggccagaactggttggggagaaagcctcttgagagggaaactggtgtcctcagaattgctgtggggtcacagacgtgctgccctagcgtgtccgtgcttcctttccctaggaaaggaagcatcctggggccctgcagtgattctgaggactgagggtttatgtcatgaatgccttcttgaaggacttccatgtcactgtgatcttttctgtctcttcaggctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccaagtactaccttcaaggtaatccgtggcttcccacaaagttccacatttaacttcctccaaggaaggggattaaaattttcaactaactcccttcagttgaaatctcggaccacttttaaaacaaaaaccwtggtctaattctttactttgttatgaatttcttgacagtggattgagcgatacgtgtcagaactaagcatttcactgtaggcaaattgtgtcttagttatcaagtaaatgtacaaaaaaactaaaacctggtctgatccagtggttctgaggttgggtggaggctgagctgtgcacagtcagaattgcctttgatttggttttaaccatgacacttccttattttggaatgccaaataatattagagaagggtaagagattttatatttgtaagaaggatgaaaggaaactggcctaaatgttaggatgtaggttaaaatcaaccaggacgcacatagggcagagtccagggtgtgaaggaaggttttaaactggcactaataagggtgttgccctttgttccctcacataatcgtgaaaggctgcttttgttttgaacagctagtcttaactatatacctttcataatttgatttttgaaccgtgtgtggatgtaataactctttaaaaaaaaatgaagtgtgtttaaagaaaaccccagcctgctctgatgtcaaagagctgccgatcatgtcctctgggaggggagagtagtgatagctgagaaggagcaggtgctctgtgccctggtgctgagcacattgccgagaaggagcaggtgctccgtgccctggtgctgagctcatcgccgagaaggagcaggtgctccgtgccctggtgctgagcgcatcgccgagaaggagcgggtgctctgtgccctggtgctgagcgcatcgctgagaaggagcgggtgctctgtgccctggtgctgagcgcatcgctgagaaggagcgggtgctctgtgccctggtgcggctgagaaggagcgggtgctccgtgccctggtgctgagcacatcgccgagaaggagcaggtgctccgtgccctggtgctgagcacatcgccgagaaggagcaggtgctccgtgccctggtgctgagcgcatcgccgagaaggagcaggtgctccgtgccctggtgctgagcgcatcgccgagaaggagcaggtgctccgtgccctggtgctgagcgcatcgccgagaaggagcaggtgctccgtgccctggtgctgagcgcatcgccgagaaggagcaggtgctcygtgccctggtgctgagcgcatcgccgagaaggagcaggtgctccgtgccctggtgctgagtgcatctccacgacggcagcacctgatggagggaagctgggtcagcatcgctgctcctggtcacagattgtagacagcgccctggtgcatctgctcatagcacctgtggcccctgaatagaactgggaaagtgaatgttctgctttctgggtgagttgatgatgggaaagttgatcagcctcattcacttgcataactccacagcacggagctagcactctgtgtttctctgttctctgccttcctcacacttcggtgaatccttcagtcattcagaatcagatgttgcatgtcacargttgtgccttctcttgctgtcctctttcccagtgctcggtaaatcttgattaaaggaaggaaggaaggattgtttcagaagccttcagggrccctatcatgcagagaaggaaagtctaggctctctctgacacagcttgaagatgtctgagaggctcccatgtaccagggtagccttgcaagctgctgctcctacacatgcctcagccatcaggttattcactagttcccaaagtcaccctgtaacctrgtgggtttacatatgctgctcttggtgctggaatgccttggcccaccttcctcatccttccaaacctacttctagtgcccctcctgggaaggcccaccttctcatagcagggtgacaccgctggtgtgtctgcaggattccaaacctacctccagtgcccctcctgggaaggcccaccttctcatagcagggtgacaccgctggtgtgtctgcaggattccaaacctacctccagtgcccctcctgggaaggcccaccttctcatagcagggtgacaccgctggtgtgtctgcaggattccaaacctacctccagtgcccctcctgggaaggcccaccttctcatagcaggtgatactgctggtgtgtctgcaggagtcttcacgctccatcgcgcagcactggccacttgtctggttacacataagacctccacgttcacaagtggtatgtctagcagacctttgaggatccccagctttcagagtgcttgtgcatgcgcatttagtcattcttggtaaataaaatccctttcagaccttttcactttcttcattcaccagccccaggaagtagctttagttttaagacatcttttcatctttcatgaagaaatgaagtttctatctcttcctgaggcttgccattccttcgggagggcagagctgtctctcatcaggacgtggagctgctgggcggtttgcttccccacatcagccctgtggaacagtccattcagcagcccctgcttcagctactcccaagcgagaatgtggggccctcccggagcggagccrcaccgcctgtctctgggccccatctgtgtgtggacatgtccgtctcctaccctgcactctcgcctctgcattcctggcacccagcagcaccagccacaaagattttcagccagtgacaaaggttgggagcagcagagttcatgcaaggagtccacacaagggttcctcacttctgacagcaacagcacactgaaggggttcccaagccaacttcagatttaccctttcaccataactcacagagctccctggaagcagttacacttatagttatgatttactgcagcaaaaagatacaggttaaaatcaaccaagatgcacacagggcagagtccaggagggaattgaatgcagagttcccaccagctctcccgtggaatcagatgtgttgtgttcccagcacccacgtgtggcagtgcacatggagtatcatcagccggaggtgcttccccragccttggtgtccagagtttttcccggggctctgacatgggcaggattggtccattgatcactcaggtactgcatggccagcccctgctccgtatcctgtcattagccaaggagcaaggccagccctctttttgggcaaggttaaattcttgccttccctcttgttgccgttgcttctgttcctggaggagctcctggcacagtgatggggtctcaggcctccaccttactgcacgatgaagagtttgaggagatcaagaaggagactggcttttcccacagtcaaatcacacgyctgtacagccggttcagcarcctggacaaaggagagaacaggacgatttccaggggattccagaacttgccatcaacccagtgggggactggatcatcaatgccttccttccagagggagaggaccaggtaaacttccgtggattcctgcaaactctggctcatttccaaaccattgaggataatgaaaagagcaaagttgtgaatggacctgaaccactcaacagccgaagcaacaaactgcagtttgcttttcgactatatgatttggataaagataacaagatctctcgtgatgagctgttaagggtgctgtgcatgatggtccaaataaatatctcagataagcagctgggcagtatcgcagacaggaccattcaggaggctgatcagcatggggacagtgccatatctttatcacagactttgctaaggttttggagaaggtggatgtagaacagaaaatgagcatctgatttcttcactaaaggacagacagcaaactattccttgcagtctagtatttaagtactggaacttgacagtcctcctgtccaccagccctacctccaccccatcattccccttctcccaaagtactactgctgttgcataacaaccccaaatatgttctgtcaacacaaacctgcttttggtctataaacagggcgttacagaatggtacacccagtctatttcttctcagtatccattcgccagttcttcatttataaatatcgtcttcctctgttctgctgctgaatgccacacatccatccagtctgagaaagtaagatagggaatcctgccgaggaacaagccagcaaagctctttcactggatgtagactgcacctgctgccttccctctggcgagtctgccagcatgcttctccatcctttttatatgtcctttgcttcccacttctgtgtacattcaacatactgttcacgtagtcatgcagtctttctgctttttgtgaagcctcagaatctcctctgttctacttggcaccccaagctatgcctggtattgtatttctgacttggctcgatagttcggtggtctggcagtttttatctaccttcattattaaaaggccctctggagctgggcgtggtggctcacgcctgtaatcccagcactgtgggaggctgaggtgggcagatcacgaggtcaggagatcgagaccatcctggctaacacggtgaaaccccgtctttactaaaaatacaaaaaattagccgggcgtggtggcgggtgcctgtagtcccagctactcgggaggctgaggcaggagaatggcgtgaacctgggaggcagagcttgcagtgagccaagatcgtgccactacactccagcctgggcgacagagcgagactccatctcaaaaaaaaaaaaaaaaaaaggccctctgggatgttgcctctccaggagctttttggtaaccaacacttctctcgggagtatgagatcatcctctgcactcttctctgtcatcaaagggctgctgggtggagatattcttgaaaggtggccttggtgagaggtgtggagtcaagtcttttaggttgcttgcccacgtcactctacctctggcctctgattctcaactttgtacctatggggcgtctcttgttagtgcagtgttgactattcaaaaagtagcaatatgcctgcagatttgcttagtcttgggacacggttaccaccagaacggctgctcagacaatatgcttggggactttctcatggctttttgaacaaggaggctgcgcaccctgtgaagcctcctgcattcacacctctgctgcatggtttatgcctcagtgttatgtgcactggaatgcttttcactatacgtttccaagttagaaagattagtgttatggaagtgcctaatgtatcctagtccaaaatatttaaagattgttctctgtgtcttgaagttttgcacaaaattctttatgaattttacacttggcaaatgttaatgctagaagccatagtccgcttcttatacaagtccaaagcgttgactgttgtatcattagctccctggttacactggtttcccagctccttgtgtagaccactgctaatcccttagaaacaagaggtctggcactagtagcacaacctaaggtggcattccaagtctttaagcaagtcacagcaacttttctgccaaagtcagcttagtttagacttcagtgaatcaggctgttgccatcctaatgtatgtctctgtgagtctgttcattcacatatctgccgttggctgactttcttgactcgctgcttgcttgcttgtttccttgctttggaaagctattgaagatgtgtacataattctttaggaaggggattgctaaaaaatacactgcaaagcgatggaaaacagtggagaacaggggagtagccaggctggatggctcaaatataaatgaatgaggaattctttatgaagtgtcagttggactttgtgattgagtgatgtaatacaggaattatatagaaagggaagaatatctgatactgatctgttagatacttcagaggctccttgatttgcatatttaaagttcctaaaattgtagcttttcccttcttttggctgtacagcagactgttttaatccacggttgtgccttattgttccattaaaattgtgtcttcagtccatcaataaatactcgtggttaaaacaaaacaaaaattctttactgcatgctgactaagggcagggctctatccatgtgcatcgagtggcctcgtaagctgtgaacagagtgcctgtgggacgtgggatgaagtctcttctgcctgattttaagtctttgcaaactttttagaccgtaaggagctaagctcagtctgctcgtgaaaaatgatggtgacatgccatgtgtgcccttcccgtttgacagacggcgatctygatgtcgtgtttgcctcttcctctaagtgcggaaaggataagaccaagtctgtttcttccaccatcttcttccactgtgaccctctggtggaggacgggatccccgagttcagtcacgagactgccgactgccagtacctcttctcttggtacacctcagccgtgtgtcctctggggtgagtatgacatccggaagcttagcacttgtaccccacatcttcccttaagaataagtgtatgtgtgttttttccccaatgttttcttgtgaaatattcagaacatgcaccaaaaaatagagaaaatgatagaagcggaccccacatagtcagtgccccgctccgttgcttgtcagcatcctgccactgatttttggtccatggctgcgtcacctcccaccacccccagyagcagtgccattgtttcctttgtgtgtaccatgccccgaatagggtccagtcagggcaccccagctctgtccctctaccctgttcccattgctgcctccctctccttagctcctgggaggcaagtactggtggtgcctcctctgtgtaatcctggaacatcttttgtgtcgtaatacaaatgattgtttggtaaagtttcactttgatttgagtgcagtatttttactttgatttgagtgcagtatttttacgtttgtttgaatgaatgaaaagcttactctccagattttgagaatcagcatgagaacagagggagcagtttctgctctgaaggaaggtggcacctccattggttgtcttgtgtcccacagccgttttatactttgccacgaataacatgttgtcagttgctttcctcttggatttattttcttcttatgttacccccacccatcattgkatttatatttatttttaytttttatttttttgggatggactcttgctctgtcactcaggctggagtgcagtggtgcggtcttggctcgttgcaacctctgcctcctggttcagacgattctcctgcctcagcctcccaagtagctgggattgcaggcatgtgtcattatgccctgctaatttttgtatttttggtagagatggggtttcaccatgttgaccaggctggtcttgaactcctcacctcagataatctgcctgccttggcctcccaaagtgctggcattacaagcgtgagctgccatgcccggcctggcccaccattttacataagcttttcattctctgtcctgagactttaagattgggggaacatgaattcttgccatgtaattgtttccttcatgtcctgaaaaagggaccgtagagtcagcagacgacagtggtgggggtcatgggggaatgaagatcacacattttacatcttaaatcagcactccccctgcccacccttaacagtggacatgagctcagcaaaaaccagctttgtcctgtgctgttcaggcctgtgtacttagggatcctcagctgcacagtcagggaaagaggcttttggttgaaatttcacttgtggtattttcagcttttgaatgtttatggtgttccggtgacgtcattacaaaatgaaaggattgaaactggaagttcttcctgaaagaagcaaaatgtgaatttttataaaagataaaacccagaagtgaactttccctgcattctctgtcatggagaggctacagctgccatgagatgaatcctgcctcctgacatggcagctggtcttctgtgtgggtttgagggaccaggccaggctaggatcccgtccatgttgaatgtttagagttcgacttctgtgagtaggaaaagcacygtttatagggctttggtgtttgactctaaaaccagagaggaagattctccaggaaacctcggtttcatgatgttcagaacatcaggattgggagctgtttaaatcccttaacacactgacaaggtaataaggactttaaaaaaaagaaacagaagttgaaaccaagagcaaaaactcagatggtggattttgagggatgcaggtaccacccgggggtgacgtggaatagtgcctgagatttttttttccccaaatgttatcagtgttgtacattgtagaatcatgtaaatatggccagacgcggtggctcacgcttgtaatcccaacattttgggaggctaaggtgggcggatcacttgaggtcaggagttctagaccagcctgggcaacatggtgaaaccccgtctctactaaaaatacaaaaattagccaggtgtggtggtgcacacctgtaatcgcagctactcagaaggctgaggcaggagaattgcttgaacctggaaggtggaggttgcagtgagccgagatggcgtcactgtactgcagcctgggtgacagagcgagactagatctcaggaaaaaaaatcatgtaactataacaaacaggtagcaatgttcgccctaatagattaccatttttagttcttttagctatttcttctggaatttacctcagtattttaaattaacatcctatatctcatctgttgacttcctgcaatagtagatgaagatagagctgtcttacaccttcctcctactttacaaaaatggttctttcacaatatttgattaaagtcaaaaaatttacacaaagctaaaagacaggcatctacagatggaaggggcaggctatgtgcccagcacagttattgatgacaagacccacccacttatgaaataccaggagagcagatacaaagaaaagactgtaaaagctttaggggaggctaatttgttgtattagaaaataattcaagaaaggttaaaatactttaaatcctcactttatatcatcgataggttcttggaaactgcaactttatgtgaaatgatgtataatgaaaccagttttttttcctcagctttatgttatgttatgttatgttatgttatgttatgttatgttatgttadttttttgagacagagtctcgctctcgcccaggctggagtgcagtggcgcgatctcggctcactgcaagctctgcctcccaggttcacgccattctcctgcctcagcctcccaagtaactgggactacaggggcccgctaccatgcccggctaatttttttgtatttttagtagagacggggtttcaccgtgttagccaggttgatctcgatctcctgatcttgtgatccgcctgcctcagcctcccaaagtgctgggattacaggcgtgagccaccgtgcccggcctcatcaactttataatgagacagttttgaaggaaatgatgtcattcgaggacctcccatagtcgcttcacggaaggttgcagtttgaaggaaactgtcagcgaccctatgaggacacactgtactggacaacagtggtgtctaagctgagaggggtggcagagttcccagcttttaaaatttcttacagtgatagcatcatatgaaagtaaaaccattttcttgaaagaaatgaaggaaggaagaaaaggtagagttcctaattgtttggaagacatactgttagacttcctgtcttagtatgcatgccagtattttaagaataaccactaaaataatataaatatagtatgtaacttccaaaacagcggagaagaaaaggagaagtaaaaatacttaaatccccaaagaagacaagcaaggagaaaaataaaacaaaaatcagataagtagaaatttcagcccagtatggtagaaataaatctaaatatatctataatcataagtatagcttgactaaacttgtcagctaaaaaacaagttgtcaaactggatttcaaaaacaactctgtttacagggaacatgcctaaaacaaggatacagaaaagaccaaagtcaaaggagaagaaaagatataccagaaaataatctgaaagaaagctgcagtagttatgttaatataagataaaataggatattaaagaaaaatattagggataaagaataaagagggtcattataattttaaaagggctaatttcctaggaagatacaagaatcctaaacttccatctacctaataaaaaagccttgatatgtaaagcagaaattgacaaaaccacacacaagaaacaagcctagtgattgctgggttgagtagacaaagagtaaagctttttttggaagattgagacagcacagtgaaaagcaagatttaatagacatgcgcagaacactgttccctgcgttgggagaacactgtttgcccaagcttacatcaaacacttagaaaactttagcaaaaattaaccacaaagcaggcaagtcagcaatttcctttttttttttttttttttttttttttttggagacagagacttgctcttttgcccaggctggagtgcagtggtgcgatcttggctcactgcaacctctgcttcccagattcaagtgattctcatgcctcagcctcctgagtagctgggattatgggcgtgtgccactacctcctggctaatttttgtatttttagtagagatggggtttcaccatgttggccaggctggtctcaaactcctgacctcaggtgatccacctgcctcagcctcctagagtgctgggattacaggcatgagccactgtgctcggcctaagtcagcagatttctgactgatgcaattaactacatacatgatgcaattaagttaggaaccaagaacaaacaactgaaaaatagaaatacgtttgaagactaaaactcacttctgaataatctatggtccaaagaagaaatcaaaggtagaaagtaaaatacgcttagaactgagtgatgatgtgtctcttggatgcatttcgagtggtcctgagtggctggagctgcttctgggtgagtgggtttctggcttggagggagaggtctgcatagctctcagacctgtctgtggagtgtggtggtgcttctttctgagcagaggtcaacccttgcaggcccacctagaactggacgccaggctgtccctgtggtttcttgtcttgctgatgttttagattgtttggcttaagctgaactttgagagcggcagcccttgcggctgggccgcgggttggcctgttgccctcaacctcagttctttgagcagccggcatcttcagcagcacaagatgcgccccgctggggttgcctcttatcaccagcagcacaggaggaatttctgtttatgtgatcctgttcctgtgtgtgtggccccaagtgacagagggccagagagattagaagtgtcaagtcgttacactcttgagtgtcatcttgctccctaagcgcaaagggaagtctccgtggttgtttctcattttctattattgtcccaactctgcttgagtgttcgatgtcatggaaacgcactgctttttcccacaagtgtgcatgtgggtcttgggtgggaatggtgaactccgctggtgaggcagctggtgtgctcaagagccttctcctgggatggagcaggcttggagagaggagacccgtcgggggctgtgctgggctctgctgctccctgggccccaccctggtctgtggccgcccctgggccccgtcctggcctgtttctaaggccccctgggcccctttcgtgtggagatggtgtctcatggtgggctgcgctcactgcttccagaagaaattctgagaggaaagagctstgaccctggagagaagtgtggtgcttcgggacagcctctgccccagcctagtcctgccgtggattgggccacctagagggggccgcgtccctcctgcctgtctcctctgtgtttgggtgaatgatagttcatggagctggaagcagtgccttcttgtctgctttctgacaaccctgccacaaactcatcatcaggaactttttgcagccctcttccatgtggagtgggacttgtggccttgttttctgggcaggagtaagaatcacatggtgttgggaaagtcagagctgctcttgccttggggactcaggtctcaggttgtggctgtggcagcaggaccaccctgtgacacggctccttttctgtgacgtccttgcagggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaaggagaggaggtaagygggtggcagggcgaggtggggcgggtggatgcatgcctcccatagctaatcttggggtcagttttgtggggttttatttatttgtttttaagccctacagcagcgaaggctcgaggttcttagtccaaaactctctggaagcagtccccagcgttgtggtttttaaatgcctgcatttctgtctgaccaaggccgaggccctcgcacatcacccgtgcctgcggcttctaggaccgtggtcctttgtgtccaaagatgagtagaacattaaacggcacctttcatgggtgccttttcccactgagcagctgacccctctgccctcctcacatcataaatgcaggagtttattaagcgcctgctatgtaccaggtatgatgccatccttttgcgccactttgctgggtgaaaggactctccatgtgacggtcaagcagattttcacgtcaggcgtcagtgttagtggctctgacctgggggcaggagctggccagctcaggcgttccctgctgccactgtcatttgccagctgagccacaggccaatgagagaggtggtcagaaagtaccaaccatggaggttgcagtgagccaagatctcaccactgcactctagcctgggcaacasagtgagactctgtccaaaaaaaaaaaaaaagtaccgattgtggccctctacacccaaaatgcagaatggggcagaagaaggtctgggccgggaagggcatgtgatgtctgtctctgcgagccaccattgggcaggcttagtggcgacggactggtgtggtcctgttagtcatgtgaaaaagtccttgccctaatgttaagttgctctagagggccctctgctgttggattccaaagcccatsttctttccactcaatcacaacaaatacattagggtatatataacctgtcacggctactcatttgtcattcagaatgtgggagaaatgcagccrccaccagccccctggtggtgcagatgggggtggggctggcgggggtggggctcctgcccatgccctctctacactggagtaattattgtctccttttttttwatagggaaacagtgataagtaagctgaccacttgctgtaggagaagttccaacgtgtcctacaaatactcaaaggtaattttctgtggcgagtctcttgaaggcctgcctccccggccccctgtgctgcgctgtccatgtcgttctcatcaggggtgccaaggaaagcagtcacaggctgactggaatccagaaaggaaagcaacacccgttgcctcagccacttacgccagcacatttttttgttatttttttccctcaagtttctctcrtggttacaactgatttccttgaagtatttaataattaggttgtttccactgtttttggctgttctttaaaaaaaaaacaaaacacacacacacacagtagtgaagatagttgtgcatgtagcatttggatgatttctttcagrtaaatttgcagaaaagaggcattatctggatcaaaggacataatgtttgtggtctcgatgggtaatgatgaattgctctctaaaactaggcttttgactsgagtccctcctttgacattcctcccctgccatgcagtgggcacctttcagtctatgagtagcccggaagagccccttctcccccagctgcgctgggggatcactggtctgcttttcggtccaggccatcccgaacgccttctgcttggtcccacccttggctgtgagactcctgccaaatgaccccactgccaccctcccaaaccctcctgccttggtgcagtctcattaggaacaggaaggtgttgccagccctcgtcttcctttccctgggaactggagatgcagtgactgtgaggacagtgggccagttcttccccagctcgtgccagcagagagcatccctgatgtggtggatggtggagcagaatggggtctcttagggggctcacgtggtctctgctgttgatccctggcaggtgaataaggaagaagagacagatgagaatgaaacagagtggctgatggaagagatccagctgcctcctccacggcagggaaaggaagggcaggagaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggagcgtgaggacgatagggtggggctggtcaggggtgagaaggcgaggaaagggaagtccagctctgcacagcagaagacagtgagctccaccaagctggtgtccttccatgacgacagcgacgaggacctcttacacatctgactccgcagtgcctgcaggggagcacggagccgcgggacagccaagcacctccaaccaaataagacttccactcgatgatgcttctataattttgcctttaacagaaactttcaaaagggaagagtttttgtgatgggggagagggtgaaggaggtcaggccccactccttcctgattgtttacagtcattggaataaggcatggctcagatcggccacagggcggtaccttgtgcccagggttttgccccaagtcctcatttaaaagcataaggccggacgcatctcaaaacagagggctgcattcgaagaaacccttgctgctttagtcccgatagggtatttgaccccgatatattttagcattttaattctctccccctatttattgactttgacaattactcaggtttgagaaaaaggaaaaaaaaacagccaccgtttcttcctgccagcaggggtgtgatgtaccagtttgtccatcttgagatggtgaggctgtcagtgtatggggcagcttccggcgggatgttgaactggtcattaatgtgtcccctgagttggagctcattctgtctcttttctcttttgctttctgtttcttaagggcacacacacgtgcgtgcgagcacacacacacatacgtgcacagggtccccgagtgcctaggttttggagagtttgcctgttctatgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccagatttggggtataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctcggccmtagcattgcacttggcctcatgctggagggaggctgggcgggtacagcgcggaggaggagggaggccaggcgggcatggcgtggaggaggagggaggccgggcggtcacagcatggaggaggagggaggcgctgctggtgttcttattctggcggcagcgcctttcctgccatgtttagtgaatgacttttctcgcattgtagaattgtatatagactctggtgttctattgctgagaagcaaaccgccctgcagcatccctcagcctgtaccggtttggctggcttgtttgatttcaacatgagtgtattttttaaaattgattttkctcttcatttttttttcaatcaactttactgtaatataaagtattcaacaatttcaataaaagataaattattaattgggtgttaccattttttccttgatagtgagacgttcccgagcgagttacccatctgcctgcctgtcttttctttctgttaagtgactgaatttgggttttaactctggtgttctcgttgaccctttatgaggcagcactttcatttttctccagagtctcctggtcgtaggtgttaactttgggtccaatctgccttcccttggctctttctagatccgatttctttaccttctccaggccaacctcggggtgtggtcctgttcatcaaaacaatgaacatggagtttagagtccagtgagtcaataaagcttttttttgtgcaacctgatctaacatggagatgttttctcttgagtaaactcactgagttttccatcttaaattactcagcagtgactgagagctacctgcatggaagcaggaagttactccagtgttataaacaaacttcttagactcaacatcctattctccatccctttttttttcctgtagagtccaaaaacctcaaccgtctcatttttaaattatccaattggagttacctttttaaaaaagttattcttaaggactttccaatacctctcctgaggaagacatgtcaggtcttctaaaagtttacattatgaccaaagaaagatgctggtcctcaggcattctacccagggggctgttctccaggccattcccacctcctgctaagaccatggggagccctctctgtaaggaggggcatatgcagggacctgcccatccccttggtaagctggatggcaaaaaggcatgttgtctgcaccactggctgcctgctaatgtcgctgtcagtggggaaggagaagtgacaacacgtttgagtgcatttgctttgactcttagaaacccaagcctctgaaaaaagagtaactacttgccagctgttgttacagatgatatttttaggaaaacatcccgtgacagcaaatcagaattggactctttttcagagaaatgattttattgatggagtacaacctgggtatttagcttcctttcaacaaaattttttgtgcccctttcttgagactgtccatgaatgacagagacatagaataagaactggggtgctaaagatggaataggcaaaccccacaccaaggaaatccacagtgaagtggaaatctggttcttatgaacattttaagagcatctgaagcctgtacttcaccaaccctaaaataatacgtaacacgagatgattcctcaggaaggaacatatagacatacagacaggagacaacatatagacattagaacttacaggacaaagaactctttttccctgaatcatttgagatgaagtttcttcccatcaccaggcattcctacaaacaaggaccttcacacgactaagatgccacctggtgattaaagaacactttgggctggtccgatccattgtacaagttaaagcactgatgggtacacaggtcttacccctgttggcgatcgggtcacaaggagccagtgtgtgtgtcaccaggaggttgtatggacgagactggatttctggaaatatcctttactgactctgaagaatcccatggctcagggaggtacactcatgtcctttcttacttctccggttccactctgttgactagtagttggcctcttgagccatacttgctgtcagttctggacattgttctgtgagaatggggtcaacgggcagtcgtggtgcaggtgagcttgtgtgcaaggcggcaagatagccacattgagttggggacagtatggcctgggggtgttggataggtaaggcagaagcaagcccagaacttggagcctgttgtgactgtcacagtaaggagtttgaagtcctgaaagcagttgagagctgtaggagggccagattgggcttttgagcaagatagtctagatgaaagtaaagagatggagacgcttcagcaaccagatgggaggttgggcatgggagctgtggctgtgctgagctgagaagcctcagactgcctgcgaggctctctctgggaggaagtcaggtctttctttccttcgtttccttcctttcattcctttcctttccttcctttttcctctttctttctttcttttctctctctctctttttctttctctctttctttcgagatggagtctcgctctgttgccaggctggagtgcagtggcatgatctcggctcactgcaatctctgcctcccgggttcaagggattctcctgcctcagcctccctagtagctgggattaaaggcacgcactgccacgcccggctaatttttgtatttttaatagcgacagggtttcaccgtgttggccaggatggtctcgatctcctgacctcatgatccacctgcctcggcctccgaaagtgctgggattacaggcgtgagccaccgtgcccagccaggtctttttcttaaagagggacagactgaaggtaggctgtgaatggtcagttatttgtatttctttaccttttatgctatcttgtagtttgaccagtttgcaaaacaaattgaataaaaagtaattgataatgttgttttgatgctcagtgtttgagggaaacacaatctagtgaatggggttattggttgtcacacctgggagagtgaaaatgaggggctcacaacccaggtgaggtcatctggtgccactcagccccatcccagagaaagcagccttgggatgctggcctcggtgacaaccaagaagtgatggtgggttgctagagacagggtggagcacagagccctggaaggaagcaggaagtcaggttcaagaaaggacttgtgacctcacccttggcttcagggttttatttttctttcttttaaaacattttgagacaacatgtagacattcaaacttacagaacaaagaactattttttccctgaatcatttgagactaagttccctcctatcaccagacatttctacaaatgaggaccttcacaggactaaggtgccaccatcagaaccacaatatgtggggacggtactgccagctaagccttagtgctgtttcggtgttgacagctgtcacaatgatgcccttttcagtagaggagcctgtgatggtcacgtgttgcaggtgatcattgtgccatttggtttacttctgtctggaaagtttctcctttctgtaacctccatgaccttgacacatgaggtcactcttctcacccgccccacctctgggagggtgcctgatttgccctgccccacccagcggctttaggactcagctcttcaggaacaattagggagagggcccttgggtctaactgcaaaatcatacttgaactagaaaatcccgttggcataggtatggattgtcatatagaaacatttttcgcagtgtgccccgtggaacacttgttctgtatgttgttaacagatgttttgcaaaaaatgaaaaggacctgagctctaataagtttgggaaatgctgaattgaagtgaaacagcttttcttggtgtgagacctttcagagtctttaaaggagagttgctgaccacacgtgaaatcacaatagaaaatggccagcaggcctccaggtaggcagcaattcctagacatttgcctgtgttccctgggggagctggtggcctgtgaccatccactgggaaattcccttctgtggcgaggttctgttgttttccagaggctcccacggagcatgctgggtgggtggtctgtatgagaccacaccgttgatgagcagtgaggcccaaacaggtatatcaaaaaatgctcagcatcgctgatcatcagggaaatgcacatcataaacacagtgagacgttgcctcacacctgccagaatggctactgtcagacgaaagacaacaagtgtgggtgaggatgtggagaaaagcgaacacttgtccacctttggtgagaatgtaaattggtatagccattatggaaaacaggaagttcctgaaaaaattaagaacagctaccaggaatcccacatctgggtgtatatccaaaagaaatgaagtcagtaccttgaagagatctctgcagcccctgttcattgcagcattattcacaatagccaagatagggaaaaagcctcagtgtctactgacaaataaagatggatcaagaaaatgcatgtatgtatacacacacacagtggaataccaagtcttgcagaagaaggaaatcctgtcatttgtgacaacatggatgagctgagagaacattatgctaagtgaaataagccagacacagaaagaaaaataccagatgatctcacttatatgtggaatctaaaaaggttggactcagaagcagagagtggaatggtggttaccaaaggccagagggtgcaggaagtgagcagatgttggtgaaagggtgcagaggttcagctatgcaacatgaatgaattctggagatccactgtgcagcatggtgactatgatactgctttgtgtatttaaaattttcagagagtagatcttgtgttctttcccctctccaaataaaaggaaattatttgaggtgatggatatgtttaactagcttgactggggcaatgattttgtaatgataagtatctcaaaacatcatgttgtacaacataagtatacaattgacccttgaacaatacaggtttgaactctgtgggtccacttacatgcggttttttttttctgtaaaagttacacccgatgcgtcagccccttcttctacctcttccacctctggcacccttggcacagcaagaccaaccccccacttcctcctcctcctcctcagcctactcagggtaaagacaaggatgaagacctttatgatgatccacttccacttaatatataataaatatattttctcctcatgattttcttaaaactttttctgtattttattgtaagaatacagtatataatacatacaacatcgaaaatatgtgttaattgactctgttattggtaaggcttctggtcaacagtaggcaatactagttgttaagttttaggggagttaaagttctatgtgggttttcgattgtgtgtggggtctgtgctcctaatccctgggttattcaaggttattctacataatttttctgtccgttacacctcagtaaagctggataaaagcgaaaaccaaaagactacgaaggctaggagaaaatcagtacatgccactccagcccccattctccccagaagcagtccccacttcttcccctcagctttgtcccctgtcagtttaaaatcatgaggttcataaatttgaaaaggaaagctttatttcttgtaaagggtctcagcctgcaaaatcgccatcctggcaggctgggaagtgtatccagcagagaccaaaggcaggtacttggagacggggaaggatgaggcaggaatttatgctgaatgggttggccaagcatacatattcaacaggtgatggggggagctatgaatattcatgacagggggacatgcacatgcattgtaaacattcctgttacatacgccccatgatcactttggggtggagacttaacatttaaatgcatttcaattaggacttatgtgtcaaaaggtgaagcagggacatgaacgccctcagtgcatgcctgggcaaactagacaaccagtccatgcttggtggtcttttaccaggagaaagtccctgaaatcaggctcttgttaaagctgtagttacagctggtggagaagggggtcagttagtctgcatctggccataggtggtgagctgaaattgttgccgtattgctgatctccaggcccctgcttatttagctgccagagaaaaagaaaacaaaacaaaactttgtggcagttagaacctagtttattttttaagtgcctgacttaactcttgcctggcatggccataggtcatgtttataatttggcatcttacttccacaaagagtctgttctgtcgtgttatgatctgtaattttaacaccaccaacagactt

SEQ ID NO: 17662 - DNA, 95832 bp, Homo sapiens
tatatatgataccaaaatcaggttccataggagaaaatattgataaattggattttataaaaataattttaaaaacttgttttttaaaagacaacattaagaaaaagaaattggataaaatatttgcaaatcataaatatgataaaagacttgtgtccaaaatatataaaaaagtttataactcaataatcagatgagaaacaaatctgataaaaatgggcaagagatttgagtaggcatttcatcaaagaagacatatagatgacagataagcacatgaaaaggtgttcaacataattcgtcattagggaaatgcaaataaaagccactttgaggtaccaccaaacacctattcaaatggctattataaaagactgagaataggaagtattgcaaagtatgtggactccttacccactgatatactgtgaatagtaagtgtaggaggggcatatggactccttacatgttgctggcaggaatgtacaatggtacagccacattgggaaacagtttctctgtttctcaaaaatttaaatatacgctttgcatatgacttaacaatgaaactcccagttatctacccaagggaaatgaaaatgcagattcacacaaagacatgtacatgaatgttcatagaagcattatttataatagctcaagctggaaataatacgaatgtccagcaactggtgaaaagataaaatatgatatatccatacaataaattactactatgtataaaaagggactactgatatttgcatcagcatggatgaacttcaaaacattatgctaagtgaaagaagacagacacaaaagacaacttagtataataccatttaaatgaattttctagaaaaggcaaagctacagacagaaagcagagaagtctttggttgggactggaatgggagtttttgattatacatgtgcagaaacaaactttttgaagtgatgaaattgttccaaaactggatcatattaatagttgcacaactgtataaattattaaaaatcactgaactgtatgcatataatgggtagatatgataataggtaaattgtactttaatcaaacttaaaattcaggttacctggcaaccctacattttgtttgaaatagaagtgtaagagataatgaaggagtggcagataccgtggttaacaaaaagtgaaggactagaaaccaacttcctgtagcaggtaatcagcgacaatctggggccagtggtgtgggggtaaaaagaatttatgaagatacttgtaggtaaagaaagtcatatttattagagcacgtatgaaaatgtgttgcaagggaacaatgggcaggccagcaagagaggagctgactgcaaggagacgaaggcttgctggggatgttctagaatggtgcttgtgctgtgtgctgaagagggctttgtgcagtactgataacaccgaggttgcagtgaattagcttgcatttttttttaatcacccgagggtctgatgatagctgagtgcaggaagattgtgagttatttgtgcaagagggctacatgttctggaccacaaagcaaggcagacttacagcttatctgctttatatttttgctttccctcggtcccgccatcctgactccttttccctaattagaaccccacactctctttggatggtacatgcgttttccattttcccaggttctattactctcctttggatcttacacttctgaattctctctattcgttttgttacctaactgatccctgtaggcatctctccttcatcccagagcagcaagaatcctttccttaccctctttgtagatgcaggcccaataacaggtctcaaaccttcccagagattatatataaaccatgcataatataggagaaaattaaatctttttattctctcccttaggggtagtgagtggttgatttacaaatgcaaatgatagatttaaatgtttgtgtaaagttgaaatgtcaaacattttgttggcatttagagatattatctgaaagagcattttacaaataaggaaactaaggctcagaggcttctggtaatctgttcaaggtcacatagttatccaagcttcttgctccaggggacatatttttgtgctttcaaaaaaagaaagaaaaatcaggatgtcatacacattcttaaaaataaattaatgccacagaaaaatgttttccctaggcctcacaaagattaaagaggcttgtgggttttttttctgtttagatttggctagatgtctttcttgttttactggcgaattagaagaaagctggaaaagctctgaaacagctgctaaaataattaccctacagcatatttcattttttaatcactaagaaaagttgtttcaaagtaatatttcaaagtaataattaaacattgataaattgtttttgtttggtgttttggccttatctacaaccaaagcttcaagcaccaagacagaaatgtctaaatatttatgttacaataaaacttaatagaaaacttacacaaaatcttaaattatcatctttactgctattccagattagagtatgcaatcactaaaacagagtgatttaggattaaggatgaaacattcattgttcacctttgcattaacccaaaaattgtgttgtggttttatatctcatgaccttattgtactttggaatgtgatggtgaagctgtccctcagatcatttagaataaagaagactgaggcaatatttcactataggctttgcaatgtctatagctaaacctgaaaatggcatatctgactcatttttttttttttttttttgagacagagtctttctctgttgcccatgctggagtgcagtggcatgatcttggctcactgcaacctccgcctcccaggttcaagcaattctcctgcctcagcctccagagtagctgggactacaggcatgtgccaccatgccctgctaatttttgtatttttagtggagactggttttcatcatgttggccaggttggtctcagacacctgacctcaagtgaaccacccgcgtcagcctcccaaaatgctgagattacaggcgtgagccaccgtgcccggccttggctcatttttattcttccgattttagacttccaattgggtttttataattacccatattaagtcccacctggcacagatgaggcatgagcattaggcagaggccacatcctggtgacgtgtgtgccaggtctgtcctgcagatgtgctacattttgtttggcttttaaacgtgctacattttgtttgtttgaagaaactgtttctctgaattttgtagacaacattttgcaaccggagaattcacacaaacatttaaatttcctgcttctcttgaaaaatctgaccatctgcccacactgggcacacaatcctgttgaatagatgctgcaacctttaacatggcacatggtttgccttttgcagtgtgtatagggctgcctcagtcaaatatggttcatggcatattgtgctttcaaaaaaaagaaagaaaaaccaggatgtcatacaaaatcttaaaaataaattaatgccacagaaaaatgctttccctaggccttaagatgtttgtgaccctggagactgcacactgtgttttccaaatgttaagtctttaaagtggttcgttgccttgagatgcagacaatacacttcttccatttgttttgtcaggtttaaaggcactttggataatgtctctgttgagttgcttttagaggttttgacactcatttgaccagtctcagtggagcaaatctttgtccttgaatctgatttttggaaagagtcaaaggaaaatttggagccaagtttggggcagaaaaatatgtgtgattatgaaacagtgaaaacctgtttctcttgggtggtttgtgagctgactcaaaggtaactttttaaaaaagttcaataatgctttgagggaaggcttttacttcttccagatgtcaactgtcctttctactaagctctcataatattgaagtagctttgttgtctatggtgacatccgaggttcttggtctcacggccacaaagatcaaatatgtggacacacacaaagggtgaggtttggagcagaatttttaataggcaaaaggaggagaatagctctgctacagagaggggtcccaaaaaatgggttgcaatacgtggtgaaatgcaggggtttttatagatgagctagtggggaggcggtgtctgatctacataaggagggaaaacccggtttcgtgcatatggcatgaaaacccggttaggaccaggtgtgtcatctgcatagggcttaagtgtctggcagccccggccccaatcttctactatataggcaggtagctactccgtgttgcttatttccttcttactgtgcatgtggtaaaaaagaggggaggtggaacccccatggtggacatgcctggccccagtagccccttctgtctgtgccgctgccggcatctcccgtgcaagcttccagtttccttacctatgtttgcagcccaatcttccaggttgctctttgttagaaaggaagtgatttcttgggctgctttttgttagaaggtaagttctgccgagggctcttttgctcatactatctgcctaaataatttctatctcctgtatcaatatcctatgtgtgactctattctgcatatatgacttaggttttaattattttgtttacgagttggtcctacccccccacccccgcttccaccacacttaaggaaagatacattttaattcattttttatatggtatgcatagttggaggccaaaagattgagttgaaggattcattacttgatgaataaatggatgggtggatggatgagtcagtataaatgaagagcatcccaagttgactattttaaagggataacatgcattttatatttgttaaacattcattctcatttgtaaacacttgtatatattcatgtattcaaaatgtattgaaaattaattgttttccttggtacctgaagtcagtcctgggtattgcaaagtagttcgaagtcactggtttccctctgtctcacttcactacacactggtgattttgctaagtgatgagccagaaaatgtacaagttccagaatcaaaggtaaaacaaaacccaccaagaatcagctcactgttagcgtcctagttgaaaaataaggcttatcaaagtatttcagattgcattaacacttttgatatagctaggtatcagtgtcaacctcaggagagggcaacgccaactcctgaaaccttcaatacagaaagtctagaaaaataagcaaatatacatacaaacaatagcgagaagactccagaaaccacataaaaccgtgggaatcgaaatatcccttacgtgtgttcagtacatgtgaacccacgtattttaagtggacgatttctctctcagagtaccgtaggtagtgggggacggggcgcagagggggagaaacagaaagtcgccttcctccatggttcatttgcatttccatccagaaactcacaggtcgaccccaagactccactctctcccgcctttgagaagccggaccggcatcggcggctgcatccttctcctcctccccgctctattttggggccccatgatctcatgccctctgcagaccacacgctgcaattccagcccagcccgcgccgcgaggccacgcagggcgattcctgcaagtgtcgggagggtggccggggcgcggggaggggacggcttggggggaagtttaagacacgcccacgtaagggacccaaaataaccgacacacagagtgcccgaaatcagacaggaagccaaataatccggggcgttgagtcgctttgccctgactgcgagagccgggtgtagggcggggagccaaggatctgaccgcgaggggcgggcgcggcggggaggggcggggcggggcgggcggcgcggggcctattaaaggcgcggccgggcagcggggccggagcggccggggccacgatggagcgcgacggctgcgcggggggcgggagccgcggcggcgagggcgggcgcgctccccgggagggcccggcggggaacggccgcgatcggggccgcagccacgctgccgaggcgcccggggacccgcaggcggccgcgtccttgctggcccctatggacgtgggggaggagccgctggagaaggcggcgcgcgcccgcactgccaaggaccccaacacctataaagtactctcgctggtaggtccgcggccaggccccggcgcccgggagggctgggagtacggggagggcggcgccgagctcctgcgctctcagcgcagtcagcaccgggcaccggagagaggcatggtccgggagtgcttcttcgcccgcgcgctctcctccgcagcctttgcaagtgccctacacagccgcccctgccaggtaccttgccagggcaggatggttcactctcacttgaattatggatgcctgtgaaagcaggctgttcaaaacggtcatccttagaaatactcgaccccctgccccaggagagtacgggtttttagaggagaaaaatgtcaaacgcgaaagttgttggtcttaagaaggtgcatcaatgtgttgcttcttttagggggctctgggcgcagtatacatgacttcacttgggttaactgattgcagttgaagagttagcggagctctttaagttttattaggaactctacggaacactttttccctttcgctccgttttggaatttccttgcaggtgctcagaaattccatggatgttcacattatgtgactgaagaaacctttatgattctttgcccactcttctaaccagaggctacacggtttgtgttgctaacaaaagctacctattactcctctgctattttgctatgacatttgcaggacccacagtcaacttcatgaaatgtgggggttggtttttattctgaattcatggtgggaagtgctgattgagagaaggcctggattcctggctgttattatttgctgaggccttgcgtaactgtccctaaacctcaatttctaatgtgtgaaaatgggacaacatcaactcccttgtgcattgcatgggattattgtgaaaatcaagctgaagaatgtaggtagggaagtaaattgaaaacagcaaggaaatagaatcatttttattgtattatatggaaatcacagatttctatgtatagtgtaccctaaaatatatccccttacatatgattgaataatgctttgtagaaaaatttctaatttttcaagtctcctttcattttgtatgcatttccattttcactatatttgggacatcatggagatgctataatactttgaggaatcaatcttcctagacttaagagatggtgccgtatgcttagtacttaaaaagaagccttagtttcacagaataagtaccccaagccacatgatgtttgcatctcaagataaaattttgcatcttgtaacactgttttgagtctataataacacaatattgatgagaacttagtctcttgagtcaccttttaaaaattttgttaatggaagaccttagcttttacaacctgatcacttaaattgtttagtattaataccttgaggtgtttcacacacgatgaggtagtcgataattgtatatggaatcagtgtgtaactcttgtgtaaaaccatttctacatgcctataaacctttacaggttttccaattgcaaaattcaggttttaaatttttcttgctcatttacttatacatccacaacagatatcagcaaaggtctagttttggaataagctgtccagtctttgagacctgcagtcaactggtcaaacagcattctgtgtgatgatgctactctgggcatttgacatggaagtgtcctaggacttacttccacaagtaggactattatggaccttttttatccattaattggggtcttttgcatctattgaattggaaagaattyttacttcatatcttttgatggaacactgtgagacattaacatacaaatgttaccaaatagacctggtgcggtgactcatacctattatctcagcactttgggaagttgaggcggttccattgcttgagcccaggagtttgagaccagcctgggcaacatgatgaaacccatctctacaaaagatacaaaaattagctgggtatggtagcatgcgtctatgtcccagctacttgggaggctgacatgggaggttcagctgagccagggaaagttaaggctgcagtgaactgtgattgtgccactgcacttcagcttgggtgacacggtgagaccctttattgttgaaattgctatttagctactgaactgaaagtgcaaactcgtattcttctttcccttccctacttcaatacctttttcccccaaccccgccccccccccaarracttccccaaataatgggcttccaaatggaaaaggccccaaaagcatcctgacaattgtsgtcaaagagctctgggatatgtcttctagaaaggagctgcaattatagaattccttttgttttcagattaaacctcagcacacttttcataaagctgcagaaacagattgaactaattgcaacctggggttgggattaggagaggcccagcactatgatcctcagctacactgttttaatttagcaggataaatagaagagttgcgttgccttgcctttcagaggcaatcatgttgcagtggcaatgtaatttttacattactctgcagttttctcagataaactaaaatgatgtagatgtgtgagagtggatgaaggagtgaggattctgtcctaccctggcttctccccattgtggtggttgatcttaggagagggccaccaagctgtgctttagaggcttttggccctgggccctggaatgcttgtgcctaggtactgagccaaactgaggaaaacagcaagagggaaaaacaagtattattctctacatgtgtcagtaggtatgttaaatattagatgcctttccttggttgtaaatgaagttttgaactgaagtgtagacttccaccgagatgtgttgacttggagatgtatttaaatatccttcttgtttcttggtgtgattttacagtsatgtaattctcaactacattgcaatacatttctccagttagctcctcaaaagcattttttttgtgttgtttgtgaccttctgctatayttatgaatacatatatctgtgtatctgtgtatgtgtaaagggcttgcgtatgggtggtggtcactgaagactactttcatgtttcagtgaaagagttctttaaaaaaacatatatctatatctatatctatatatctatatctatatctatatctatatctatatctatatctatatctatatctatatatatgtagagagtccgtttggctcaagtttgaggactgcaacccaggagcatagattcaagttgccctgagtagatgctcctattagcagcagttacaaatgggtttttaaaggaaaaaggaagaggcagttcctaagttgtttatcaagcattcatgttacamtaacgagctattggttggctatacattgttctttgtatcacacattccaggaacatgaagatagtgggtgaggcagctgtcaggaacaaaatgcttttaaagaattgcccctgggaatgggtgcagtgatgtgactgaagtcccatgctcatgtccctctgggcctgataaattttgcatagttcgcatatctcagactgctctgagcaatttttctttctcatttcctccttttaataaaaatctttctcttcttaaaatactgatgatcaacgttttggatgtaagtttgtcccacattgctgggaaggctcatttccggatagtcttgtcccatgtcagagggaatgagatgggcagaagtactatcacttaaaaacttagtgaggttccaaggctgaattggtaggcaacaattcagggattggattgaaaaataaggggacagagcagcgggatttcaggtcattcacttacactggagttgaggtatgttgggtcatttctaagcatctagctattatgatgagttttttgttatagaattttgtggtagactttagacatctagaaatacaaagcataatcaatttaagaatcaaaaggatgacacaaataaggacaattatcaacaaaacaacttgaaatacaaatatgaaaagtgttcctattcctgaaggtaaccaaatgaatattttaatccacttcttgtcctggtctaaagaacaaagtgttgaagatctccactgaggaagatgtccacttaggcagggtagcctgatattggcccttctaacgtggctaggagtcctttatttgatggtattttctattaaacaaaatcttccaggttggagaccatgatctttgatgtttttgtctcctaagagcttgctgttaaaagaatccttaattaatttagaattttcagtgagaaacttataaggccttgacaatagtgaagagtatcaccttgttaatggaaaaaccaaactctgtaaaatattttaaagagctttatcctgagccaagatgagtgactgtggctcggggaaacactttctcaaggagtcctgagaatgtgcacctgaggcagttggattactgtgtgtttttatatatttcagggaggcaggagttactggcaaagacataaatcagtacatgaaaggtatacattgattccatatgaaaaggtgggatatcttaaagcaagggcttacaggttatttattcagcatattcagagattttttttttgagacagtcttgctctgttgcccaggctagagtgcaatagcacaatctcggcccactgcaacctcccgctcctgggttcaagcgattcttctgtctcagcctcccaagtagctgggattacaggcacacaccaccactcctggctaatttttttgtattttagtagagacagggtttcactttgttgcccaggctggtcttgaactcctgagctcaggaatttcacccacctcagcctcccaaagtgctatgattataggcgtgagccactttgcccggtgattcggagattctttaatttgcaattgattaaaggagtaaggctctgtctaaaacttggaatcaacagaaagggctgttgtggctgtgtgtgatggctcatgcctgtaatcccagcactttgggaggctgaggcaggtgggatcatttgaggtcaggagttcaagaccagaatgaccaacatggtgaaaccccttcaaaaaaagggtgaaacctctttttttgtaaaaatacaaaaaaaattagcagggcatggtagtacatgcctgtagtgccaaccacttgggaggctgaggcaggagaatcgcttgaacctgggaggcggaggttgyagtgagccgagattgcaccattacactccagcctaggtgacagagcaagactctgtctcaaaaaaaaaaaagggatgttgtaagttaagcatgatgctatgtagcaaaattgatgggtgtgcagacatgacttaaccctcyccttgcatacccttaaggtcttgtttataacttggtgtcttattgccacagagacgttttcgcggtcttatttctattgtaacattaatgctggtcaattgttacgcctcaactccaaaagggagggagtagaattaagtgcgtttgacctctcttcctattttgactgagagctcagtttttgaggtttctctggggtctccttggcagagagtgggtccactcagttggtcgagggctttggattttatttttagtttacaacttttcaggagagctggttcgtagtctccttcatccaggtgcatggatctttccattcttatttcaaaaggagaaagctgatgttttccaagcagggtagaatgtaagttaagcaaatggaagagccttaggccagggaaggttaaagctttctgtaagctttgccaattaacttttcatgattccatttatttattcttccactctggaagactgagtgtggtttgcacaatggaaatgccgatccatccaatctcaatgagcttcaaccacacaagataagatttctggcggagcatagaggctaatgcctgaaatcccagaactttgggaggctgatgtgggaggattgcttgagctcaagagttcacgacctacctgggcaacagagtgagacctcatctccacaacatgtggtaggacttccaaaaatggagaatgcaatgagttcatgctggtaccaagcactgattttagagaaaaacaccaggtggtggtgggaagtcactgtgaatcctgctgacctaaagaaaaaaaaaaccaaggcaaaattaatgtaattatagagctttatttgggccaagtttgaggaatacaacccaggagcatagattcaagttgccctgagtatatgctgtgaaagacttctttataagaggcagaagctggcattatttgagatttgggtgtaaaaattataattcaattagcttccttttccttcccttatgatccattatcttaactctagaatatggaaggaagaatgttcaagctaagtctctgctcttaatcagacttggagttgacattgctcctttggtttataaaatttgttatctgtccagccatagttgaacattttaatttcagaataaccagagcatcttaagaggccagagaagtgttctctgtgtcccttatggtatttgtttcacatgttctaataaaatacataaaggattcctaggaacccaagactgttgtttttactattaggcagaggatartacctgacactcaatgtcagcttttaattgcttgaatgaatgtactgcattttttgttagactgagccacactttgatttggaaaaggggaagatgggaagactaaatacacaagcagggacccatagggtctgtgatggtcaggaatccacatagagatgacacttgggtataaattcaggggtaagattaaaactgggatataattttatttgggtatagggagatggaggagatagtgaaggaacagaagtacccaactaaggtgaaggtgcctaagaagaaggcagacggggcctctgtgataacgtggattcagaatcagaaatctagtcagtgaacattctctcaggtacagacactccaagtgtggcagtcggcatgtatgaaggagagcctccttcacttacaccaaggcctctttggttttgataactttgctgccacaccctgaattcagtctttgtgattcttcgctcttcttcagcattgctttctgtcccttcttttcttctgccttgaatcttgttctggtatttctttttcaccatttgtagctcagctgtttccactccatgttgtctctttctcagggatacgtagctactgtttcaaaagcactttgctaatttctatttcacttgtttagttaactttggacactcagttttgtcatctcctgcccccatcatatcctaatcatgactctgaagaaaatccttggtggtcacattgagagaccttatgtgttctgtataataaagaactgggggccattaacctttctagagcatttacagaaatttttatctatcagccttttttttttttttgaaacggagtttcactttgtagtgcaggctgaagtgcagtggagtgaacttggctcactgcaacctctgtctgcctcccgggttcaagtgattatcctgccttagcctcctgagtagctgggattacaggcgcacaccaccacacctggctaatttttttttttttttttttttgtatttttagtagagacagggttttgccatgttggccaggctggtctcgaactcctgacctcaagtgatctgcccgcctcggcctcccaaagtgctgggattacaggcgtgagccaccacgcccggctgtatcagcttttcatcttcatccagctgactctttttatcttaagtagcaatgttaaaggtaaatgaaaatagtttcatattcaattttgctctcaagtttgatgactaccattgtaaaatatttgtgtgacatttaagatacagcaaatgtatttcatctatattgtggcctttttgtacaagccagagaactttatcatgatttataacttctttttttttcttactatggggagaggcatttaagttccagacaacttaggaacaaataagcatttggaatacaacttgtaattagagatctgcttttggttaaaataagcatgcctccatcaaccataaaataccccccaaacaagaaaaaataaacaagaaaccttttagcaaatgagctcagggccgaacatagattactcttctaagcataaatcttgtgcaacaaaacctgatactcagaattctgacccagctcgaaaatcccttgtcatcggataaaaactaagttatgcatttaccaaggaaagacaatgtaggaacacatttaaggtttttcaaaagagtgaccagaatgttcagttaaatattaacgggaagactattttctgagtattctagttatctgagatttagttgcaagaattaagatatctgtagtgtctttgaaaaattatttttacctttttttacttttagtttttagaagaggtgttggtagaagtgtaggtggtagaagtttagatggttataatcatttttgtagcacttggcagctttaaaaagcatttcccatatatttttgattgatcctcaatactcaacaactgtgaaataggaaagtatgatgacagtcaattctgctttacagataaggaatctgaggctcagtcagggattcagtcaggtttccatgcagacattattgtgcataaaaaccacctgggaagtgttaaagacagagattcctaggctccaatctcagtgattatgatttaatagatttggaatggacccaaagaatcctcactttttaacaagcacctcaagttattcagatgtaggtggttgatttactctacttctagcaacaatgggctaaatttataggcaaaagccacaccattagtacataatagactatgatggtaactggaaggacttttatctacagatttttatyacggactaatagctaatgccatcccattcatttgctaaatgttatatcctattcatcaagcttggcctgctgttgggtttccaactctcctttgcctgcttcagtataacaatgtgtaattagaacctaagaaatttctggtgtggtgatgctaaagcttgcctctatattgagatatatatgtgtctttggtagttcagtgatgagattttcctgggtggaagccaaaattagtgcactttattagtgtgaagtcaacaatcagctgtttctgggagcttccaaagtaggtatacttttgggaaawtgtgcttttcttcttagtttgagtttccttcttggcttattttgaaatgtagtagaatagaaaaatagagagttttgatagaaagtgattttgggatgtgtggtggctcatgcctctaaaggagaccgaggcaggagaatcacttgaggccataatttaagatcagcctgggcaatataatgaaaccccatgtctatctctctctctctctcaatctctctctgtctctctttctttctctctctccatacacacacacacacacacacacacacacacacgtgtgtatgtacatatctccatattttatatatatgtataatatgcataagaaaatcattttggaggaagtaaattgtcacagcgaattgtcacaagtgtttctcatttatggattgaccattttctcaccgtatttcaggactttgcacagacttagctggcaaacatcctataacaggtgtgatttgagagtcttaaaaaaaaatcactatcttggttttcaggtgaatatttttgagaaactagcttgttcctaaagrtgtgtttcccgatccccctcctgcttagaaagctttttttgacgttagcaagcatctgggggatcttgatgctctcttatggttagagagagagaattgaaaagaaactcagtagattaagacattatttgccctttcactgtgttgacttttacaccgtggtattaaaggagtgatggcaccttagcagacgtcattgcaatgacaccaattgtacaagtagtcatgcacttgcaataaaaaaaaagccatttcactaaaaagaacaccttagatgttttattgcttagatgaagcaataaaaatgtccttgatgaggctggtcgcggtggctcacatttgtaatccttgcactttgggaggccgaggcgggtggatcacgaggtcaggagatcgagaccatcctggctaacacggtgaaatgccgtctctactaaaaatacagaaaaaattagccgggcatggtggtgggcgcctgtagtcccagctmcttgggaggctgaggcaggagaatggcatggacccaggaggcggaggttgcagtgagccgagatcgtgccactgcactccagcctgggtgacacagcgagactctgtctcaaaaaaaaaaaaatgtccttgatgaagcagatttaataatctgaaacctagattacctgtctttttgatattctatgtgacacaattggaagtatgcatgtagcatatctgctgcatactgaagtactgttttctagaggaaaagcagctgtgcggttgtttaagttgcaagctgaactaattttttttcaaagaacaccatttttatttgaaagaactgacaagctttttatttagacttatttatttgacatattttctcaaaaatgagtgatgttagcttgtcccttcaaggaaaacctatgaagctatcagctgtctatgataaaatctgagcttccaagcaaaaattagaattttgaaaaacttgtatttgccatttgagtgtaacagcttcctgatccttacacaaaaytgatgaagatagcgaggaatgtggttttttttcatgttgtttaatgacatgcgttaacatttggaagaatgatagaacttagtgaaccaatattttccaaaggatgagtggatgatgttacaaaattatgcattggtataatttccattcaaagtgcaagatagactaatggattttaatgtaacagtatgtaaagttcagtaataccttttccatttttatgccataatttacttctttcaaaagacaaatataagataaaaattaattcaagagcacagatatatrcattctatcgaaatgaatacaatgtgatttataaatgagaacaaattaccaatgaacagtatttcagaagttgaaaaggtgacactaaatgttaaatacacagccttttagttatattcttcagattcagtttttttgtgaatttaatataaagatgagttcattttgcaacctaaaaatacttacttattgaaactatattaatactttaataaactatacaaaaaagataatgagacaaacgtgcatttgtggaactgcatgtcagtcagccagttccctgcagagggaattcccagcattacctcattcatctgtgagaacacagagcagtccctatttagacacacacatttgtctactgctccagcatggccagcccccyacttcttgatggtttctttctgctatgaatatgcatgtccagttgtctgcttcatagagcagacatttaccttcctcatccaccagccattggaggaggactggggccacgcaaatgattgattcgaccaattctytggggagagtttcccagtggccctcttccatcatcatatctggaatcagatgagtttccatagcttcttttttttttttttcgcatcttgctgaagcagagttttgaaaagcaaaaccacaaactcagctgttccccataagaaatctgttatcaaagataatctccatggagactgactccagctgtccagcrcttgtccatttgcgatgtaaaccatcttgccccccttccctgcttcggagcgactggtcatagtttaagagattactacttttagaattttggtgtggttttaaagaagaatgtccataatcatctgaaaaggcatcttagggttgttagtaacttttagaagtataatgggatcctgataagaaaaatttcgtgaatatatttacaaatatttaggaaataggtgtacatccagtaatattttcagtaatatttttcagaactaggggatgtgagggcgatctggctgtgacttctatcaccccattgatcgccagggctgatttggctatctggctggctaggcgggtgtccccttcctccctcactactccacgtgtgtccctcccgaagatgtgcgctcggttgaagaagatgaccatctcccatagatgagaaccagtctttggtcaagggtatatgaataggtgcactcccctgctagaacctccaaacaaactctcaagaactagggagaggagagtgaaaattaacctagttacaatgattgtatccttacattcttttataaatttcaaaatacttctacatctcctacctcattagtccaaaccacagctctgctgttatccatccccatgttagagatgaaaaaatcatggctcagagaaagtttggagactttccaagatcacaaaatcaataattctgttaatctcatctctgtagtttattggtgaatagttttggagtcagacaaaatcaggtttaaatcctgctacggttactagctgtttgaatacagacaaaaaagtttcctaaatagtaccacaactgtagcatagagacaaaatcatattagagtgtgttaggagaagtaaattatataatgtgtacaaaatggtgcataatatgccctgaataagtggttttttcttgttattgttgataagcttcaatgtgactgagaattttttattttaccttactcagaaggcactttacatccttaactacccaaagtgtggtctgcagactgacatatcagcattatcctcttagaatttgtaagaaatgcagaatcttgggccccaccccagacctactaaaccaagatctgcattttcatagatcctcagaggtttgtctgaacaattaagtttgaatatcagcactccataaggctatgagacagcacagaaggcaccacatctggaatttctgtagctgagaattctaattaaccctcgctgtgccactgacttcatacatgatgttgtgattagaaacctaaaacaaaatgaaaaaactcaatgggcctccatgacctcaactgtggttgcattaggttgaattggtgctaccgctggttgcatttggcccctttccttccatgaacctcagtggcacatggatacaagtagccccattgctcttgcacatacagaacatggcatagtctcctccctttgcatataccatctctgtctttcaggaacctgcctgtgctctcgtgtgttgcttataatttaattgccttcttttactctgcactggcttgtcctttaattgctctttattgcccttagcgttgccaatcttctgtctttgctgttacctgataacattcagatgtttttccaattcagccatccatctatcaaaatatcatgtagatggtgctttccatcgcacgatcaatggaactatccaattccaagtttccactgcagtcccctctcaacaatcaacagtatacttgacacaaaaccaaaacaaaggaatcttataccaacgctttttcaggtgatgtaaaatcaggttaaatgtccttggcccagagtttattccataatacttcatcatccaaacacactagcttcctataaactgccacccagcaccatttcgattataatctctgggatactaggaaacaggtgaatgaaatattcatgtgggaacagtgtggtttaggagcattatgagtagactctgttggtcttatctacttttggattagtcggggaaataagcaggaaacaactctacttggacacgatttatttgaataccttactaatcagcacaaaggaggtaaatgtgaagaatattgacatatataagtatttatacatttgttatctcttagaaactttcaaagaaaaagaatattgagtattatggaatgattcaagcaaaggtcttcagagacagggttcatgtaaagggtctaaacgggaatcacatgaatcatttgctatgtgacctttgaacaattactttctttctttgactttcagtttccttaaccgtaatatgaggagttggattagatgggttccttctagttccaaaatatttgttttgagagcttacaatattttccccattgctataaaaatactatctattgcaaaaaattcagaaaatataaaaaagtataaagaagaaaatgaaaattgcttttgggttttttcccctccaggacttttctatgtgtacatatcactttttaaaaaaaaaaaacaaagatgagatcactttgtgcatattattctgttgccttttttcatttatattccattatgaaagtttaccattgatagacagctttctaatgtacttttcataagtaggattttgagacttttattttagtatcctcaattcartaggtaatctttgaaactatttctatgcatactttagacattctcagtccccaagaatttcyagctttttggtacatgtttgttttctgttttattcattcctcagctccatctctattgcttatgtctctttttcatggttaaattactagtttttctaaaataatagcttctctgcattatgtttctgctcagaatttttctgggactgccacagcacacaatgagaaaatatatactcctaagccgagactagtttttatttcccacacgcgggataacagtagacgttaatcaatgtagggctcaccatgaatagtttcatccattcgtagcagtgctgagtctgtgacatatgtgttcagtcatttatgagttaatatttgtcaaccacttagagtagacccttgctggtagtaagtgctatgtgtgtttgttaaatacatacrtatctatttgtgtttactatttgtccggccctatgctaaagacttatctcctttaatgggtacagttctgtgaggtaggagggagcaaatctgttggcttgggagtgtctggcctagctcccatacctcagtgggactcagtatcctatatgatgtatagtacatgcaatattatgtgcatactttgtattaaggagattgtagggctcagatatgtttcagtcaactgctgctgtgatggcactttgcccatttagagagtcaaaaaaggactgaagatgcatatctctcttcagcattccacacctctgaagcacgccttctatgacattcagctcagccttgtacagttctccaaatacactttgtacagattatatctgttttctaccccaccgtgattttttaacctctccttttctcacccaacatcaggcacccaccaagacccaactcaatgtgtcctctcaaatgaaacattctttagatgctctttggccccatctccctgtcccagaaccactcaattgctactggatcctgttgaggccatagagcttagtgagtaaggccagaccctggagccagagtgctggagtgtaaatcgcatctctgccaataattgcttttgggtctttgggcaggtcccttaacttctctgtgtcatagcttccttgcctattaaatggggataatagtagtagtacctcacaggtttgttttgagggttaggtggattcatatttataaactaatgagaagagtgcctgatactagatggtagatcggggttcaatattgttattgctatggtttgtaacttatttaacaaatatgtagagtttttactgtgtgggcagtctggtgcaagaggctgggggctaaatggtcaaagggaaagtttacttactgtctgttttttaggttttatctgaagggaccagatatttatcgaagaattatacaagattatctcaagttgcagctgaaataagtgcagcccagaagctgtgtacatagcgagggggaattagccttgtccaggaggtctgagaaggcatttcttaggaagtgacaggcgagcagaagaggattatgagaaaaggcagcagcaggggaaaggccctgggagaggagacaacacggcccatcccagagcttggaggaggccaggatggctggtgtgcagcgctgagtggagtgtaatggggatgaggtgggaaatgttgccagagccatctccaggcaggatttgttgttgttgttgttgttgttgttgtttgagacggagtctctctctgtcatccaggctgtagtgcagtggcgccatctcggctcactgcaacctctgcctcccaggttcaagcgattctcctgcctcagcctcccgagtagctgggattataggtgctcgtcaccatgcccagctaactttttgtatttttagtagagacggggtttcactgtgttggccaggctggtctcaaactccagacctcatgattcacccacctcggcctcccaaagtgctgggattacaagtatgagccaccgtgcccagccggtttttgttttaagagcaattggaggccgggtgcagtggctcaygcctgtaatcccagcactttgggaggctgaggccggcagatcacttgagccaagagttcaagaccagcctgggcaacatggtgaaaccccatgtctaccaaaaatacaaaaattagcctgttgtcgtggcacacacctgtaatcccagctactcgggaggctgaggcaccagaattgcttgaacccgggaggtggaggttgcagtgagctgagatggcgccactgcactccagcctgggtgacagagcgagactgtgtctcaaaaaaaaaacaaacaaacaaaagcaattgaaagcaattggaaatcactgaaatatttttctgtttggtttcttttttatttttgttcttagtgacaagttctgatttacttttggaaaaatcattttataatagctttagtggcacaaacaaatcaacgggaccctgaaaactataatrgctttagtgacactaacaaatcaaagggagcctgaaaatagaagagcacactgtctttttgttgttgttgttgttaattgaccacttcgtaactttttttattcctgctagattttgagtccgtagatgtgttcactccargatgataaccactagctacatgtggctatttaaattaaaatttcatctaattaaactttaatgaagcaaaaagtttatttcctcaatcactcttgccacatccgtagtgctatgcaatggcgcacggctagtcactttcatattgacagtacagatctgtggaacatttttagcatcttaaaaacttcacttggatagcatgtaaaaattgtgatattatagtttttaaaaaataccttgatagttctccaattaacaatgatgaaaatgtacatagtacttgttcaagaaacatttactagaagacaaattaaaagagttaagatatcaacgttcttataaatattattttaagattccttatccaaatgattattgaatatgattaagttgatttaagcctaaatatatacatgaagaggtgacacatttctaaaattgtgttccctttctaattataagctcatatattaattactaatttttttcataatagtcacccatttttcatctttattaacttagaaaattttacttcttatttaaagccctggagcatactttcaaaaatgattttgaaacatgagtctcttcattaggtcaacatttgtctaagcacgtctgtaaatattctgttacaggaagaggaagagtattgagcaaattctcttcaacaatcagacagctctgctttagggactgatatccttccagttcaggaggaagtgtttccaggtaatttccaatgaactccagatgagtaaggtttgacagctgacccacatgaggggacaaattcatcaagctacttttccccaaaggtaaacattgcagctttttgcactgaaacagcccatctggtagcatctcactgttgttgttggytacagcacagtactgcaaattactcagatactggatttcttctggaatgaaggtcaagtggttatagcttagattcaaataatgtagtttgctgcatagsaaaagctgctagggcagattctcaatattaataggaccccaaaagagctgctctaggttagataatgccccagtttatccaggaatgtaagtaatgttattgtgccataastttaagcaggaaagattctgaagatgctgacagccaatgatctcttccacagttttaaggttattttcctttaggtctaactcatgcaaattattcaggctgaaaatggagtatggaatgcattccaggtcacagctgatcagttctaggcttttcttattgaccatcattttcaagttgttcagcacagccagtttgcttccctcattatcaagggacaattcttcagtgaaggcaagaggtctgcaatgacttgtgggatctgggagaggctactctgcaagtagagggtccttggatattttaagtcctgaaagccgtctaactgcacagtactgaactgttgagggagaacacagcctccctgtgtggggcagaaaagtttctcacataggggaaagataaggttccttcagattcttcaggtgaaatacccagcatgggatttttcccatttcaggatgcttcaggcagaggattttaaaattctgctccaaaaagccagtgcaggatggtctactaccagagatgaatggtccacatctttgaggttgaccagctgtgagacggcagacggcagcttcacctccagggtctgctccaggcttagcacctccatttcggtgaactcaaagacatttgtctggaagactgttgagcataaaaagatgcagttctatcttgtcttggacattttccacaagctaatgtttttcagtttctcaactgtccattcrttactgaggttgatctgtttcagtttgttctcactgacctctgataggaatatggagaagcgtctggaataaaaaggatcatactgattagccagatgaaggatgaaggcaaagtcattcttgacatcagggatgtcactatagttgcttttttctcttaacacctcaaaggaatattgcttcatggatctcctcagcatccaccacagcctgtaggaggaggtcagactgtagagtacatccaaaatggtataaaatgaagccagaaacttcaagatttctgcgaaggaatagacacactggtaggcttatatcctgtaaaagcctacatgtcaactgaacagtcaatttaaagagtgatgtaggttaaaaaatatggaacataagttatgatgagcacaaaatgactttgactattatctgcttcagatacacactataaatgatgtccttctgctctacgtgcatgcggaatcttctcactttttcaaagatggctgtggcctcttgcccctccttcttgtccaggccactggaagttgggctttctataccagctgactccaaagcccgctgcaggtggggcaatgactgctttctggaatctatgtcagttgaacaccctgaggacgaaagcaaaatcttggactcggagagtttcagaggcctcactgactgctcggccactgtttctgacagggtgcaggtggtccgtggagaatcgaagcacttataaaggatggccacaaaatgctcaagcttggagctggtacctggggtagtgaagccataagttgctgcaggctgcaaagaacagtgtgtgcaagagcaccaggtaggggaagaacgttgcaaaccaatggagctgtttctcgtaacagacagcgttgatgtaggagtmctgctgtcagtggaggtcgttctggattccgagtgggatcggaaastgatgtcccgggattagaggatgtgtttatgctggctttcaggatgttccaaggcatggtgcaatgattgtcaaattccactttgtaagaagacagcacagaaccctgctctgtgtcagctggagagctccagccagcatgtccacatgatcagcatgatgtaataccagaagacatcctaccatgattttaagatgtgataagatgactgggtgtctgctagtaaacattttagctcggttagtgtaatcatgactttcccttgtaggaggacagaaatataatgaaaaaatattaaataaatcagaaatgcttcaatcaggtgatctataccttttgaagtttcttagacataccatctctgtgtttgtcttcattcctatgaatgctggccaactggaaccctgcaattagtctcaaattgaaaaatttcctgtctttggccacagggtcaatgatggatgaggctaatgagtgtggtattgaaaacacgggggtttcagtacctgtgggccatccaggtagagaggtccagcaggcagctggaaaacaaaccggagccctgtgtgactccagtcccgggccccaggcccacacattcccctccattaccaattttaaaattctgtctttaagttgtcactgtgattgtgattgaataaaatactaggcctttacagaaattaagtggtggtttatatctcccatttcctgtccacaggaagaattactagaaatcctctgtttagttgtctttttgtttgtttctactgagcccatctttcaaggataaacacaaggtgcccgaatgagtatgttccaaaaattatttcagaaaaaaacagcaaataaattacagaaacttaactgcacattatgttctttccaccctttgtttttcatctctgacccactatctgcataggcaagattcttgcctaggcaggaaaaactatgttttttggataagattcatgaggcttttccttgcagtccatctgttgggtcctctgcctgagggcagaaagagctgttctgcaccattaataaaactgctttcctccctttcctatcttatgagctgaactaaactttacaattcttttctaaagtaatttaatactacttttatttaacgrcatatctttcttgatagttgctgcaaaagagaccaactattttcaggattgggggacaatttttcttttctttttttaaaccaactgaagaaagatctaattaaaatatgtttttgcatcaaagggatttgagaattagaaaacaagataaccctcaaaatggagagttctttgcctatattaaatttagtttagattgtgccttgggatgtctgtctgtctatctatccatccatccatgtatttatctgtcttggtctgattatttactgtttgagtccaattagaaaaacaaagctcatactcagtaacttaatcaaaataatttaatataggaaacaaataccaaaagtgttagaagagctaacggtcaaacagggaatggtaggacccttaggcaaccctgagaagagtaacagaaggaagccgctaccacctggagagcaggaagggcaaaagaaaaaggtgatgaaaccagagcttgggagctagggcttcgctgtagcagctgggaccctgggcagatgcagccactgcaggggtcccacccggagcagggaggacaaggtagatacattctgatttctcctttcctcccaccctccartgttctctttcctgttggcctctcctggtctgatgcttggagtctgggagtctgggaartgtagtagtcaaagttacttctctgagttggcggatcaaaagaaaaggcagtaacacaacttgggtttcttgggaaacagactattagatggaaatgagcatgcctgggatttcattagagtatgttcttgagatcagcacctgtggaaggcaagacaaggaattggggtcatacagaggatgactgtgagctgcagtgctcattgggtgtgatgctctttggaggctgtgcacctgtggaaggcaacgcaagaaagtagggctgtgcagagggtgaaggtgagctgcaatgctcagtggatgtgatgctcattggaggctatgcccactctacggaccttcttaaactagtgggagaccctctagagtggtccaggagggggcaagctgccccaggaaggaggagagactttgggcaaagcggctgtctttagctgagacactccctataggtgaccactcccagcagctggaggagcagtggtgcctttatctctgaaggggagtccaggcacctgaccacagtgcccatcacaggcagggaaaggatgtgaaagcactgtctgcacattgttgatttaaaaaaatcatacattgatgaaatgtaaaaagtgaaagttcagtttgcctttttaacttaattctgtttatgatttacatatttccatgtcccagcctgttgatctacctaaattaaaatatgtatattttaaaagatttattgataagataagaaaatgtttacaaaatagtattacatgcaaaaagatgaaacaaaaattgtatatagaatcatttctcagttatatatgtatatgggtttgagtgtgtaaatgcatttaaaacaataataaaaaaaatagggccaggstgggtggctcacgcctgtaatcccagcattctggaaggccgaggtgggtggattgcttgagctcaggagttcaagaccagccgtggcaacatgatgaaaccactgtctctaccaaaaatacggaaaattagctgggcatagtggcatgtacctgtagtcccagctactcgagaggctgagatgggaggatcacttgagcctgggaggtggaggttgcagtgagccaagatcatgccactgcactccagcctgggcaacagtgtgacagcccatctctcaaaaaaaaaaaaaaaaaaaaaaagaaaagaaaatagatmaaaaaattttaaaaatgaaatggaatttttttggtagaataatatggattcatgcctgtttctsttttctcttttttctttttcctttcaataaacatactgtttgagaatagttctagatttacagaaaagctgtgaagcttgtgcagagttccatatactccatgcccaattcctctgtcattaacatcttacattagtaaggtccatttgttacagctcatgaatcaacagtgatacatgattattaactaaagtccatactttattcagaattacttgtttttyccctaatgtctttttttgtttttttgttccagtaccccatccaggaataccacattacactgagttgtcaggcctccttaggcttttcttggcgaagcgtctcagactttccttgtttttgatgaccttgacagttttaaagagtatgagtcatgtattttgtggaatgtccttcaactgggatttgtctaatgtttttctcatgattatacttgactgacgtatttttgggaagcacatgacagatggtaaagtgccattcttaactcatcatttcaagagtatctgctattaatgctattaataggtcttgtcattgatgatgttaaccttgactacccrgctgaggtagtctttttcaggtttctttgctgtaaagatactcttttttgtccctttccatactgtacctttggtagagagttacattccacctccttgatggtggagtatctgcataaattatttggaattcttctgaattggraatttgttctcccccttatatttatttattcagtctttttcagtatggagtcattaatgtctattttatactttgaattataacccagtactctgtttttcatgtttttgcttaacttgttccagccatggccacttgkcagttaatttctgtgaccctttgacgtgtgtgtgtttgtaagtgtttagcacttccttactttctggccctacaggatgttccaggcttttaggttcycttgacttgyttttttttttccttacagatttcttaatattatataaccataaaactagtgtgtataatcaaaagtcagtttctccaccctgcaaattaggagtggacttacataaacctttgtgcctgaactctgtgcatttcccagaggtgggcatcacaccacccatgcctccattgcactatatgtgtggattagttttcagacatctccctttctccaatgaagtgataaataaccaggttattccctcagaatgaagctggccagatgtgcactttaccttgggaatgatttaggcataagatctgggagaaggagaaaggcaagcatgcttcctcaggtgggcagggagccatcttggtttgtgtgaccaacttgataaattcatctctgttcagcacctggtcatcagctctgtaaactcaaaaatctctcatagtttttggtgtgtcaggagtccacgaaaggcttgactggacctgtgtgaatcagggtctttcatgcagctgcagttagatggtgacttagagttggaacagcaagggctggggcatttaggggctggccaggcatctttctgtctcttcwtgcagtcttagggcctccccatgtggtctctgtgcacggaatggttgggattcctcatagcatggtggcctccgtgtaagggtaactgcttacatggaggctgaaggctttaagagcaagtattccagtgatgggtctacataagtttaaaataattggatagtattttatgttgtttggatttaccaaattatatttgctccatgatttataaacagaaatttaggttatttgcaagtttttgcaattccaaacactgctacaataaatatctctgtgtgcatatctttgtgtgcttatgtgattatttctagcagataatagaaatggaattgcaagagtggtaaatatgcacactttgaatttaggtagattcattgaaatgaccttttagaaaggaacttacacttctgtgaaggcagtgtgaaagaatctatttctccttatgtgcttgtcagagcttgtgattatcagtctttttaatgtttgttcattttgttgggtaggaaagggactcattgatttgtagttctttgattttttttaatgaaaatgaatgttttatatttttattagctattttctttaaatagttggtttattacttttggtatttttaaaaattggattttttttctacttgatttttataccctattatctattgtcatgtaccaaaaatgtcttatccttgttcccccatcccaatgtggtggatttttgtttttttggctttacaggaatttccaatttttatgaactcaaatgtatcaacttttccattatcatttttggattttgtgtcatacttgtaaagcaaaattgtaaaaatatttgctcatcttttcttctggtgattttattttatacctttaaacatttgctccatttgccattgtattttgttatcaggaaagagagagaaattttgtttactaagcacttcaagatcttttttctcaatagattgcttttcttaagatgctgaagtaaatcagtacaatagataaagaccacaaaaacagcattttgcgacrgtgacagtcctactgaagacaggagacagttaaaaccatcagaccaagaacagaggagtgsatatttaataattctatgattacttctgggggttaactatctgtgaatctaaatagaagttccagtggctggaggctgtatctgaggagggaccctttagccttttaaagagtgattctgctgtgcagttgaggtgttttctgtcactctccttattgatgaaakgcttgtgtctcaagatacaatgacggtctacaagtcatggagtgaaggtgaacatgaaagctcaatgaaaccattactttatactatgagatggatgttttattctttgacctttaacttcagagagaaatgacctgtgaaagcacttggtgagatcttagtaaagaagtgatttgcccactgaggcagaagttataggtgctggttaarttttatctttttctttgaaaatgtttggtacttattgaaacaaaaatgaatgagcatgacagaagaggagaataattgccctagaaatatcagctgtctggagggcttgcagaaacccaggaaagatttcaaatataaagggcctgctgcaggtgagtttctggccccttttctgctttgcctggggaagtaaggctcctgggctggtgttacaggagcatctcaagacaagcttctcattctaatagcctgtgttcaaccaagaatcttatgcatgtacatatttgaggtaatagtcttttttttttttttttttctgagatggagtctcactctgtcgcccacgctggagtgcagtggcgtgatctcagcccattgcaacctccgcctcctgggttcaagcagttctcctgccttaggcccctgagttgctaggattacaggcgtgtgccactacgcccagctaattttttttttgtatttttagtagagacggggtttcaccattttagtagagacggggtttcaccatgttggccaggctggtctcgaactcctgacttcgtgatctgccctccttggcctcccaaagagctgggattacaggcgtgagccaccgcgcccagctgaggtaatagtctttaagagaagagggtacaggatgtagggtcaggggttattcaaataaaggtatgattagtttccagagagaagtaaatttgtagacattttacatttattagggaccatagaaaatatttagtccaactctttttgtttattgataaagggacataaataatgtaactttctcaagatcacaaagctccaaaagtaatacatgtcttaattcagatatgaaaccattgagagttactggtctctttgtgattatggtcacgatttcaccaaacttatatttttaattgaatatggctggaattttaatgtgtaatttacttacagtttaagtggtaaaatatgaatcattcctgctttcttaagccagtcttttaatttgatgtttcattttaacctttccttctaaaaaaattattttgtcaattgtcattaccagctcccatgagttactgataggagttttctttgagtctgttcttcaaatgcttatttatcaggataattaattaaaaagaggaatgatgtaatgattatttgcttaaatatcaggcgtactaaaatatctttttctggattactaattttagtttggagaagaatctgatagttttattttcccaagatactagtccaaccaaatctatactatgtttatctaaaataattgtttatttttatttttattatttttttcttcaacttctattttaaattcagtggtacatgtgcagaatgtgcaggtttgtttcataggtgaacatgtgccatggtggtttcccgtacagatcatcccatcacccaggtattaagcccagcatccattagctattcttcctgatgctttccctccctgcacccctgacaggcccagtgtgtgttgttcccccctcatgtgtccatgtgttctcatcatttaaagtaattgttttgagctgcaattttctattaccagtgactcctaacattatattagatttaggggattgtgttctctttcatgtacatcatatcatacttgaaaattaaaaaaatatacttgtgattatcttaatttttcatttaaagaaaggttaaaggcccagatcccctaagtgacatatgggcaccacttaaggatttccatttcgtgtcgtaatcgtaaaacttctcaaccttctctgactttatttctcttgtcttctgttcttttaaaagaaagatgtgacagaaagcacaaaagatccccaaaaagagtgtgtggttttcttttttttttttgagatggagttttgttcttgctgcccaggctggagtgcaatggagtgatctcagtttactgcaacctctgcctcctgggttcaagcgattctcctgcctcagcctccctagtagctgggattacaggcacccactgccatgcctggctaattttttgtatttttagtagagacagggtttcaccatgttggtcaggctggtcttgaactcctgacctcaggtgatctgcccgcctcagcctcccaaagtgctgggattacatgtgtgagtcaccacacccagccgagtgtgtgtgtgtgtgtgtgtgttttaatgaatactgttctctttattcacagttagcatccacttagacaaaatcttattgttctctttattcacaattagaatccacttagataaaatctattaaactcagcctgctactgattttccccacttaccaaataatagaagaacttggcgtttttttaaatgcacgagattcatgacactgacacaaattagaagcaagtactgtttgacatgatggcatacgtccagcaatttcattaatcattattgtaaaaaaatgggttgatggtggattcttggaaagtcaaacaaaattgctgtgataagtctttgaagcatgtttttgtggactcctgtcttaacattactcattttaaagccaatattcttccttttatgtttatggaaagtgcggtactggcatccatagggcagagattgtttttatccatagaagcaggaatccctttttagggaaagtgcttgtgaccttagcttgcttagagctcatgcagagaggtcctagacgtgctttagcagctgggcttgagcaggtagtgacaagtactaccttatgtgtggatctgtgcagaggcaaaggaaaccagtagggttcccctctgttatgttgccattagcctactgattgcttcttgtcaatctttacaagcagtggtttggtaataaatgaccttgtccaccaagaacaagagtgagttttctagcttatttggggttcctgttgtcattgtgtgtgtgtgtgtgtgtgtgtgtgtgtgtgtgtgtgtgtgtgkagtttgataaattacttaaaagtttataaaggccagacacgatggctcatgcctgtaatcccagcactttgggaggccaaggcgggcagatcacctgaggtcaggagtttgagaccatcctggccaacatggtgaaaccccgtctctactaaaaatacaaaacttagccgggtgtggtggcgcatgcctgtagtcccagccactcgggaggctgaagcaggagaatcgtttgaacctgggaggcggaggttgcagtgagctctcatcactgtactccagcctgggtgacagtgtgagactctgtctcaaaaaaaaaaaaaaaaaaaaaaacccaaccagccaaccaaacaaacaaaccaaagtttataaaataactcttccattacttctttactacttccccttccttctatcattgtcattttcaacctatgccagctgtaagttgataggtattcctataatgatttctgtgaatcttgaaacctgttaatgagataataaatattactattcccataattgccaagctgacataattatgaggatgtagggcattctgctctaagacaattatcatagtagatgttcccaggcatcacataggcaggcattaatatttaatctttagtgtcttctaccatgtctcttttgctcttaaatcattgagttaattttattcattttatttttcatttctagaaattttatttttttactttctagatcttttttaaaataatatactgttttctgttactattatctatcttgccttatttcttattttgaacagtatttgaataaatgacaattcaagaactcatgaaagacaccaatytttagattcaggtagcttattgaatcttaagtagaatagataaaataaatatatgttgacaacagaataacattgtagaacacaaagttgaaaataaaaaagtttaaagctattagagaaaataagacagattcacttcaaaaggatgatagtctgatgactggattctcagtggtgatgattaaagcataaggtagtgtaatgatatcatcactgtgccaaaagaaaataattgccaaactggaatttgcatatccagtagaaatatctttcaaaaacaagaataaaccaaagacatgtgcagactaacgaatactgagagagtctgctatcaggaagaatctaaaagatgtactttaggctgatgattccagatgaaagctgagaagaaaaaatgcataaagaaagtggtaaatatttggtaagtttaaatgaacttataaaacaatgatgtctaaaggggtttacaagttagatagtaatattaaaagaaaagtctgaaaagctataatctaagcatccatattaacagtaagaaaaaaaaaaacccgaaacccagaacattaagcctagatatggaaggaaagaaaaataagagtaagaccagaaattaataaaataacaataagcatacaaaagaaaagataagattactcctggttagcctgattaagtaaaaaacagacaaaaaagggtggcagtacaaatcatatcaagaatgaaaaagaacacaaatagagatgctgcaggcattgaaagtataacaaagggttattataaacaactttataaccatatgtttgaaaaggtaggtgaaatgaaaaattacaagaaaaaatacaacttatcaaaattactcaagaacaattagaaaatctaagtaattctctagcccatgaagagattgaaccacaaattaataaacttcttacacagatttttctaggcccagatatgttctccactgagttcttctaaacctccaaggagaaacgaactctaatcttaccatccttacagcctagtttatgaagttagcatggcctttcacttgaagatctttttactgtygttgtcctggaattttgcagtgatgtgaatcggtatgagccttcttctatgatttattattttggatacttgatattaggactctttgatgtgaagttttgtatatgtctttttgaatcccattgaatatacttaataagatgtctttttatttctattttttttttctattcccctctcccctttaccrttctgtgttgatcttagacttttgtcttaggcttacctccaatgactggtgaatcatggtggttcatttatatttaaggatgagagattaggtagatttcatggagctttgagtattcaggcagaatttgtttattgaagtttgcttaaggtaaataggcagagaaggagcttactgttatgctgagracccctaaaatgccagaatgaggaagagtttactctgggtcactaatacccacattagtcctgtggttgtcctgtgtactgattccaaaagtacatgggtccattggagaaactttggaaaataaatataaacactaagaagatgacaaaataacttgtaagcccatccatcaagtgtagatttatgtataaccaaaaattgggaccatattacccattctgttttatcatctgttctttatacccaataatgtgtcatttttccatgtcaattaaatattcttctaaatcatggctgtataacagttatatacagccatatatacagttatatacagttatatacagttatatacagaaggctgtataacagttatataaatggtctatatttctttagctattttcctactcttggacattatgtgtatgtctattttttcttatacatagtactgtaatgtatatatttacatctaaatatttgtacatactttcttaaccttagtataaactcccagaagtgcaaataatatagatgttttatggcatttgttttaggatttttcacagctacttgtacccaaaatgcttgaatcagtctagggctgcaatatattaaaagtgcagatagatatgaatctgtagaaatctctaatatattaatacaaattggtgtttacatggattcccttttcagtagcatgggctggaaggccactgtatacctataactaaaatgtctagtgccatcatttcctgcaaaataatttgttgtatttcttctcagattccttgctcctgcatggtcttcagctactgttgaaaacagattactgtagaactaaaacaaaaaaaggaaaaatgttaatgcactggtttatggcatttaagaaaataggaactaggctgtcgtacagttgacaaacattggtaaagttgtactatccctttggaagaatccgtagtgggcccagtcctttcagtgattggatacttctagtaggaactaccatttattcagtaaccctatgccctcgtcaccaatctaggcatgttttgtacattccgccgaaggctcctgccaactttgtgaggtgggtattatcaccacgtcatagatttaaaaatgaggcttagtgaggatttgaaacattccctactttcacagctgctggttgtctagaagtcagaagaatgcaagccgcctgagaccactgcagttgttttgtgcacaggtgtctctcccgcactaggtcagtgcttgagatgtagtaggatctcaagaaatatttgttcaatgctgaataatgaattgaaaggtggaatttgaaccaaagtcattttgaacttgaagctctttctaccaggcaggtgtcaatttctttagttttagtgtttcactgagagattgtgagatttgtccctatgtgatgtgcttgttcagtgctggatgtcccttttcctgattttcatgtgactagttatgtaaagggcttcacatcaagtttcactgcagtttcagaggatcttcttcagataaatctagcgtaactaaaatgatactgagtgcataagagaccaagcatgcatgaacaactgcttgagtggacttaggaactttttttagaagagattctaacttctgctttgagcttttgtaatgctccaaagttcttcaggaatgtgttgtctttgaatctccctttgaatatcttgtagaagtttcttggcactggatttactcaataggatcgaatccccatcctccagcaaacgaaatcccgtgaagactcccagcacsaggctggtctgaatcctcacagttctttttcagaaagcatgcaactttggtcaaagatcagaggactgataggcaatgtagtcagctgattcatttcaaatggcactttcataccgtctgacacattggaataccacatccagcaatctaccatttcctaaacaaaattttgtgtgtatatttgttgtaggtatcttttatgtaatgcagacacaatgtcacttaacaaactgactctgtcagcttagatgaggaaaattaggggatttatggtttctccccatttatgtttaattaaatcacagcttgctgatgttcagcttaacgattatttgttgaatgtttactttgtgcaaggcaccatgctagatgtggaaaacacagggttgaataaataaatccatgcctctcgggaactcacagtctagtcagagacagacaaatcttatggagcatggtaagagctgcagtaactaggggtgagggaagacctagagaaacatggtgctagcatctcctcggtgaggagggtctagcaagtccaagrcctcatttcccaccggactcataacatagccttccacaatgatcccaagggatcgttctgggattattaaatccagtcctgtcactttcatatttcagcgcctgaacacactccactgaccgcccgcaggctgcctcaggacccatttgttccctcccttttccctccagccccttcccttcccactcctacctgcctcctttacactctgcctgcctaggttcaaatcttgctgtggatgcttatcaacccccggtccttggcaagttactaacctctgtagctcaccttccttaaactgtgttaatcgtaatctgtcttgtgatgttatagtttggattaaatgatttaatataaaactcttagaaaagtgcccggcacgtaggaattactagagaagtgacagccatgattgttgttgttattttctccttcccaggctggtgttgtctttcctacctctgtggctttgcatgaagcaccatggcgtatatatggtcaccactatgtcatttcttaggttgcttctaactatgtcatatctttatcatcagcctatggcatcattccagagttgttgttgcctttattagatttataaactctgacattaggacttcacygcaaattattttttttttttgtatttccccacagaatctaaatacattgcatcttgcagatactcaaacctttgtttactgacagagggagaggtccctttttctccaaatctctctttgtaaagccttttgaaacccttttcttcttttctgctctccactgtgttgttagtatgttagcattttttacatgtttctactgaagtccattgcaatcattcgttctaatgcttcccccggccaacttcctttgtttctctgtaagggtaggagttgttttatttgtatctctggtctttagtacagggactgcacattgtggacactcgtatttcaatgaatgcctgatacagaaagaataatacacatgatattaatgccattgtatttgagggaattggtgagggaaaaaaattttttttttagtatttcttttgactcactaaatgtctaagaactaatgatttagttaactaaagaagcaggaaactccaaatattccaaaaactttgcttttactttctgtctcccagtttcttgttttctaagataagatgtatttctatggtttcttagaaaatattaaaatttgaaaaatacctaaattgttatggagattaaaatggatggtagattatgatattgatgagttaaactgctttgacaggaaaattcaaactaaattaggtttcacagctctgaaaattattgaaggggaatttcctactaaaaatcattctgattaggtgttttgtaacaaagtagtagatattctaaatttcatcttttatggatgtgactgtcaatgagaaatgatcatttctattgtcatacttttgtttcagttctatgctatgcctcatcttataaaaggtaaatcaagaacttctttttaataatgaagaggtgatttttaaaagtcagcatgtgtcttcagctacttaacaagaggataaagagctatatataaaccatgtgtattttaaaccaatggttaccatttaaatgcttgcttaccacctagtctttccatagtagttttcctgtccatctagttcttctactcatawactcatatccaatttgtcctgcccctttcagccattccacccatgccttaattctcttatccccttttgtattctgttttccccacctttccctctcccagggcatgtcgtcttttttttttttttcccccattttcccacttccactcttagaatttcaggccattcaagtttgttatattccatgatttcagattaagctgggctcccagagctggagggtctttttactcttccctcgttgacagtctttgttgtcgccactggtttgttgccatctttcacatgggatgccctaagccctctctattccttccacactcccacccagatgcttcttacttggccaagaagattgaagaggttcctcatcagctgtttctagcttcctgttgctataccttagtttgttttgtgtgtgtatgtggtgtttttgtgtgtgtgtgtatatcttcctctcagccttctgacatgcctatctctgagcctaaccctctgagagtattttattgtataagtaaaatatgacttgttcaaccagcttccttaaaatgagcttaggttgttcctagtttttttgttcatttgttttatgaatacagttttgaaataaacaccttggacaactattttggccacttgtgagagtacagttagtactagctttgcatgattctctgacatgcacaaatttcagttaccacagtttaattaaataaaaccagctcccaacaacatagttcaaatttcatttaccaagatatattaactgtgagtaattgcgtaaagtacaaactttgctgctagctcatcagtccacaaatcactgtgcaaatagcaagtgcaagttatggtcagtgaccaattgcatcatttctttcaaaatctgccagtgattagcccataggcatcttttagtcagttcatgcacagacagcaaaagcatgtagttgtgttgttgctgctttgcctctcagaggtaaacctatatgacgttttcaaaaagtggataattgaaaaagtgaatgaactgatgaagaatgaaagtaaagtaaagaaaagaaaggaggtaataatgctggaagtgaaattgaagtcaaagtaaatggagttatggaagaaacagctaaccgtgggaatgctaacactgccatggtgcaatagactccagatatgaagccagaggagtctagtgaagctgaattttttgacataaatgaggagagtggttgtgagaaaaagaatgaagatatcccagagggagtgacactgccacaaaacttcctcttggagacatttcataatgttgaaggtgcaaagcttatgtgaaaacattggaaactgatctaaacttagaaaggaatatggaatatgacaattctccaaggcacagaaaatattctcactctgtattgtgagttatgtgatagatgagaagaaggtaagtactgtttggactattctagataagtttacagataaatacaatttcaattcttcatggtttttttttttttttttttttttttttttccttgagacagagtttcactgtgtcgcccaggctggagtgcagtggtgcgatcttggctcactgcaacctytgcctcagcctcccragtagctgggattacaggagcctaccactgcacctggctaatttttgtatttttggtagagacggggtttcaccatcttggccaggctggtctttaactcctgacctcgtgatccacctgccttggcctcccagcgtgctgggattataggcatgagccaccgtgcctggccaattcttcatgtttttaatgttttaaattataatacactaaatatagatgttttactatgttttattttcttatacatttataattgacagtaaaacagtttttgttgttgttttggcttgtttttttttttttttttaattttttttgagcatcttgctctgtcgcccaggctggagtgcagtggtgcgatctgtgctcactgcaacctccgcctcccgggttcaagcgattctcctgtctaagcgcccccgagcagcagggattataggcgtgcatcaccatgctgggctaattttttgtatttttagtagagatggggtttcaccatgttgaccaggctrgtctcaaactcctggcctgaagtgatccccccacctcagcctctcaaagtgcctggccgtttgtgatgtttttgatagatatttttagagattatctttccatatagttgtgtcagtttacaccaccatcagaagtttaggagaatccattactattctcttctgataccttgttctgcttatttgcccttgttgacttgctcaagctcttcctctgatacctccttattttaaggaatatacacacacacacaaagaaaaacacatgtttttgcatccttaaagaaggctaaccttttgctttctttgcaaaaactcttcctttcttttatccattttattttgaagtaagtaagacctgctgcctcactttccttaccattcacttcctcttaagtctttgcagtcacttgacagtaggcacctcgagagcagaggtcatgtctgttttattactgaatgtccagtacatagtccgtactcaatactcttcatctgaaggaatgaattcttataaaagcctccaccaaccatctacttggtcctattcacccattcctcctgtctctattatctcttcaccttagctttccggaaatactacaccatctttccatacctccacccattgtccattcccgtttgcattttcttggtttcagctaagataggctgttcattatttatctgccaccttccatgtgcctgccttcgtggaacccttctttatgctgccctttctcctagaagtttgctgtgttctgtcctctctttccttcctccagttccacctggcaacatcacgccatcatttcccccccattcagagccatgccaaaagcttgctctaggaaactctttckgatctccctctccctaaccaccccaacctttctccttctttaaacaactgtagaactttgcaggcggtttgtagggcctaccaaatatgggccactgatgtgctgtttttaacttctcctacccaagtagaaaccccttgagctatctcttattttttccttcagtgtataacagtctttgcgcatcattggtactcaattaatattttattgaggtgccctgtaatctgacattccagggagctttcaaggaaactttgtcacactaaaaaaaattgaggattgttttgtgggttattcygctcctttgtcttctaactcacagaagttctgtcatggttcttaggggttgtagggtgtgtccacttattttaaaatgtcaaagaccagaagagtggagaatgggaaagtggcaaagtgttagcactggaaagatgtttagagatcacgtagtccaacccttaaattttatagatgaataaactggtatctagaaagcttaagtgacctgcctgaaatcacacaactagtttgtggtaacacttggtccaggaggttgtcagctgaccctcttcagggctcgttcccacaaggtaccacagtacatgtgaggatgttaggtttgggtttgtgtagaactgttaaaagaggcatataatattccacatattgcctttaatggattgatacataggaaatccagactctgtaaatagttttctctctctttcccttaataattataatttttatgactaattcatttatactaactaggagagtttctaattacattaacattggatggtatagaatggttggttgacatttgagtaaactttttattaaagtataaaatacagaaatgtatacaaatcacaagtgtatagttggaattttcaaaaagtgaacacatctacgtgactagccccagactggaaaaaagaacagcaccaaaaagtttagaaacatttaaagcaataaaacatttggagaaataaaaggattttaaaactatataaggccaggcctagtggctcttgcctataatccccccactttgggaggctgaggcaggaggatcccttgatgccaggatttcgaggttacagtgaactatgatcatgccactgtaccctagcctgggtaacagagtaagacactatctctaaaaataaaaaataagataaaatattttttaaaaaagaaaccatgtaattttctcttttctccctacaggtattgtcagtatgtgtgttaacaacaatacttggttgtatatttgggttgaaaccaagctgtgccaaagaaggtaattaggtgtgtgtgtgtgtgtgtgtgtgtgtgtgtgtgtgtatgtgtgtgcacagccttattaagaatgtgattgaggtaaacattatctcctattcctatgggtactccatagatattgtcaattcaacgctggcttgagcctttttcctgaagttcttgtattatattagtcatataaagttctacttacaaaacatggccgggggttctgatgctgttgtcctggagcccatgctccctgacttcctccagggactcagaggacattctttactgctcttttaccctaaggagttagttgctgaagcaaccctgtaggttactaggtgacagttaccatccctgggcaaccagaaacctgtcagtwtgtgctcttaaggttctaaaattgcagacattggttgtttcaaagccacaatgatatttttttaaacttctagatatatttttctttccatcaattgcagaaatctatccagcattgacaagattataataaataattaaactggatcacagtaaatcgtagtggttattatcttgtctttgaggtagttccccccccatccyctcgcaataaaatcattgatggtcattctagagaattcagctttgaaaattgaacaggttcttctgtttggctattctgtgattgtaatattaattatttaaaaaatttttagtgattattaagctatcatgtactgttgaaaagtagtaattttatgtatcagtaaactattcagaacacatgtatctaagtttaactgaagtaaacagttacagactttagtgtttacctatgtcatcttttagcatgaagtgattcactcctgagttgacacatacaaattaaaaatgaaaaataacaattttaatccaagcccaacatagtatgcatcatatttttaaaaattattaggtgcatattaatgagctccaagtaatagctattattccaatagacttccctgacccccactccaggtcaggaaagttcgtatttctgacactagaaattattattgttacttcatcttcttaaaattgcctgatttcccagtgtcaaatgagaggtaaattccatggcagtgtctttttgggtcagaacaccattaaagtcaagaactaagattatttcttttttgttgttgttggatgtcccttattttccatgtgttcctttttttctttttttctcattgtcctaattttctagctctccagtgaaacctggcttattcaaggtatctagtaatgaacttcaacagtaaaaaactgtcatgaaaagtactttcctcccatgtctaccatttattcatttagcaaaaatgtgctaatctcaactatatggcatgcacctggctgggttttagggagacagtatgctgggcaaagccagatgtggtcttggtttgccgtctaactgggatattaaccaaataacctagttacgtgtggaattaagtaattgaggggaaggacaaggttttatatgagcttaaaaaaatggaaatcaggcctagctggggagttaggaaagctttttagagggagccagtctggatctaaaggtgaaatgggtgtttcaggtcagggagggaagagctatgccagggagcatgttctgaacaaacccactacttctttacaccaggattgagagtgaggcaggctaggtaatcttttcctttctaaaatattcttaaccacttctaaaaaaaatttttcccacattttgaaattttagggaaccccatgcctgcttaagccaactttttcatagcacaaagtattcagaacaagcctttattctgacttttattttatcacaccatggttatttaagtcttatcagacccagtaacgtttgtaataataatcattaaaaagttatctttctttcctacatcaggagataaaaatcacaaaccaggcacataaggttactttctgtttgtatcactttttgtgtgtatttgtgaaaagatttttgccttactttattaccccatctgtattttctaaagtagtatttgaacctagtgtacacctaacttagttgtattcrttgatgtttactttgaattatataatgattagaaacatctgacttatcgttcaattttttcagttaaaagttgcaaaggtcgctgtttcgagagaacatttgggaactgtcgctgtgatgctgcctgtgttgagcttggaaactgctgtttagattaccaggagacgtgcatagaaccaggtaaggatgagcagggaaaaaagtggagttatggtcattaggaaaagatcaaggaaagttctgtgtctttcaggtatgtgatttacctaattcatttgaattttttttagtttagcatacatacacgttttgacattagcttttatattttctttcaacagttccttaagagaaaaaaatttacagaatttctctgttaaacattttatggatagcagaactttgtctatttttaatgtatgctgaaagcctttgtaatctaatttgcattcaaattctaaaagcctgcttgaaatatagaaatattttcattatggttctttgacggcaagagatcttatatgtccacctatatttttcaaaataaaactatcagaatatgaaaattttcttagttagatttggaattctctgcatatgacatggaataatttttaaatgagagagatttatttatttttcattagtatttattttttaaagacagggacttgttctgtcacccaggctggagagccgttgctcgaccatggctcgttgcaaccttgaactcctgggctcaagagatcctcctgcctcagcctcccaagtagctggaactacaggctcacaccattatgcccagctaatttttaaaatgtttgtagagatgaggtctcactacattgcccaggttgatcccaaactcctggcctcaagcaatcctctcaccttgacctgagagtcagacttagattaaattttagcaggtagaagaagccaggtctacatatgaattgcatatggtaaggtgcatctaaatttgaaaatgacaaaattctggacttttagtgaaataataataattggttcctacatattttaccccattagttcagagtggccatggtagtggcagattctgtgagtgactaagagctgtgaaattgttcattgttgctcatggatcatactcaggaagacagcaattctgtgttcactttggacatgttgaatttgagacataaaacacattttgctgatgtttgtttctagaacatatatggacttgcaacaaattcaggtgtggtgagaaaaggttgaccagaagcctctgtgcctgttcagatgactgcmaggacmagggcgactgctgcatcarctacagttctgtgtgtcaaggtcaggtgctcgttgggctctgcagcagcctggtatcttccagcgtcttagcggggctttacataggtgttatcttttatattaggagtcatggctattggccaactatattagctgaaaaaaataattttaaaactttttattaaagaaacttttaaacatacacatggggagagagagtatgtaatgaacrttayacccatcacccagcttcataattatgattatgtrcacacggccaataatattttatctataaccactcattcccctgccaccaccctctcatgttattttgataatagcagcacacttgatgttgtatttgtggaaagatccctcttacagtcctggctgacttttatgtcccggcttccctcctagtaaatggggacactgtctgctgtgcattgagagagtcgatgtgaaattgtttagaaagattcgagggcattttgtaaggtgatactattatgatgtcttgtccaggtattattattatttttttttcaaatttcttgacagaacytgactctatatgagagagaactaagacaccaaaataccaaggattttgatgagtggatagaaggggagggttgtaaattttggctgaaaatattaagaatttgaaaatggaaaagataccttcaagttctcacaaatacagtagtatgttttagtcttacaattgtgcatccatttttaattcctgatatcaactaactcttattttgaagcacaataattctctttattgattatacacctccagagtcatgtcctgtgttatctatcaatctgttcacatactttgtttttggaatctgtcttaatgtgtctcacaagcatcacaattattattactgttaagtgtgttcattttattttcttgaaaatattttaggtgagaaaagttgggtagaagaaccatgtgagagcattaatgagccacagtgcccagcagggtaagattatattctgaggtattaattttttcttttttagaagtacagcatcatttttttctttccaaattaagatgataaaaataataaaatcactggtttattaaacattacaggttgagtatcctttatccaaaatgtttggtatgagaactgttttggattttggacttttttggattttgcaatatttgagttataccagtttgggcatctcaaatctgaaaatcccaaatgctccagtgagcatttcctttgagcatcatgtcagtgctcaaaagttttggattttgaagcatttgagatgtcagattttcagatttgggatgcccaacctgtatttttagccagatcttgtgtttggcaatggtggaacagagatgattatggagttatccctattctggaagtttatagaaaaaagagaggccatgaatatttagtctttggtattgaagaatgctagataaaaatatttgcattttccttttcaggaaggaaggatctttacttttatttggagtttttagagctgctaaacttgtagaaaatttagcttctttttttttttgtattttggtccatttatacatttttgggataacaacctatttgtgagagatgatacatttttttaaaataattcatatttggtttttttgtccttcagatattttgtacagggtcttccatatatgacaccatcaaaaagagtatgtgtggaatttaaagggtgaagattttataaaggtgttaagtgtatttatctttgttccatttgaggtctaccatctcatacatttgaattactcatcttcagaaatgtatttttacctctttaaaatgatagttttcccagactattaaaatttttaagctgtattttagttcattttgttcatgtatgtaatttttgttatatgtcttcttttttttcttttggaaggaaaagtacttttgatttaaataagcagtagcaacagcagccaaaactaaacctcaaccaaataatttcaacagaagagcctttttttaaggaaaattttcatgtacsctaaactgtcttttaaatccaaggaatactgggaatgttagacttagtgaatttcaaatctttctttttcttctaaatattgcttataatttttcagttgtaatattgaatcttttagtggaaaacataaccctttctttacaagaagattgtaacttaggacacttattattacactggataatttaccagtaygtttaygtgatggcccactaacctgcttttatgatttctgttgattgaataaaactagttttgtatggaccgttaagactatatacactggttctacagagtctctcagtggagctatgttacagatagtagctagtgaaaattgtataaaaatgttctccttgtggggttgcttttgtgtttgtgtgtgagggtaaggtgggaggaggcagagttgaaaaggcaaggtaaggtatttcctgtcaagttttaaatttactgagtaaactttcagtgggaagtctaacagttatccagtgttatasaagttccctaccacctaccatgtatcactagatgctgaaaaatttctgagccatggccgttttggggtagccacatggccattgtccatagctattctcgtttgtcaagtatattagcatcctctgtggtttttggcctcctttttgaaatttccacactacacgttaactgtttgtatatgtatgtatgtgttgttgaaacctcattgatcattcccagctttgaattatttctttgttgtttatatatttaaatatagtatctctcaaacttttgtattaagtatttatatcttttaaatatattaagcctaaaaactaaatacagtatataggcttggtgggtggctcacacctgtaatcctaacactttgggaggccgaggtgggaagattgcttgagcctaggagttcgagaccagcctgggcaacatagtgagacctcatgtctacaaaaaataaataaataaataaattagccaggcatggtggtgcgtgtttgtagtcccagctacttgggagggtgaggcagaaggatcatttgagcccaggaggttgaagctgcagtgagctgtgatagcgccactgcacggcagcctgaggaacagagtgagactctgtctcaaaaataaaataataaaataaattaaataataaaatagtgtgtaatgtatatactatatgaagtactatttactgtattagagtccatatcagaaagtggtggttcaggaagaatatttatggaaatattatatgctgttgttttttattgtttattttcctgcaaattgggaaaacaatattatattttagtagcaattggtgtagcttttggaacagcaggaaccatgaatgatgtttctgtatggtggctcaaaatgatatgaatgcttaatatatactatgtgatgatatatatgtattacgaaatgatagagcttgtatataaatataaatgcatgtaaaacgtactttataagtatgcttgccgactttgttagttagttttcttaagatcacacagaccttagtggaaaatcttcactggacctgtgccaagaagggggtacatcttcattggatatgtcttgtctttgcttctttaaacatttttktttctttttcattacccaggtttgaaacgcctcctaccctcttattttctttggatggattcagggcagaatatttacacacttggggtggacttcttcctgttattagcaaactaagtgagtaacttcagagtttactgctggaatatcaccatttcagtgagattgactaggcaggcagtctttcttggaaaagtactggcagaacctaactgtttcactaaacttttctatggcaaagtagttgaaccttgtgtaaggcgcttatctttaatagtgtgattactctgaagctgcccttcaaaaaaataagttaatatagttatcttcgaattttaacctttggccatttttatatgtatttattctttctcagaattttgaattccttgtgaaaaagtcccttgtttatttattttacaaatattattatttttgagactgagtctcactctgtcgcccaggctggagtgcagtggtgtgatcttggctcactgcaacctctgcctcccaggttcaagtgattctcgtgccacagcctcccaagtagctgggatttcaagcacatgacaccatgcctggctaatttttgtgtttttagtagagacagggttttgccatgttgctcaggctggtctctaactcctgggctcaagcaatccacccaccttggccttccaaagtgctaggattacaggcgtgagccaccatgcctggccttattttacagatattttatttcagaaatagaatttcaaaaactaaaggtatttctgagatattacgagtacagacatagaatatttgtcagttattctgtattatcctttggattgaattggactcttcctttttttttttttttaaatcccaatcaggccttaattaagtgatttttctataaattccccataaaatagtataatggtgttttcttaatattgatgccaaagttttaaatcacgttaacaacctttaagcagctacaatgtaatactggactaaaatagatgtaagtaaatacaattactttagctttttttctggaattctaaaatattgcttaccagatttgagtatgtgaggtgctttaaacattaacatcactctttgtaaattcatatgtacgtcattatgcttgtcttatgaagtgccaaaataattttgggagagttttaaaaatttttagtttttaatttctacatggaagaagatagttttgttttgttttaatgttttgcataaaaagtctttagctttgcatggacaaagctgtgttcttcccagcaggcctgtggcctttgaagtttaaatacagccctttgttggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttacctgttcactctgatggtagtttcttttgctgtgcagaagctctttagtttaattagatcccatttgtcaattttgtcttttgttgccattgcttttggtgttttggacatgaagtccttgcccatgcctgtgtcctgaatggcaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgtggcattatttctgagggctctgttctgttccattgatctatatctctgttttggtaccagtaccatgctgttttggttactgtagccttgtagtatagttcgaagtcaggtagtgtgatgcttccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggccattcctcagggatctagaactagaaataccatttgacccagccatcccattactgggtatatacccaaaggactataaatcatgctgctataaagacacatgcacacatatgtttattgcggcactattcacaatagcaaagacttggaaccaacccaaatgtccaacaatgatagactggattaagaaaatgtggcacatatacaccatggaatcctatgcagccataaaaaatgatgagttcatgtcctttgtagggacatggatgaaattggaaatcatcattctcagtaaactatcgcaagaacaaaaaaccaaacaccrcatattctcactcataggtgggaattgaacaatgagatcacatggacacaggaaggggaatatcacactctggggactgttgtggggtggggtgaggggggagcgatagcattgggagatatacctaatgctagatgacgagttagtgggtgcagcgcaccagcatgacacatgtatacatatgtaactaacctgcacaatgtgcacatgtaccctaaaacttaaagtataattaaaataaataaataaatacagccctttgttaccattatcaggagagcttgtctccatggtgccaaatgtggcatcgtgagtttagagttaagaggtggaggtacctgtatatgaagtttaaaataaatcattaaaccatgagcccaagccctagctttgaataattagggaatgtagcctgtaattctgaactgatggaaggcagtgagatatatagacacatgccaatttgagggacttttttaggcaaatggagtattgaacgctggaatcattagttatgtgttccctcctcaatagtagaggcaggagaaaaagaatgaggcaccagaactagatcagcagggcatcaggaatagtcggacttctgcactttcttggacttgaagccacaagatgccttttgtctttaaagcagctgagtttgtccagggttagctgcttctagatttatggcctgggaccctgtcttcccagctactccttcatccttgttttaatttatagacttagttcagttttcttattctacctcttatgatttaggtatttgaccactaagtagtatcaaagaacttacaagcatcattttattataacttgttcatcttgaatgaagtgatgttatgggtaattggcttaattattttaatgtttttctgactaagagaaaaatgaagtcatctttaagattggatttgtatccacagtgttgctttataattcatcctgaatttttatctgattaaaatccctcctgggctaattttttttacgtgatttagactgctgtggtaccactgctaaatgaggtaagccaattgtcagatgtatttaataacaatgtttatttttttcccttctagaaaaatgtggaacatatactaaaaacatgagaccggtatatccaacaaaaactttccccaatcactacagcattgtcaccgtaagctctgcatttcaacttctatctgtttgaagaagtgagatgggattgtaacattttttgagggaatagatttaagataaaagaaaaacaacttattttccaataggtagttaagtaaggaaacccaggttctgatcyttgctctgccacaaactagctgtggctttggaaaggtcactttactggctgagtctccattttctcatctgtgaaaagagatgactcaagacctcaagaaacgatttcctggtttcctttcagtgttaatattctctgattcttgtatcctagttttgaggcttactttatttgagccaaaaaaccttcccaaactcctgtgttcacaacttgtctttctaatcatcttgatgatgaatttaagcaagccactttgcctgactccaaataggattacaatcctgtttttgtttcagtgtttccagatttaatttgagtcaaataaaacagtagaactcactaagctttagaattgaagccagaaaattagtatgttagcttatattgatccaagctactctgggacctcgccaaaaaaggaatttgttctgcagaaatgctttactcagcaatttaaaaagacaacagcattgttttcaaaatttcagaggctaccttttttttttttgtttttttgagatggactcttgtgctgttgccagactggagtgtggtggtgcgatctcggctcactgcaacctccacctcccgggttcaagtaattctcctgcctcagcctcccaagtagctgggactacaggtgcacaccaccacgcccggctaatttttgtgtttttagtagagtcggggttttgtagcctgcccggacctaggggcggatggggggaatgtgggaataaaagacaaagacaaaagagtatatttggaagaaggggtcagggggtaccttgcctctagtggacaagggccctgagctttacacagccctccatatttattaggcaaaagagatagcgagtagagggcggtggttgtcggctaattgtcagttggccttttggttcacagcaggcttgcgagactacattcttttaacaataggctagatttctcagtagataacttcaaggagcctggccagggagtgaggccctcagcaaaccttttggtggcagggcagtgtgagtttgcccacatcctgcattcatgaaaaacagtttgctgtttgaccatatagcctccatggaatgctgagttggtcatgtcccacgggccttcagctccctgcagggtttcaccatgttggcaaatggtctccatctcttgacctcgtgatccgcctgcctcagcctcccaaagtgctgagattataagtgtgagccactgggtctggctgaggctgccttttttatatagatctttatccttagtattactgacttattttctcctattacataatttaaatcacaaatactacataaaatcttaagaggttgcgttttgccattacctgatttttttgtttttctttccttaaacttattataattccatgtagcttcagttatcggtttctttttgatgatttttttctgtgaatgtatttaacattaartaaacacaacttgcatataatctgttttatcttttttagggattgtatccagaatctcatggcataatcgacaataaaatgtatgatcccaaaatgaatgcttycttttcacttaaaagtaaagagaaatttaatcctgagtggtacaaaggagaaccagtgagttctttgtttttctactaaaakagttaattattctcatctatttcaatcagagtaaaataaccagattctctagagcttttaataactgatttcatttagtgtgtctgtggccattcttttgtaaatggagatgaatgctgataatcctaaacataacttgtataattgcgtaaaaggagagtagtttatttcagaggtggatttgggttgtgctgggcaatttttcttttctgatcaattcttcttctaccagtagcatatagcagtagtatgggggtaatagctttgatctacacaaaactacgttgtttttgaacgtcttggttttatttgcctgtgctaatttaggagcttctttccaattgtgatctccaatttactttccaagctgtgttctcctttttaatttttaaaattctccaattctccaatttacttttttaaattgccacaatttaaaaaaattttttaaaaattgccacaataattatataaggtctatttaaataatcatgatattcctcttagaaggacaaagagcataatagttagtttgcaggttatgaattcaaattttagctctgacatttaaagctgtgtgactttggacaaatcattctgtttctgcctctgttttatcatatctataatgtagataatattgtttactactttgtaggattattgtgaggattatgtgaattaataatgtagcatgcttgtaggaatactatttagaaccatgattggcaataataagtgcttaataaatgttagttacatacacagatatctcagcaagttaaagacatgtatattcgtgaattttttttcttttaagagacaactgttaattaggggaatagctccaaaagctacaggagttaatctctgactatttaatatgttgttgctgcttaagagtcatattacatgattattgtcatctaagtgctgaagcttgttgaccttaaaagcattctagcactagagaggaatgcattggtgtggtatgaatacatactttcctaagagatgaatgtttgcatgatttcttaattttccttcattttctgctccagatttgggtcacagctaagtatcaaggcctcaagtctggcacatttttctggccaggatcagatgtggaaattaacggaattttcccagacatctataaaatgtataatgggtatgtgaaatgaattttttctaggatctgtaatatagaacagcttattcttatgtaatctcctttttattgaatcctgagctttagcatttgagtgatatgttggctgaaaaatgagaactgaagaactctttctcaaagagtttagatagatggtaaatggacagtaaaactagacaagtgggccagctgtggtggctcactcctgtaatcccagcactttgggaggctgaggcgaggggtcacctgaggtcaggagtttgagaccagcctgaccaaagtggtaaaaccccgtctctactaaaaatacaaaaattagccaggcgtgatggcgggcgcctgtaatcccagctactcacaaggctgaggcaggagaatcacttgaacctgtgaggcggaggttgcagtgagccgagatcacgtcattgcactccagcctgggcgacaagagcgaaactccctatcaaaaaacaacaaaaacaaaaaaaaacaacaaacaaaaaaagactagacaagtgttttctagagccttttgagaaacaccgataacgtgtttagttcagatcttcgggcagacatgaaaaatgaggtcatggtggaggtagagatctgggagtgggagtactgcacatcttaactctagaaagaaaaagaactgtaactgcccaacaggttcatcttgcacacttcctagacagattgggtttatcaagacaggagaattgcaatggagaaattgtaattcatgcagagccagctgtgtgggagactggagttttattattactcaaatcagtctccccgagcattttgggatccaagtttttaaggataatttggcagacaggagttcgggaagtggggaatgctgatgcgttggattggggatggaattataggggatcaagtgagtttttcttgctatctcctgttcctgggattgcaaaactggttgagccagatgaccaggctgggtggtgtcagctgatacatggattgcagggcatggtctggtaaatatctcaagcgctcatctgagattttacactagtgatgttattcccaggagcaatttggggaggttcagactcttacagctggaggccgcatggcccctaaactataatttctgatcttgtagctaatttgttagtcctacaaaggtagaccagtcctcaggcaagaagttgtttttttttctgtgtgtgtgttttttttttctgggcggtggggaagggctattaccaactttgtttcagagttaaactatcaactaaattccttcccaaggttatttcagcctatgctcagaaatgaacaaggacagcttaaaggttagaagcaagatggaattggttaggtgtgatctctttcactgtcataatttgctgttacaatttttgcaaagatggtttcagaaccaagagaaggaaaagatgagtgtattaaagaggatacagataggaatgatctctgctatttagcatctattgcgtttgcaaatattattaaaaagaagatattaatggtacctctggatttccatttctaaattagtaaatatgctttctaatgtaagaaactgattagaataacctctctgtgatatttgaaatccatgatgcattgagaaaatacaaaaactttttaatggaagaacctctttggccgatttgagcaagattaccgaaataattttatttatttttaaattataaaatttcggtcacaaaatcaatacaacaatgcatttagaagggtgaacagaaaatatcttaaatcccagacacgaaatgcttagcaattttccttgtgatcttatgctagttagtgttctttatggttcccaggagcacagtgcaatgcctcttctccaccttcttatttgccactgtttttattccatggacagtaattaagagtttatgggctgggcgtggtggctcacacctgtaatcccagcactttggaaggctgaggcaggcggatcacgaggtcaggagatcacctggctaacacggtgaaaccctgtctctactaaaatacaaaaaaaaaaaaaaaaattgccaggcgtggtggtgcacgcctgtagtcccagctactcgggaggctgaggcaggggaattgtttgaacccgggaggtggagattgcagtgaactgagaccgcgccactgcactccagcctggtgacagagtgagactctgtctcaaaaaaaacaaagaagagtttgtgtactaagcatgggggattcaaagattaatmgtatatgatctcttggctttttaagatttagtagagtatacaactaattgtacttggggtggggcaagaactctgattagaggtgtgtaaacaaagcctgtgtccagaggaaggcatattcaattctgctcaggaaatactgcgtagagaactgctgtctgctcctcaggggcctgcttcacagctgtgctgagtcatcagtgagtgagtgcttcatgatgtatgctttgcaaagtatattaacatatgagttattcatgtggtatgcagttactgttttcaggtccatgaatattatcctcaagtagaggatagcaagcaaagttttaaatccaattgcaatttttatctgtgtaaaacctaactttcattctttcattgggaaaataaagttttcaaataaaacccttgatttcaaacacaatagatgcgaaatagcatttagtagctcttaatgacattttcaatgaaaaaaactatattttacacccaaacaattgtcagccatcttttatttttgtttgttcttcattttagttcagtaccatttgaagaaaggattttagctgttcttcagtggctacagcttcctaaagatgaaaggtctgtaggcaattaatttctattgtaaatacttcgttttgtagaaatgatatactattttaaaatagactacaacaaaactttgctatttgctatgatgttttatatcgaaataaattctttagtaaatratcataccacattttgaagaatttcaaagctgtaaattatttctcagtagaactgttacaccagtgttataaaatttaatccctatcaattgatgaattattttttccattctgtttttcaatgtgttcgtaaaatattacattttgatactgtttgatttagaccacacttttacactctgtatttagaagaaccagattcttcaggtcattcatatggaccagtcagcagtgaagtaagtacatttttatcagtaattatttcattaaacccagtcatcaaactgaacctcgctttgaaggaggctgctagaccattttataagattctatcatttctggaaaaagcaagtattatacacaatattactaaatataaggatgcactttaaacaaaataagagttgggagaattgtttagcctgtgttttccacagtgctaaattaaactgatgatcaattagcttctatattttcaatttgaaagcctttatccactccatcgccccttaccttggcctaaatactaagtgctttttgagaatgttataaacagctaaacctccagtgtgaaaatacagggtaataagtcaaatagcagaggaagcctcctatgaactctcttccttaggagataggtctttggccacctgagaccatgcttacaacagaggtcccatagaaggatgggagattttatcaaaagtgtagcgatatttgaatacgtgattttgttgaatatttcctaggaaactagaggtacgaaacagctcatggactaacactttcagtgtaacatctcgtttgacctgacaccctttcaggaacttagccagcgcctagctatgtttttaatctgtgtagcactttaaaacagcaaacactgctttcagttttcacgtggccatatcatttttgttaccattttaatggcaaaaaaacacaattacttttgcaccaacctagtattttggaacacaggaagcattagaacagaaaaggatctgaaggctcggcaccatggctaacgcctgtaatcccagcactttgggaggctgaggcaggtggatcacctgaggtcaggaatttgaggccagcctggccaacatggcaaaaccctgtctctactaaaaatacaaaaaaattagccgggcctggtggtgtgtgcctataatcccagctactcaggaggctgaggcaagagaatcgcttgaacccaggakggggaggtttcagtgagccgagatcgcaccactgtactccagcctgggcacagagcgggactctgtctcaaaaaaaaaaaaaagagaaaaagaaaatgatttgagcatatttccttgtacctctaagttgactttccttctgatatatattttgttggtgacctaagatatgaaaggaagtaaaaagtaaggatcttgactattttgggtcatgaaaaaagtgaaaagaggtattgccaggatccctcctgtcagaatccttgtgtagtgatcttgtgccccctgtgattccaaggggtcatagactattaaaaaaaacactctttcttaattttctagggcttcactcccaaattcctatcagttctcccgcccaggtagcccaggttggatagtcggtgagccttaaggactcttcagcacagcgttcagactaaagcctggcctgacatgtctgtcatggtccctgtttttgagggtgctgcttgcctaattcagcaacagcagaggaaggaagggaggcaaaaaagcatccttatttttctcacttgaatttacaacagctgcctaaaccatcttcccttcatttccctttccctgggtctgcgctagatttgcccctcttaaaaagtaggtactgcttggatcactatcaccttggataaaagagagtgaagagagaaggaagttgaccctcacctaggtctgtttttaccctttgtattctttccatcaaaatccatctccagcagctccactgtagttagtaactccattgtgccttcctttcattctgtccttcaacttggcagaaatactcctgcttagagggaggataaggaagatgcatgccagcaatgtggacatgtcataattggtcaaagggaaaagtttcttgtagctgttgtcttgatttgaacaattggctacatgctagtgtgatttttactctttcactaaagtcactgatacccaagacttgtgtctgggtcaatttggctacagaaaaatcccaggatcattttatacttgtttataaggttacatacatttgaaaatcattgctgccttttctaattcactaacagtgtgccaaagcacttgcttttctgagtcatcttcatttaaggttgagcccattacttttcaaatcatatccatcaatttgcaaactctgtgaactccaacattactggcacaccaaaacccactttatcttaatacttaaaaattccagttcatgttgcttggataactttgaatgaaagacgttgtcttgtttcatgttacagtgaaagagcttatctcatattatagtgaaataatactgacaatgaatgaagattaagctgattccacacattacagaaaatacacaaaactgcacaaaaatttttctcaaatggttttgcaaggagagaggataaaataagtgccagaaagcagtttgccaatatcatttgtcattctgtgttcttgtgatattcatatgtaaaatacatgcagtttgtaaggaaataatgggttatattcctatgagttctaatttagaaaattaaatacattgaattataagaagcatttcatgaataatttgaacatttttgaaaattaggaaacatatttatacagtgaccatttgaatgatcagaaagtataagaagaaatgaattgtggaaaatgaagtggtaattaagaacatattggtttctggccaaacactgtagatttgagctattattattttggcttaagttgggtctaatctaagtagtagcattctgacctcaggaatagatcagctaatctcattcccaaaacttaaaattgaacgtgtatagaattaggactcttgcattgttaatgatctgcagttatttactgttctttgtatctctgaccctgacctgtcttagtctaatgtgaatcagctcattgtagttgcatccactggcccttatctatctatctgtctgtctttctttctttctttgtttctttctttttttttttttttaacagagatagctttatgtataaatagccattagtgtggaaggtatcacatgaggttgttgcttcccattcttaggtcatcaaagccttgcagagggttgatggtatggttggtatgctgatggatggtctgaaagagctgaacttgcacagatgcctgaacctcatccttatttcagatcatggtaatctgaatttgcattatttactcttcaggataaagggctgaagaaagtttacttgatggtttcccaattttttctgaatgttgtagttaattcttttttaaaaatgtagtttcttatggacagtctttaggaaaaaaatacattaaatataaaatataagtgaaacacagaattcacagaaacctaagtgcctatcaagcacaatacaccaagaatttgaatagctaaaaaatatatattttcaacattaaatttgtgtaactctacaattttagatttagttggaactgattattatagcttcaatttcctttttttgttgttgtttttgagacagtctcattctgttagccaggctggagtgcagtagcatgatcacagctcactgcagcctcaacttcctgggctcaagtgattctcctacctcagcctcctgagtagctggaactactggcatgtgccaccacacctggctaattaaaaaaaattttttttggtagacatgggatcttgctatgttgagcaggctggtctcaaactcttgctctcaagctcccactgctgccttccaaagtagtgggattacaggcattagccatcgtgcccagccttcaattttctttagcttgataaatctgactttagaagcatgatatattaattttgataatattttcacttttacttactgtgatctttgtaacacgcttgtgtacagtttggggactataggagcagcgtgcctatggaaaatagaaaataggttctttttgtttttgttcttgttttttgcttcagaaataattatagaaatctgtgtttagaagcagtcctaagaagttacatgcaaagaagtaccagtcttggaatgagagtgaatcatacacatacactcccagttaatatcctaggtggtttggggcaaataactgggctttcacattcggtctaaaaatgtgataagacattcttctttgctcacataatgatattgtaatatataaataagaagaaacattaaccaaaatttgggtgacggaaaagattttgaaaaaagtgaagtgataggtacagctgaaattctgtcttacctatcagatcttcaactaatatgagtgctacacccatgtttaacgaatttaaccttggaagtgaaagaagttctgctctgcatattaaattttttgttaaagttacagcatgttttgggattttttttttctcctaggcatggaacaaggcagttgtaagaaatacatatatctgaataaatatttgggggatgttaaaaatattaaagttatctatggacctgcagctcgattgagaccctctgatgtcccagataaatactattcatgtaagtatatctctgtgataactttgaatatggtcatattaagaataccttcctttaggccgggcacagtggctcatgcctgtaatcgcagcactttgggaggccaaagtgggtggatcacctgaggtcaggagttcgagaccagcctggccaacatggtgaaaccctaaaaatacatatacgatactatactatatctatactaaaaatacaaaaattagcctggcttggtggcagctgcctgtaatcccagctgctctggaggctgaggtacaagaatcgcttgaacccaggaggcggaggttacagtgagctaagatcatgccactgtactccagcctgggcaactgagtgagacttggtctaaaaaaaaaaaaaaaaaaaaaagaataccttcctttaaatcattatatcgctaaactaaagggaatcacagttaatttttttatgattaaatctccaatgcagagcttttgtacacaaatggattttatgggactggatgcgagaacacaacttacctattggttattcatggactaagcataatatttgatgagcttagtgcaattttatgttgaagtgtgtgttttacttgtgtgtcaggataaagattatactagaaaaaatgtttaagagagaaatccaactacatttattcaagtttaattaattaatgacactccattaaaattacttagtttgggattaatattctgttgtgaggaggagtgctggcagaaatgattaattctataggcaattgattcctgtcctcccttaaaccatttcagaaacaataaagaatgtatcttttacatagggaagaatgaatttcacatctcttgaccacatgtggaacataaactgccaaaagatgttttaaaatatttattcttttgccagtcaagtgtatttcataactgtttccacctctgttacctccctctctttttgattaccatccatgataactttcagatgtgtagagcaaattttgtttgtctttttgatatgatatagttagttaactttgaaacagaaagagaataagcttttctgacaattaccggaattgggttaggttggtctatttggtaagatatgtttcaatagatagatactattgactattaatgaagaaaatagatttcactgcaggaaaatggttatgcagatagatttacacagtgtcacaaagcacaggctgcatatgcctaataccaagttttaattcgtatttttttaatttagaaaagtagtacatgactgttataaaacctgttataaaaactatacagatagactggacacgatggtggctcacgcctgttattccagcactttgggaggccgaggcgggcggatcataaggttaagagatcaagaccatcctggccaacgtggtgaaacccgtctctatgaaaaatacaaaaattatctgagcgtggtggcatgtgcctgcaatctcagctactgggaaggctgaggcaggagaattgcttgaacctgggaggcagaggttgcagtgagctgagattgcgccactgcactccagcctggtgacagagagagactccatctaaaaaaaaaaagctctacaggcaatagcagtctccagagatgtttgggatgggatagctaagctgtaccatacccttatcttaggccctcaagtttcccaaattaaagcaaaaactatatatgtatgtcactttacataaatatataaaatatatgtatataaaatgtatactcttatctggataattttctcaaatttatgtaatgtttggctaaaataaaatctaggaagctagacagttattgatttgtagtagaaagtaccctatgtaaatccatgggcatactatgcaaatgcagtttttaaactagtctacttgccttctctttgaagtttcctcatacccctcttatttgaaaattctagaactatcattgaatattgaagtatacaaagtaaaaagaaacagcttcccacctgaagtcctcctacttgacaactcatttcccctctctagaaacaaccgttgttaagcttggattatgtcttcctggataattgagatatttgaataattatttttgttgttgagtatttcctagggaacaagatgtacaaaacagccttacaaaacacatacagtttttatttttacccagtgaaaccataccagatctagatggatagatattttgagggatggatggatgatggatattggttactaactggatggaaagatggttggacaggtggatggatagttaggtggatgaatggatatgtgggttaagagatggatggataggtagatgttctgtaacttgtctttccctttawcaatatgacactatatcatgggtgtcattacagggtgatccctaaaggtctgtctaattcctttcagtggctacaatgtaatgacttaaatgaactctttaaaacctgccttggtatttaaatgcagagtttggatctgacattctatatttttgtattatgttttaattatagtatacaatcaactattaattcttatgtttgttcccctccagttaactatgaaggcattgcccgaaatctttctgtgagtatctttattttccattatctagttatttttacttttgtataatatayattgagagaaaagtttcagcatctattattgggattgaaggattagaatattttagtaatctgggccaacatggaaatgctgtgtagtttaaagatctttmaggtcgtatcccaataatccaggtttgaaaaatttttaagaatttgtctattggcattataaaatttatatgagaagaagaaataattttaaaactatttacaagaaataatttttaaagtagaaggaaaaaccctgtagctgtaccaccataaacaccattagcgttatgatatatttccttccagtctttttttatgccttaaaaaattaagtttctgtactagtgctgagttatctatactacattttatactcatacattttaagtctgcaagaaaactcttacaattgcacttacaaggatgtttgaaaatagaaccattagtggtaacttgaatataatctagtgacactgagttctggggcttttatgcagtaataattatgatttcctctaaatatttcaagtagtttggaagatttaccttgtacattatataagtggtttatttagctgttttttcatctgacttattgggccagctgatgaaatgtttgtgaaaaaaaatttcatatgaagttagaaagcaatttcaagaaaagttgacactttttatagatattagggaaatatctttccctaataaatatctttccctaaaaaagttgacacttttttagatattagggaaataatagtttttctttgctgtttgcaatttcagtgccgggaaccaaaccagcacttcaaaccttacctgaaacatttcttacctaagcgtttgcactttgctaagagtgatagaattgagcccttgacattctatttggaccctcagtggcaacttgcattgtaagttctgacagtctcccaggtaaacttagtctgatcggttagtgattcagggtaaccattgggccctttctaacaatattgttatgtgaaaactgtataagtatgattctcttcactctaacccaggatttctaatgtcggcctatggatgtttgagttagataattctttgttgtggagagctgtcctgcacattgtgggatatttgacaaggatcctttacttctccccactagatgaaagtagcacttcttctgtaatgtgacaaccaaaaatgtccgtcagcgttgccaaaagtcccatggggaggaaggatcacccagaccatccttggctaagaaccattgttctggcttttcatatacatattgattacttcttacaatctacatttgttactgcttgccattgcatgtctcctgcacattacagtatgtctaattgtgcctccaaagcctagccaacagttggtaaaagcactttataataatgagtaactatcttcattatacacgttgttttttcattcttcttatactaatccatcaataaactttagtttattggtgtgtttggcaaattatttggatggttaatagtgttaatatctcacaacttgttcattaactgttttggtggttgccaagaagctagtcatgatacatacccctgtcaagcaaaacctaagcagtgaaccaaaattcagtaaacagaattatactgtctccactcttattggagagctgggcttttagttttcaaaaaatatatatatatatgaaaggagaaatggtcctatcttcatgagagaactaatatttagtaaatatctaaacaccatgttgcaagcatttctttaggctatatcattgaatttttacaaataaccgacatgagaaattgaaatcaaagaagacagttaaatctatctaaactcacaagtagttaatcacacagccaatgttcaaaaccacttctgtcttgatgctagtggtttttcttctgtctactatattgcttatagttaatttgtccatgaaataaaagatagaggtgacttcttaatgcttttcaaagccaggtggttttatttaccgttgtgttggtttaacaaaatagttacatactttttaatcaatgaaaataatgttatgattatcaattatgttttatgaaaggactttacatttttaattcatatatgtcaacattaggaatccctcagaaaggaaatattgtggaagtggatttcatggctctgacaatgtattttcaaatatgcaagtgagtaaacctattatacttaattggattaaatctaaagaaaaaatgatatgcaaagttttagacttgaaaacatactgtgattatatgtcttgaatgagaattaatggaacatactttcataaagctatttttctttgaacattaaagaattttgttaaagttttatattcattggctattactaaaaagtcaaaaaacaacagatgtagtaaggatgtggagaaaagggaacacttatacactgtcaaagggaatgtaaattagtacaacctctatggatcactgtatagagatttctcaaagaaataaaaatgaaactacccctaatctagcaatcccactactgggtatctacccaaaggaaaaaaaataatcagtttatcaaagacacctgcactcgtatgtttatcgcagcactattcacagaagtagtcatggaatcaacctaaatatttataaatggatgattggattaaaaatgtgtgagatatatatatatatacacacacacacacacataccatgaaatactactcagccataaaaaggaatgaaatcatgtcctttgcagcaacatggatggaattgggggccattatccttagtgaaataactcaaacaaaaagctaaaaatcacatgttcacttgtaagtggtagctaaacagtaggcaaacacggacatacagagtggaataataaacattggagactccccaaaggtgggagggcaggaggagtgtgagggatgaaataccacttattgggtacaatgtacactattctggtgatgggtaacactaaaagctcagacttcaccactgtgcaatatatccatgtaacataactgtactcatacccctaaattcataaagttaaaaaattaataaaattttatattcatgtttcataaacatatgacatatctcctattatatttctaataattatttttcaaatttttgtgctctgttgagagtattgctttacagttgaagaaaaccagtgctataatagataagaaagtatcagacttatgttctgagaaggataatatcttacatttacccagcactttaacattttcaaaataaacttacaataattatttaatttgatccctgcatcactgtgtaaggtgggcaggatgaggtttatattgcatgtcatagatgaaaaaaaaatgttatcattcattctgttctgattgtcaaaccaagaattgtagtaaaactaagagacctatcctagatgtccttagattatgtgtgtgatagggttaaaactatatttcccacaaagtccactgagcgtggtagttttcctcttatcttatcataaccagtttgtatatgtacaatgtggataacagaatttttgggaccaacttgtagacagctgaaatgcactgataaacttccttttctggccatctaggccctctttgttggctatggacctggattcaagcatggcattgaggctgacacctttgaaaacattgaagtctataacttaatgtgtggtaagtgtgaacaggtgccttttttcccttctgaaaatagacctgaaataggattatcaaaagcaggtcacattgtaggcaactttgtggagatgatggtgaggcaagacagatttttaccttcttcctgactctcagactcactgaagaaatgtggggaacatgtcatcttattacttatctgtttgttccactaggctgcttgctggttaaagtacaccactcacagcagggtggtctgcacacccccactgcccagcactttgctaggccctcggcttagtgatttgattcttgactcagagcagtgatagaagccagaaaaaggagattgagggcagtgaaaggtggacaaaacttttggaacttctggtagccataatggttgaatataggtcagtgtcaaggttgcagaaatgaaggaggacccattagggagattcttggtttactttgtaccttctgaagtagtccttttgtgttgaagcattgtgtgttttaaatattagtttcttattctgataatggtcctaggcatctgcaaaaccttaaatatgtcttaagtataattcttttagtgggagtctatatagtttaaatgagttaatgtatcctaaaatacttaaaacagcagctggcatatagtaagtgcttactacataagtatttgctgttattacatttaagagcatgagtcttagactcagacaaagctggttttgaattctagatcatttagttagtaactttgagacttgggtaaaacactttgattactcatctaccaaatattgatgataacttataaaattgttttggggaataaataagaaaatatgttagtaccatgattggcaaaaatatgcattcaacaggttgtgactgtagttattgtatgctttaaatatcagaaattttgtagtgaaatacagcatacatatcagtatttctattaaaaataacctagtcttaaatactctaaaacccaagagagttttatacttttattttagttaaagagtaaatgactcatgtatttggttttaaaaaagtaaagatcatggcacaagtctactatttgtttgatttgaaacatctaagtaactctaccatcttgaaattatgcagatttactgaatttgacaccggctcctaataacggaactcatggaagtcttaaccaccttctaaagaatcctgtttatacgccaaagcatcccaaagaagtgcaccccctggtacagtgccccttcacaagaaaccccagagataaccttggctgctcatgtaacccttcggtaagtatcgtcaagaagtttggtccagtatgtatggtttgatagcaccctctgcatagcatgtgctgtaaaaatacttaataatyaaattagaatttaggagtgggggtaggtaaacatatgtttwaattctagggggcrcatgtagatcttttgtgatatatcttttctctttctagtttttgcattttccactctatttttaattcyttggagctgtgacttgacttgggtgcaggtgtggtgaagtctagttagttgacttgggtacgggtgtggagaagtctagttcagttcttgagcatcctgaattagggaatctgtgctgttaactctagcagtgaggtgatgagcacatagtaaaccaatcacaatgtacctttttaaaaatacaattcagattgtttaaatgtagggagaaaaaagatttyttggtatgaaatgaatatattacactgtccttttttacttccatgttaatatgtcattattataaaaagataaaaatactagacaagttatgaacaaaattgataacatccatgagggcacctgtaatcccagctacttgggaggctgaggcaggagaattgtttgaacctgggaggcggaggttgcagtgagccaagatcacaccatcgcattccagcctgggcaacagggcaagaccctttytcaaaaaaaaaaaaaaaaaaaaaaaaaaaaawatatatatatatatatatatatatatatatagcaatttggagagtagtttatttcatgctttacattttgttttagacttgagttagaatagaagaaagactgttggggtatatagatgagaattataaagcagcaatcatattcttattttttaattactggtgtgatgcttatactaacaattttgtcttttgcaactgtcattcctctccttctgtccttttcatcaaaaatgtaacttctgtccaggcatggtgtaccacacctgtaatcccagtactttgggaggccgaggtgagaggattgcttgagaccaggagttcaagaccagactgggcaacatagtgagaccctgtctgtacaaaaaactaaaaaaattagctgggcatggtgacatatgcctggagtcccatttacttgggagcctgaggtgggaggattgcttgagcccagtaggccaaggctgcactgagtcatgattgcaccactgcacaccagcctgggtgaaagagcaacactcttgccttgaaagagaaaaaaaaatccactaatacaagactatcataaatgatctttgttctatgttggaataatcaatctatagcggttctatgttacaaaatttaaaacatgtctctcagtccttaaaaatagttttataaccttttttagattttgccgattgaggattttcaaacacagttcaatctgactgtggcagaaggtaaggcatgctacacactcaagctcggaatgtgaagcaggcattttctcatcagtgtgaaatgcagagaactggcttgggggtattatttgagaataaccaataaaataaagggagttctggaggaccacctgatgaaacatagaggtttctttgcttgacagtttagactattaggcataaggaaaggagatattttgcagtggatattgtatgtaatgtatttagtggaagctgaatcacaccttgtgaacatgatggaggtgttcaaaaatttttgatgatttctgtaagttgataatagagactgagattcccatttgaaatacctaagtttctatctcacctggttcttaatcatacaaggttatatattgatttattgatctaaagttatttctgcatcacttttgaccaaaaatcaaggatacacagacaactgatgaaatttttcacttatgacttgaatgtttggagtcactataatacactctctcagccttaagttacttggcacacattttttttctactagaataaagaggtaaattctgcattagttctgatgtaagtttgtctctataaaatccctaggtaaatgctggagttaggaaaatctttgatatctccaaggtggcaaagtattgtggtgaatgatggcactttcagaattgagtagatccaagtttgaatatgagcttaggtactatatgttcatggaaatagtattccctgtcagctgctgtttccttatctgtaaaatgggcatataaccttaattcatagggaaatgtaaaaattagttatatgatgtgtaccaagcccttgacatttggaaaaagggcaataaataatatctatattgttattgttttatttagtttagtctcataatttcaattctgaacttctgctttccaagtacacatatcattaaaaaaatttgctttctggagtgtgtcctaaagaataagtaattaaaatagtgcttaagaatttttggtaatataactttgaattaactggaatatttagcaatttcatatagtgtcctcatggtatcttgatattacattgatttcagaatctttataggcaaaaataacagtgaacctcacttgtcttcttaattgtttatgcttctaccctttgtaatcagtttttttaatagttaaaagtaaatcttcaatataattaagtagaggaaaggattagatgagtgtatcacactatatattatcatataatgcacactaactacatttattttcatcctgtgacccaagagaagattattaagcatgaaactttaccctatggaagacctagagttctccagaaggaaaacaccatctgtcttctttcccagcaccagtttatgagtggatacagccaagacatcttaatgcccctttggacatcctataccgtggacagaaatgcaagtatttgtcacctctttatgtgtggccatttcaaattaatgattaagcagaacattaaatgcatagtttctcactgttcaccttggctttatactcagttcccgcattagaggaacactgaagagggagtcagaaaaattcagttccagttcaagctctgccactgagcagctgcatgactttgagaactcagaccaaatttcttctgtgaaatgagggtcgtgcagtaaagattctcttttgggctgtgcgcagtggctcatgcctgtaatctcagcactttgggaggccgaggcgggcagatcacgaggtcaggagatcgagaccatcctggctaacacggtgaaactccatctctactaaaaatataaaaaaattagccgggcgtggtggcgggcgcctgtagtcccagctactcaggaggctgaggcaggagaatggtgtgaacccgggaggtggtggagcttgcagtgagccaagatggcgccactgtactctagcctgggtgacagagtgagactccatctcaaaaaaaaaaaagaaagaaagaaagaaaagaattctcttttcctccccgaccccagttttaatattttatgattccaatttataattgcatgaaatcagccttaggatcagtcacagttacccatttctaaatacatggctgtgtgaggacaagtatttccctcagctgtccaaatctaagggggccctcactgtttggcaaagccattaaagctcagtaacatcattgcacgtaccatctataggaagacacgagcccaaaccagggagaggccagaatcctgcccaccaccaacaccagaggagttaggccttgaaaggagtgagggcaaatatcccagaataagagcagccttccccctcacccatggccccctgggtgctctggtagaaggaggaatggtgaaggagatggtgctggaaagagagaagggggaagatgagattttgatcttacgtggaattgaaattttaaactgggctgaaactgaaagtgactggcaaggtacaggatgccctaagggaacgacaaagggatttgagagagcatagtggagggcagcagtttgatttaaaaaataaaatgatttttactaatcagtgagacaaccaaataaaaagatagggatatgtctgtttatatataatttctatgttacaaatatataatacacacatatatttatataaratttcttgaactttgatttttaaaatttttcaatactgtcttcaaacaccaaacacttaaaaaaatttttgactttgtaattgatcagtctacaccatttttcataggcaccccatcctatttattaatatttataccttaattatgggttccttgattccattttcagttttcttatgtaattaaaatgcataactttacagtcattgcgatgcttgaggtttttacattgctgttcggtgactgtcctcctttgctccagcaacttttggcagtgtagttgactatggaagatagactcagatctctaaaaatcaacattttactatataaaagcttaaaattgaccagcgcggtggctcacgcctgtaatcccaacactttggggggctgaggagggcagatcacgaggtcaggagttcgagaccatcctggctaacatggtgaaaccctgtctctactaaaaatacaaaaaattagccrggcgtggtgggtcacacctgtaatcccagcactttgagggggctgcagcggatggagcacctgaggtcaggagctcaagaccagccttgccaacatggtgaaaccccatctctaccaaaaacacaaaaattagccaggcgtggtggcagatgcctgtagtcccagctactcgggaagctgaggcaggagaatcgcttgaacctggggggcagagttgcggtgagccgagattgcgccactgccctctagtctgggtgacagagtgagactccatcttaaaaaaataataataataaataaataaataaataaataaatatttaaaattgtgtagataaaatcattctaaacattatttcatattagcatagcagaatctgaaaatatttgcataaatatgacaattaatatctttaatattgtaaagcatttttacactttagttagaaaaaaagatgaatatactagtaggaaaatagggaaggacatgagctgacagctagagcttcataattttatgatgtagttcacctttaaatattaataaagcarttttcttctctgtgcctgatatctgagagttcttctcattttcgttcttcaggacagtttctctacggaagacttctccaactgtctgtaccaggactttagaattcctcttagtcctgtccataaatgttcattttataaaaataacaccaaagtgagttacgggttcctctccccaccacgtaagttttttcctctcctgaccttcccttttctcctttttgttttctttcttgtttataaatcctaccatacattatagggtaatatatatattacctattatatatatataaatattacctattttatatattatatatataatatatataaagtatatatattactattatatatatatagctatatatatatagctttgtttatttattggtgaaaaattgtggatttggtctagaactaccaagggaaaaattttaatcatctaaaacttgaattttataaaattttctttttgttgggagggtagttgatgtagtgcagatatggtaagcagaacacttcatggttcctttctgcatttcttttaaacaatttgagaatattgtgaaggtggaatatatatatcaagttggaagaatatatcaaggttcttaggaagataactttgttaggataaataactttsttgtttaaaaagaaaatgcgtttgtcagagaagtaggtaaaggtagaggcttacatatgcttgctttttcactgatccagaatctctagggaatggcttttttgaagctaagtattctattttttgaaatggcaaatttgtatgttgatgagaagccattttggggccagccttaaaaggcaaaaatcagaaagctccaggtgctcaactaccgtcagcatccagttcagttcccagagtatgtgtctgaagtcagaacttggctattgcattataaaaatagaccaggtccaagcctcaaattcatacagagaagccttgtatggtgtttcgagacagacatcctgtgatgttttttctgggtagcaggtgttgttctggagccagatgttctcttttttcttttcactgtgaaaaagtgtaaggaaagaagattgtcaacacaattccttttagttgaaatgagggcaataacgtttgaatatgtttaatttggggctcttgttattaaagtttatgtttcgttgacatgctsatcttgaaaagacttcttaaatattttatttttgtaaaggacttgaccaaacacattacattttcccttgaccctgtacttgggaaagttttacaggtttaagatggtactcagctaatttttaaaaatgctcccctaaccatgagaaactataatttcctatgttatttgtgaagaatgaaaaagttgtcctcttttctctttgtagaactaaataaaaattcaagtggaatatattctgaagctttgcttactacaaatatagtgccaatgtaccagagttttcaaggtaaataatgttaactctatatttgataattttaatgaatttgtgcacatataggcataattcatatgtaataggacttatggtctaaattaaatgaattaataccaaatacattcttaaaggtttaactttgagaatactagtacacaaaaattctacaaattattagaattatcatgtattctaattgtataattgtttgcaaacagttttggtgagaaagtatgtgatgcgcttcctaaagttatccagctaatacagtctgctaacacttatattaactttcattcggcttccttatttaactttttggaagttcttgataattgtctatgttttcaaatgaatagattttacatcatcattaactattgcagcatttgacttttacaggaataaaaatttagttacttaaattgatgtatagaatatcaaaatataagcatataaggagtttttagtctaatttatatctagaatacttgtgaatatttcaaagttaatattcagatattaataggaaatcggaataatatgccttgtttgtgtttgcgatgttgctatgcttaatgatgacatatgatcacaatttcaacatgatgtacttgttcagggatgtctcaaagagagttgggttcaacgtttgtctgtgagtcctttcaaaggccaaagctgaacaatgaatttttggcctcacactaagattagagccaaggctgggtgtggtggctcatgcttgcagtcccagccctttggggagtccaactcagaaggactgcttgaggccaggagttcaagatcagcctgggaaacagtgagatctggtgtctagtctctacaaaaaattttaattagctgggcatggtgatgtgcacctgtagtcctagctattctggagactgaggcaggagcatctcttgaccccaggagtttgaggctgcagtgagctatgattgtgccactgcactccagcctgggtgatatagcacgactctgtctctaaacaaaaaacaaaacaaaacgaagactgaagccaaacttgactttatctttatttactataaatgctaattttgaatcatggtgttaatttatttcacacgtcaacatggtcccttgttcttttgaaactacactggcttctatcttgtttcagttatatggygctactttcatgacmccctactgcgaaagtatgctgaagaaagaaatggtgtcaatgtcgtcagtggtcctgtgtttgactttgattatgatggacgttgtgattccttagagaatctgaggcagtaagaacatatttcattactcttaaaaataggaattaccatccagtagaaatgggattaccatccagttgagtcaacagaaccttttttatccagtgtcgtatgtttatgtgtatgacacttctgactacacaggaagcctcttgaaatatctgattaattttgatgttttgctcaatrttcagtaaaatatttttaggtaaaaaagtagtgtttctcacccattcagttcagttgaataatttttgcactcagtttaaatgctgaactcatttaagatctctgtgtggctgattgttaagatatgatcttaatatattgtgagtcagaagatgaagaactctatggtgtggctacagatatcctgagtctaggaatgaatagggttataaagctgcagtgcttggagtctggtggccttgggtgaatgttatggcttttacccaactgtggctggaggggcatgataaaaagcaaccgtctgaaggaaaccatcagtggtgcttttttaaaaaagagagggaaagaacatcttggaaactggttgatctttattgaaacaataattacagcagtttgggaagcaattttgctgttaagtccgtaggaaaaagactgagattccactgagattcagcccctctcagaactttcctactctcccaggctgacttagatatatgtgacttacaaaatacatcagaaagcacatcaatttgcaaagttacagttttttactttcccttgaggcataaagctgccttagaagctgtagcactggagaggatacagaagagaactgcatatgcttcctacccacggcttcacccagagccctctgtttaaatctgttttatagattatgtttctacataaggtcatatttgaaaacaatgattccactgccttaaattttgaaagatgttgaaaaaacaaacacagccttaaaataggagaatgactatgaggtaaagatgtttgggacatctttgataatatacttcagtttaaaaaattaagttattaaggaagaaaatccagttagaacaaacaattcatgacaacatgtcctctctgaaggggctggaatagaaaattcctaaccagttctttctctgcccactatttgtctataatcgcctagaagttaagactatcaataatggtttacactcttggtcataggtgttcaaaaatgacattttcttttctttagtgtttcaatttcaatgtctttaggtagaactaaaagaattctaaaagtcaataaacttctacagaaaataaaaattatttggagtgtgtttatctgcctgtcttctaattattgctctcaatctggcagagtatgttgaggtattgtgattactagcttcttatatttaattatttgtttgaatttgatttttatatgtattmaaagcatgctctactgaaatattcatcaaaaggaagatagttatttctttcttaaaatgaatattggcatgttttacagaaaaagaagagtcatccgtaaccaagaaattttgattccaactcacttctttattgtgctaacaagctgtaaagatacatctcagacgcctttgcactgtgaaaacctagacaccttagctttcattttgcctcacaggactgataacagcgagagctgtgtggtaagtagcttttgtatatttactttgcatgttgaaaatctagacatatgcatatttgtttatgtcacccatctgacattacagtgagagaaagcacaactgagtacacatggacttcgaaattataggatgcttttaaatttgatcttttaagatgacatatctttggggaagactacccttgtctgcttttacttttttcttttttttttttttttttttagagatagggtctttctatgttgcccaggctggtcttgaactcctggcctcttatgatcctcctgtcttggcctcccaaagtgctgagattgcaggtgtgagccaccctgcctggcccctttgtctggtaaagatactaaaaatcagatcagaatcaaactttgtatggcttaaccactaaagtctaggtttatctgaagtatggattttctctttttttaaaactggatgtataatttcaaagtgtcagcactgttataaattaaagttgttagacaacatttcaaattttctgtgtatcacttaattataaaaaatcttttcctttcttatcgtattgtcatcccagtgtgtttgggaataattgttttatattatcttatttgctcagaattttaaaaatctacattgtagattgggacatcaagactgcataacattttagcaattattttttttttttttgagacagagtctcactttggctcccaggctggagtgcagtggcatgatctcggctcaccgcaagctccgccttctgggttcacaccattctcctgcctcagcctcccgagtagctgggactacaggcgcccgccaccacacccagctaatttttttttttttttttgagacagagtctcactttggcttccaggctggagtgcagtggcatgatctcggctcactgcaagctccgccttctgggctcacgccattctcctgcctcagcctcccgagtagctgggactacaggcgcccgccaccacacccggctaatttttttttttttttttttttagtagagatggggtttcaccgtgttagccaggatggtctcaatctcctgaccttgtgatccacccgccttgtccttccaaaatgctgggattacaggcgtgagccaccgtgcctggcctttttttttttttttttttggagtcttgctctgtcacccaggctggaaggcagtggcgtgatctcggctccctgcaacctccgcttcccgggctcaagcgattctcctgcctcagcctcccgaatagctgggattacaggcacctgccacccatgcccagctaatttttgtatttttagtggagatggggtttcgccgtgttggccaggctgttctctacctcctgacctcaggtgatctgctggccttagcctcccaaagtgcgggggttacagtcatgagccactgtgcccggcccattttagcaatttttaagttttctcttatggtgagccaaaatatatttctttcagagtacttcctacatttccttttttttttttttttcattgaagtgacaccaagtaagtctaaacctgaatctgcaaaaagatgtagctttcataccagtcccaatgaatgggtggtaggtacctggagttaggatcttgagacccagtatgagctcagcaggaaagagtgctgtatccactcattcattcactactactttgattcaccattcattcctttgatatttataatcaggtgctctaggtactgaggacacagcagtgaacaaaatagtgagctcttctctgggcccaagagtagaatacaatgatccgtttgccatccctgatggtagtagtctttcyatatatcgttaaaattcatgaagatatgtctctccttaattgtttctatgataaactttcagaattacttgttcctatagaacacatttctcattatttttccctttattctttrgaattaaatacagaatagcaagattttagttggttgcctgatgattatctgactccactgaaagttgtcagttttgtgggcattgttggaaacatgcagctattccctgcttcattatttcgtttgagagattatattgtcattgaatgtatcaattagagtagggttctgcagcaaataacagaaacccctttgcagtggcttaagcaagtcagggattcctcatggaacagcaagtccagctgcacacagtcctgggatggcgctttgggtcaactgcaccattagggacccagaacttttccctctttctgctccaccattcttagcatgtggctttggcccacgtgggcttcttcatgcatctttgtaggtaacacattctcataaaaactagtatttgtgtagtacatttgcacacatcattacgtttgatcctcaaaataacccgatgaggaggatacagataaaggaatcaagacttatatgttaaataactttccttagtttacctgatacgattgtcacagaaccagcctcttttaaaaaaattttcaacttttaagttcaggggtacatgtgcaggatgtgcaggtttgttgcataggtaaatgtgtgccatggtggtttgctgtatggatcatcccgtcacccaggtattaagcccagcatccattagctattctttctgatgctctccctcctcccaccccctgccctccaacaggccccagtgtattttgttcccccacacgtgtttatgtgttctcatccttcagctccctcttataattgagaacatgagggttcgcttttctgtttctgcattagtttgctaaggataatggcctccagctccatccacgtccctgcacaggacatgatcttttatggctgcatagtattccatggtatacatgtaccacattttcttaatttagtctatcattgaccatatacaccatagtattccatggtgtgtatgtaccacattttcttgatccagtctatcattgttgggcacttaagttgattccatgtctctcctattgtgaatagtgctgcactgaacatatgcgtgcgtgtatctgtataatagaatgatttatattcctgtgggtatgtacccagtaatgggattgctgggtccagtggtatttctgcctctaggtctttgaggaattgccacactgtcttccacagtggttgcactaatttacactcccaccaacagtgtaaaagcattcctttttctccacaaccttactagctagcgtctgttgttttttgactttttaataatacgcattctgagtgattctttacattattcagatattctttcccatgccatgtaatttctgttttccccctttttttaaccccacgccattgaagtttcttaaacctatgtaatgcaggaccatctgttccaggtatagtttcttttccccaaacttgaagcatctaattaaacaaacatgcatggtatgtattagaaggaaagctactcaagaggagagatgatgcctaacaaatcatgtggcacgttccacttcagagctgaaatctcgtaaatgattaaactggggagatggagcrcttatagaagtgaactgagtgttctcttggtaacttttcttttatatttcctattctcctagcatgggaagcatgactcctcatgggttgaagaattgttaatgttacacagagcrcggatcacagatgttgagcacatcactggactcagcttctatcaacaaagaaaagagccagtttcagacattttaaagttgaaaacacatttgccaacctttagccaagaagactgatatgttttttatccccaaacaccatgaatctttttgagagaaccttatattttatatagtcctctagctacactattgcattgttcagaaactgtcgaccagagttagaacrgagccctcsgtgatgcggacatctcagggaaacttgcgtactcagcacagyagtggagagtgttcctgttgaatcttgcacatatttgaatgtgtaagcattgtatacattgatcaagttcgggggaataaagacagaccacacctaaaactgcctttctgcttctcttaaaggagaagtagctgtgaacattgtctggataccagatatttgaatctttcttactattggtaataaaccttgatggcattgggcaaacagtagacttatagtaggrttggggtagcccatgttatgtgactatctttatgagaattttaaagtggttctggatatcttttaacwtggagtttcatttcttttcattgtaatcaaaaaaaaaattaacagaagccaaaatacttctgagaccttgtttcaatctttgctgtatatcccctcaaaatccaarttattaatcttatgtgttttctttttaattttttgattggatttctttagatttaatggttcaaatgagttcaactttgagggacgatctttgaatatacttacctattataaaatcttactttgtatttgtatttaaaaaagaaaaatattcctatcctgctcactggtaattaacataggtttaaaatggcttcaaatgtggccctatagacggttaaaattgtaccttatcttggcaaaacttcagagcaccagtcagtgcatgcaaggtgccattttttattgagatgcttagaatgtttctttctgtgcacaagacttaccctaccagcagcagagccattctctgttgagtggttcattttgaagttccacagattgaagagaacatgccaccaatcacctcacatcttcttggtggacatgataaatgacacaatgaacttgatttctttactaccttgactgtagctttttgtccctacctgtgaaccttcaaagactgcattaacttttaggctacataggtccaattgaggtataatatcagtacaccaaagatttttatatgtccttcgtgtgaccattctttaacggcctaagggccagctgcaaagacttttggaaaatacaatttacaactcaaaattatttaataatttaggaagttgctttttttttttttttttttcagtcctgcagtttcctgaagctctgtatatgatatttttttcagcctgcttctctctgttgttcagattaggtaattttattcttctgtctcgaagctcactgattctttattctgtctaatctgttctgctgttgagcccatttattcctgatttttatattttagttattgtatgttttatttctaaaatttccattcagtttttctttatatcttctatttgctgagaatttctgtctctttgctgagactttctacgttttcatttgtttcaagtgcatttatacttgcttgttgaagaatttttatgatggctgctgtaaaatccttatcagataattccaacatctgtcacctcattgtttgcatctactgatggtcttttttccattcggaaacattttcctgtttcttggtgtgtggaatgattttttattgaaacctggatatttttaggtattatgttatgagactatgggtcttatttaaaccttctgctttagccaactttctcagataccaccacagcaggggaattgggagcactgcttcattattaccaggtgtggctaggagtccaggttccccagtcagcctccctttatactgagtaacagggtcccctcattactactgggcaaggtgagaattcagtttcccattaggtctttattgattcttccctggctggaatgtgcagcggcaccttttgctgcaccctgggaatctccactaatgctatgggacagagtgaccaggaagagcttcattacaccaggtgggaatgaaattcccagtagcctacacagccttctccgacaccactctggagttgtattcttccagcacacaaacatacacaatttaactcaaagcatcttagcagagcttaattaaatggatagatgcctgttccctttgctggataccaagaatacaaaagtcagggagttggggcacctctttacagcttggtgagagtgtaagtctggactccccactcagcatttgctggtatgggtggggccatggtgtttttccatggtgtttggttggagtacagccttttttacccttgcttggctacccttttctggtcctttggcaggagagagcaggactctcttagggcttttttttcccctgcatttattgacatttccaggttgctgactttttcagctccaagttggaaatatatgagctgaaaagaaaatgtagggaactcatcacagtgttgttacttgggccccaatgttcctagcctattttctgtctactattcagagtcttgctgtgttttaatataatatccaggatttttatatgcatttagcagaaggatgtctactctgcctttgtagaagtgtctcactgatttttacatatttttccagcacacaaacatacacaatttaactcaaagcatcttagcagagcttaattaaatggatagatgtctgttccctttgctggacgccaagaatacaaaaaagaacaagtgacaattttctctgtcttagggagaagagacagcagaagtgtaaatgatccctaaagagtgatagatgttatcatgaagccacaggaggggtgccaggctgcacaaaagagacactggatgcttcttggtagtagaggcagtggcttcccagccttggggctaaggcttgtagggtgaattggaacttttcagatgagcaaggcaaagaagggaccttctaacattccttggatggaacatttttgacattttcccatttacagctacttatattttctacaagtgtcactgtgaccaacttatgtacacatactttttcttgcttagttataataatctgttcttaaagaaaatgtcagtctctacattctatgctgactgttaaggaaagagcacccacatctgctcctacttagctttttttctgtggttcttacacagtattcctttttttcttttcttgaaagagactcctcctttcttttcttttcttgaaagagttttaaasagataagatggcaaaagtgactgatctctactcccccagtttgaatggtaaatttgaatggtaaattcccatgaacatatatggaaatgtctttatcctactttctccaataaaggctgttcttagcttttcaaatgcaaagtgaaacctttatttatcttgatttcttttttttttttttttttttttttttttttgagatgctctgtcacccaggctggagtgcagtggcaagatcttggctcactgcaagctccgcctcccaggttcacgccattctcctggctcagcctcccgagtaactgggactacaggcacctgccgtcacgcctggctaattttttgtatttttagtagagaatggagtttcaccgtgttagccaggatggtctcgatctcctgaccttgtgatctgcccgcctcggcctcccaaagtgctgggattacaggcttgagccactgcctccagcctatcctgatttctactgtcatgcctcacatcagtccttttttttttttttgagacagagtctcgctctgtggcccaggctagactgcagtggcatgatctcggctcactgcaacctccacctccggggttctagcaattctcctgcctcagcctcctgagtagctgggattataggcgcatgccacacctggctttttgtattttagtggagatggggtttcactgtgttgctcaggctggtcttgatctcctgagctcagacaatccccccgccttggcctcccaaagtgctaggattataggcgagagctgctgtgtgcttcttaagtgaggtaagtaacttccatagaaaatttccatcagttcattcatgaaagaacaaagaacctggcaaaacttaaaaaaacgtttccaagaatcagataaaagaggacaaaccttagggagaagaaggcagctgctcatttccagcaggggaagtagctgcatagagtacaaggactggtaggcctgttggctgttcctgtttaaggagacaagatgggcatggaacagggaccaccccctcctctgggagaagctgttacccccttcacttttcctcctctgtcattacccacaatcactctccttctttgcgctatggtaggtgtttacccatcataggaatgggcatttgaactttgaaactgaatgtggtgattacacttcatgctgaagcttttcacatgagtgctttcataagcattaagtaaaattttataatgactgcagtccaaggacattttccctggtttttggccagtctaaatattgtaagagagagagaagaaaagtgtacggaatataattgtctctaagctaagaaatgtggatgttcaaataaaacatacgtacagaactctggctgctttcctttgtggctttgtgtgtggaggatgggtaggatcatgggcgatggtgcttctctgcagacatgaaactgagtccgagggttgttgacagttaaccacagctgtaatgctgaaaggcaaaagaatccaaagttcatttcaggttcatagagtaaacacttctgatctgtgacctatatccttgttcttggtattttaattatatttagtcatacttccaggtaaaaacaaatgacaggcatatatattctttagtatttagaatggtctggaaccagacttggaacttctatagattcttttaatgtgaaatttttgtatttatcctctccattatagtgattgaacaaaaaaatgtttactagaaatcatattcataccagaaaacagatatgtgaaatacattttaatctactagaaatggaagaatccttggaagaggcattatactcatgggatgtcaaaaggaaggaatataaaagaagcctctttcatcctactcaatgctgttgttttaaatttaactttttacttgcctgtaacttctcgattcaagggatagttttaggattttaattaaaatgacattttaaatgatatatcagaaattcagaactcagaatggaatatactttggctttcacatagtagagatacaaaataattgaagaaatatataggaaataaattttttacagtgtctcatacagtgtctcataattttgccccacaatgtttagatatttttcactgttaaaaaatgtatgcatttacttagatggcattatgctggctgtgacataaaggaaataaaacagggatctctgaaccgaaagtttataacttaactaaaaattctaaaggattttaaattagactgaaattttctcagtccaatgaatggatcttgttcaaatttttatagtttaaaaaatcactggctgggcacggtggctcacgcctgtaatcccagcactttgggaggccaaggcgggtggatcacgaggtcaggagatcaagaccatcctggctaatatggtgaaaccccatctctactaaacacacacacacacacacacacacacacacacacacacacacacacaaaattagccaggcgtggtggcaggtgcctgtagtcccagctgctcgggaggctgaggcaggagaatggcatgaacccgggaggcggagcttgcactgagccgagatggcgccactgcactccagcctgggtgacagagcaagactccatcgcaaaaaaaaaaaaaaaaaaaaaaaaaaaaaaaaattcttatgacacctacaattttggattctctgttatattctatatcttgacacaatgttactgtctggagagttaaccacttgtactaaggtccaaacagaaacaagatggtaaatctatgggtcttttgtctgtgtacttgttcataagctatctctacaggtttactcaacagcacactttaagatattggcactggaatagattttcccagctcagggttgacagtagatttcaaagctgagcttactctgtgtcaggcattaggggtaagttggagaacagggcaggtggaatgcctgcccccttggtgctctcttgtcaatgttttacctttatttcaaggtccagcccaaagccatatccttaggatccattgtttatgtggtcagactttcccaacattggtggtaacagacagtacatgccctcagtctagttcttgttatgtattatggttgcaatacaactacagatgtgtaatgcagttgattattccataacccatacacagtgttggtagatggcaccgtggcctattaagaaattttacccaggacccagactccaaatccaaatacacaacttgctaaaagcagtctttgcaagcttaacacgaaataaaataatttcaaagtggtgtggttataggtataagaggattgttagcttccacttggggtttccagggacctggcgggatcttatcctacagagaacaccaacctcttaaggaaactgggaagcccagagaagctgcgccacctaaacatttcccagcctgtgatcctgtaagaaaagaaaaatagctcagggcagcctgagctgtgtgaggcatgtagaatttattaggcccagagagatgtgagtgtgagactttattcttaccacccacctcccgccatgcctaggggcagttgtttaaagtcatttcattccttattagctgcctcactcattatcctcacatgcctggagtttgtgatgcaaagaacaatgtatagcaagttatgttgtaacaatgtatagcaagcttatgttacgttgatgtaacttcttggtaaacaatttaggaactgcctcttttttcctttaaaaactcacttgtaactgctgctaattggagcacacattcagggcaaacttgaatccatccctctgggttacaattctcaaaactggcccaaataaactctgcttatattaagtttccttcagttttttcttttaggttaacatcagttacatttgcttagactgtatactttgagcatattcctgaaaactgtaaccctgatgagatttatgtgtcccaagtgtgctgtttcacaagtgtaatcacctgatgggttcttcctgcccactgactagacaaaaccaattcac

SEQ ID NO: 17663 - DNA, 16849 bp, Homo sapiens
gaactactgctattaaagtcttgaaccctctgaaaaatgaaaaccagtctccaaagagagaatctggagaccaccctttccaagtttgaactggaacatgggcgaattttctcattcttgcagttattcctataattgcctttccattgtcatcaatttccaggcagcaattagttcgattgaactttccacatcctcctccttcctgggcgaggaggcagtctaaagctaatctattttgatagatagcattcctcatttttgtagattgctgggctaatagatctaaagcccttgctgtttaattagtgatgatctcaagcactatctataacctcatgatgcagttaagcatgtaaataggagaccagtaaccccatgagccatcgtcccccaccaggtagctggcccatagtagtgaattattctctcagggggccattcatcatctttccagtcccctatggctgtgtctttctttacgctccttctatatctttctctcttctcatcatagacaggatactctaaggcttctccttgtcttagagggattaagaagaaagacggcctaattgttccaagtacacaggcccctgtccatttggctggtagctgtcggtaggcccgtggcccacagatccgatagagaccagagggtgcttgccaggtatttggagcttcaagctgataccaggtgtggtttagagcagagaaacgggagaatggatttggatgaggtggtttgggactatctttgccgcgccataaagtttttcctaattttttaacatgtttctgttccaaacatgttaattcccctactgggtctgtagaagtttttccctagcaagcaatacagtatttcccgataatagaagtttttaagagccagacgcttgaacttgtgggagtcagtttgcaggaagggtcagtcagagtaaagttattttgaggcattaactcttttgcttcccaaggccattggtctcccatgtttgtccctccacaaacataacatgaggagatgcctaggctgccagcaatgttttcagccatctgagcaaataggtttttggctaaagggggaggctcggcaacttttgatttatgtgctcatagaatgacttaaagactcggaattgctgctgggatgacttcttggtttgagtcctctttatgatatataaatttactttagctttttgactgctgctttgtaatgccatggagtaacctgtagtccatataggtagatccggctctaagatagtaagatttacaggattgcaagtgcttgtcttacagtccggttttgctggcgctttgatgagcaagattggctttagcctcagtgatgatcggtcagtgaactgtgttgtgcggttccagcaagctattgctagggccttggaggggcaaacagggtatgcacatacaattttgtactggcagtttgtacagtaccctgtaggaccagagattgtgagataggttgggttcacggatgttaactgacaaatatcaaagtatatggctatagccccccctggggggtagaggcttggctttgatttataagacttcctttctttgactcagtatgaacctcaaaccaagtcctaggtaaagacttagaaggtcatagcatatataaggctggccatttcctgggtcacaaattgaataggtgatccgattgtaagtacaagttcctaggtgagtccctgtacactcctaataagtatagaataatagagtcctagttatactgtttcctgaccctgtagtgtgtgtacaatggggacactttctaagggtacttattttaacatggtcaaggggggtgataacagcaaaacaatgtacagcgtattcatatccagcaaggacagaagagggccttgcctgggggaggagattgagcacagcaacggaacaatagtaaaacagttagtattataaggaagactactagtcctaagatttctaaccacatttacttgcttgacgagtcctcaagcttcggccgtgcgtagactagtcagcttcgggtgtgtgactagagcggggcttgtctccttaagcttcagccgtgcgttgactggtcagcctcacgagtgaccagagcagggtgatcgtcctcagcagcagcttgttgtcttctcaggatcagctgggttggatgatctgtgtcctgctggctggtccactcgtcctgagctgccggtttcagccgactgtggtggatccaagacataacacctgcaactttaacagcaacgggagtggacaagatgacagtacagggcccaccccatatgggtcctagagaagttggattccactttttaacccaaacagagtctccagatttaaaggggcacactggtctatcaggcttacaggcatcctttcttgtacccagccatggacctcttgcatggctattcctaaagcctgcatttgctttcttaaggttaattcctctagttcctggagatcacctttaatttgacctatgatttggggttggccaactgaacaaaacctcatagggtaaatactcagtttgtttggtgggggtgcacctgtctcggaggaggaccataggcaaaacctgaacttatctcagatgagcttcctggcaatatttcttcagtagctgcttgagtgtccacttcatgcgttccacttttcctcaactatgcagccaataggctgtgtgtaacttccattttatttttaacagtcttgttaaatctcgtactatttcagctacaaatgccggcccattgtctgactgtaaagatagaggcagtccaaacctggggataatatcttttaacagtactttagtcatttgtcgtgctttttctgtcctggtggggaaagcttcaacctatcctgaaaaagatgcaaataaacactagaatataccgatagcttctggcacggggcatttcgtttaagtctataaggaagttttcacaaggcatggctccttctcctgttctgtttcccagaggaggggttccttttctcctctttttgtaacttcatataatagctcagccatcagcgagaaatctggaatccagatacggcagaatcctgctgccttcaacttctaatgtgaccacagactcctggaggcccagtgagaaggagcccggtctgtcctagtcctcacatccttcagctcctgccagcccaatcagattagtatctggttcctctaaggtatggcagcccttggccaatggcctctttgtctcacggccttggccatttccctcattgccttctggacattcatccttccagtgcccccttttttttttttttttttttttttttgcatctctcacattgatccctctctagccttggtcagctcttaaatccttgtctaacttgacctcttccacgtccacatctgcgtccacatcctctcacatggctaatttctctttctataagggctgctgccaacagatccgcctttttcttaagcctttcatctgcttccttttcccttccttagttctcctgctcctgcagtcggctggcagggctgggcaaggacaaacctgaatataaaattcagtgtgtctgctgcccaccagtcctttatgcttggagaagagagagatgtttctctttttcytctcttctatctattaaacctccgctcctaaagtcctcgtgtttgtccctgtcctaaattttcctggtgcatgacaacaaaccccgggtatgtagaccagacaatgtagccgcttcaagggatttgagtgaggaaggaatgaatcaatggagcccaggggggttttagagcattcaaactattcaggatgatactatggggaccaagggagagctttccccttctccctctgaaggaccactgaaaaatcactgacagattgtctcataggagaaaagcatacatatttgtttaatgcgtatacacgggagcctttgaaatggagacccaacttctcaacagagtacagagcttagataccatcttgaggttccacaaagaatgtgggctcagagcatggccaaaactaggttaggggctgggcgcagtggctcacaactgtcatcccagcactttgggaggctgaggcgggcagatcacttgagctcaggagttcgagaccagcctggccaacatggcgaaactccctctctactaaaaatacaaaaattagccgggtgtgatggcgggcgcctgtaatcccagctacttgagaggctaaagcaggaggatcccttgagcccaggagttcaagactgcagtgagctgttattgtgccactgccctctagcctgggtgatagtgagaccctgtctcaaaacaaacaaaaaaacccctaaatctgtggactctgggtgattatgacatgtcaatgtaggttcataaagtataacagctgtaccccctggtgggggatgttgataatgggggagactgggttggggcgaggacatacgggaaatctctgtaaccttcttctaattttgctgtgaacctaaatctgctctaaaaatgtatatatataaaaagtggggccttcctttccctctcccctgccccagccctctcccccacctccttcctctccctgctgcctcccctctgccctcccctttcctccttagccactgtaaatgacactgcagtgaatatcctggagcacaaagggcatgtctcccagttcagaattacctcctttatttagggcaggttctcagaactagagtagccgggcaaaggtctgaggcaaatgcctttgccctggggcgccccagccacctgcaggccccttatttcctgtggccgagctcctcctcccaccctccagtcctttccccagcctccctcgcccactaggcctcctgaattgctggcaccggctgtggtcgacagacagagggacagacgtggctctgcaggtccactcggtccctggcaccggccgcaggggtggcagaacgggagtgtggttggtgtgggaagcacaggccccagtgtctcctgggggactgttgggtgggaaggctctggctgccctcaccctgttcccatcactgcagagggctgtgcggtggctggagctgccaccgagcgtctcggtgagggtgacctcacactggctgagcttacaggccccatcttaagactttgttcgtggtgttctttcacttctcagagcctttcctggctccaggattaatacctgttcacagaaaatacgagtggcctcctcttcctccacaacctcacacgaccttctcccttccctcccgctggcctccttttctctcctgtcactctgcctgggcatgccccagggccttggctgtgtcctttctttcctcagggaagaccacaagtttgggctagatgcctccgcacccccccacccacaccccctgagcctctagtcctccctcccaggatgcatcaggctggatggtgacatctccccacccttgaatgagacggctttatgctgctctgggacccgcacccagcttggactgcttgctccatggccccaggaaaagctcgtacagataaggtcmgccacttgggtggggggcccacagcatgtcaccctctctgtcccagaagtcacgtgcttggtcccctgtgaagcccctytggggacctaggggacaggcagggcatggagacaaagtatgcccttttctctgacagtgacaccaagccctgtgaacaaaccagaaggcagggcactgtgcaccctgcccggccccaccatcccccttaccacccgccaccttgccacctgcctctgctcccaggtaagtggtaacctgcacaggtgcactgtgggtttkgggaaaactggatctccctgcacctgagggtgtagaggggagggagtgcctgagagctcatgaacaagcatgtgaccttggatccagctccataaatacccgaggcccagggggagggccacccagaggctgatgctcaccatggggcgcctgcaactggttgtgttgggcctcacctgctgctgggcagtggcgagtgcygcgaaggtaagagcccagcagaggggcaggtcctgctgctctctcgctcaatcagatctggaaacttcgggccaggctgagaaagagcccagcacagccccgcagcagatcccgggcactcacgctcatttctatggggacaggtgccaggtagaacacaggatgcccaattccatttgaatttcagataaactgccaagaactgctgtgtaagtatgtcccatgcaatatttgaaacaaatttctatgggccgggcgcagtggctcacacctgcaatcccaccagtttgggaggccgaggtgggtggatcacttgaggtcaggagttggagaccagcctggccaacatggtgaaaccccgtctctactaaaaatacaaatattaatcgggcgtggtggtgggtgcctgtaatcccagctactcgggaggctgaggcaggagaaccgcttgaagctgggaggtggagattgcggtgagctgagatcacgctactgcactccagcctgggtgacagggcgagactctgtctcaaaaaatagaaaaagaaaaaaatgaaacatactaaaaaacaattcactgtttacctgaaattcaaatgtaactgggcctcttgaatttacatttgctaatcctggtgattccacctaccaacctctctgttgttcccattttacagaaggggaaacgggcccaggggcagggagtgtggagagcaggcagacggstggagagaagcaggcaggcagtttgcccagcatggcacagctgctgcctcctattcctgtgcaggaagctgaaagccgagctactccacacccgggtccgggtccctccagaaagagagccggcaggcaggagctctctcgaggcatccataaattctaccctctctgcctgtgaaggagaagccacagaaaccccaagccccacaggaagccggtgtcggtgcccggcccagtccctgcccccagcaggagtcacacaggggaccccagatcccaaccacgctgttctgccgcctgcggtgtctcaggccctggggactcctgtctccacctctgctgcctgctctccacactccctggccctgggaccgggaggtttgggcagtggtcctgggctcctgactcaaaggasaggtcaccttcttcttgggcgagctcttcttggggtgctgagaggccttcggcaggtcatcacgacccctccccatttccccaccctgaggccctcaggatggacaagcccaaacaaagcaacccccacggccccgctagaagcaaarcctgctgtgctgggcccagtgacagccaggccccgcctgcctcagcagccactgggtcctctaggggcccgtccagggstctggagtacaatgcagacctcscaccatttttggctgatggactggaacccagccctgagagagggagctccttctccatcagttccctcagtggcttctaagtttcctccttcctgcttcaggcccagcaaagagagagaggagagggaggggctgccgctgaagaggacagatctggccctagacagtggctctcagcctggggacgtgtggcagggcctggagacatctgtgattgtcacagctggggagggggtgctcctggcacctcgtgggtcgaggccggggatgctctaaacatcctacagggcacaggatgcccctgatggtgcagaatcaaccctgccccaagtgtccatagatcagagaagggaggacatagccaattccagccctgagaggcaaggggcggctcaggggaaactgggaggtacaagaacctgctaacctgctggctctcccacccagaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggagtaagcagggggcacaggactcaggggcgacccgtgcgggagggccgccgggaaagcactggcgagggggccagcctggaggaggaaggcattgagtggaggactgggagtgaggaagttagcaccggtcggggtgagtatgcacacaccttcctgttggcacaggctgagtgtcagtgcctacttgattcccccagggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagtgaggatctgggcagcgggtggctcctgggggccttcctggggtgctgcaccttccagccgaggcctcgctgtgggtggctctcaggtgtctgggttgtctgggaaagtggtgcttgagtccccacctgtgcctgcctgatccactttgctgaggcctggcaagacttgagggcctctttttacctcccagcctacagggctttacaaaccctatgatcctctgccctgctcagccctgcaccccatggtccttcccactggagagttcttgagctaccttccatcccccatgctgtgtgcactgagagaacactggacaatrgtttctatccactgactctyatgggcctcaactttgccaccttacaaaataatttcagcccaaggcctcattaaagaccttcatgtaataatagccaattagaaggaaaaataaggccgagtgcagtggctcgcccttgtaatcccagcacattgggaggtcaaggtgggaggatcacttgaggtcaggagtctgagactagtctggccaacatggcaaaaccccatctctactaaaaatacaaaaattatccaggcatggtggtgcacacctgtgatcccagctactcaggaggctgaggcagcagaatcagttgaacccaggaggtggaggttgcagtgagcmgagattacgccactgcactccagcaggggcaacagagtgagactgtgtctcgaataaataagtaaataaataaataataaaaattaaaaataaattagcaatctgaaaaagataggaagataaaagtatacctagaagtctaggatgaaagctttgcagcaactaagcagtacatttagctgtgagcctcctttcagtcaaggcaaaaagggaaacagttgagggcctataccttgtccaatctaattgaagaatgcacattcacttggagagcaaaatatttcttgatactgaattctagaaggaaggtgcctcacaatgttttgtggaggtgaagtataaattcagctgaaattgtggaacccatgaatccatgaatttggttctcagctttcccttccctgggtgtaagaagccccatctcttcatgtgaattccccagacacttccctgcccactgcccgggacctccctccaagtccggtctctgggctgatcggtccccagtgagcaccctgcctacttgggtggtctctcccctccaggagtgccaagacctacgcctacctgttttcccatccctctcggatgcccgtctaccccaaatgggtgggggccgaccatrsagatgasatccagtacatctttgggragccctttgccaccccactccgggctaccggccccragacaggayagtctctaaggcyatgaccgcctactggaccaactttgccaaaacagggtaagacgtgggttgagtgcagggcggagggccacagccragaagggcctcccaccaygaggccttgttccctcacttgccagtggagggactttgggcaagtcacttaacctccccctgcatcggaatccatgtgtgtttgaggatgagagttactggcagagccccaatcccgtgcacgtgcacagccagtgcccagtatgcagtgaggggcatggtgcccagggccagctcagagggyggggatggctcaggcgtgcaggtgcagagcagggcttcagccccctgggagtccccagcccctgcacagcctcttctcactctgcagggaccccaacatgggcsactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccagttccatgccctccacaggggactctgaggccactcccrtctcccccgacaggcaactccgagtctgcccccgtccctgcaacgggtgactctcaggatgcccctgtgcccctcacaagtgactctgaggctgcccccgtgyccccctyaggtgactctgaggctcccccgtaycccctacgggtgactctgaggcccgtgcccaccttgggtgacactgaggctgccccatccccgctaygggtgactctgaggccgcccctgtgtcccccacagatgactccgaggaagctcagatgctgcagtcattagtttctagtgtcccatcagccttggtctcaagaggccgagagggtgcaaccccaggggctcccctcccatcttgagctcttcctgaataaaacctcattcccctgtctggcgtctttgctctcaaggctaagctgcaggaaggagtggacctcagttacccttacagcaccaggtgggggcccaacctgtgaccccatcacctggcacaatccccaggctctggggcgttgatggtgccatcctcactttcgagtggaggaggtgggcccagggaagttgattggcaggcccaggagtgggagtcaggcacaggtcactccagagcctgcccttccctgaatggaaccaggctgctggctcccaggggctagattctgtcccagatggtgggaggggctggtggcagctgcagtcagagagggagctggggtctggcaggctgtggctgcctctggactaggggatcccagccacacccacatcctctgggtgcagggagtgaagtctgtgttctaactggggtctggggaacccgcctgggaaaagaaagggattctgctcctccagccggatgyaagtggaagaaagaataacacatcacaccagaaggttggaagcagaggatggggagggtgctgggcagtaggcgctgggtggtgggcctctggggggtgcccaatggctctggcagagttgacggggcagsggcagagggcagaaggcagagtcaggagtactcctgcctctgctgggtctaagcccaggcacatcactgagcacttgaccagcctgacctcaccatggccttgtgaggtgggtatggtgtacaccctccttttagacgtttatagatatttagaggaaaatgaggccctgacagggcatcacgtgcccaaggtcactcagagcaaggatttgaacccaggtccctgactccaaagccagtgcttggaacaacgttgggggtcttcttccccactcctcacctaccttctaaacaggcactgtggggcagggtggggcttagatgagagaaaattctggaatcctgagcaactttgcctggggggctccgcggtggagggcagaagcacccaaggaccagctagccactctctctgcccctccagcctacaggtgggaggataaggctcagggccgacaagtcctgtggcctcatgcagcagagctgagccgggacgaaccctgtcccctggagaagcaggggacaccctggctggctgtgaccactttggccaccctgggcttcctgggttggtcaaggggtctctggtgtaaaaaggggactccctgtcaaagactgagtgagatggagctgcccggcaatgtgggcctctcccagtgactgtccctgttctcttgggcaacggaagcccgaggatacaatgatgtgtcccttccttggccacactggtacccacagggattattgtgtttctacctgtggagtcagctctcaggcgcctccagcactgtgggagaaacccctgggaccccagtgcctcttcccaacccttgggactggcacccgtctcttgttgagagaaagcacagtcatgtctgtcattcagaaaatcacatccctggatggccaagccacgtcagaagggatgggctgtggggatccaagcgtgttctacctctgggctgcacccgccatccctctgcttcggtttgaatgcttgtccccgccaaaactcatgctgaaatttaatccccaatgtggcagtattgagaggtgctgcctttaagaggtgactggatcatgaggccctgtccccgtagatggattcatccattcatggattcatgggttagtgggttatcatgggagggtaactggtggctttgtaagaggaagagagacttgagctagcatgtgagcaggctcagcatcctcaccacgtgatgcccagtaccgtctcgggacaccagagtccccaccagcaagaaggccttcacctgctgcagcctctctgaggcaggaggagagggaattagggaagccaagggttggggcataagcaaaggaacagcaggtacagcccgttcacataagccagagaacagcaggtgcagcccgttctcataagccagagaacagcaggtgcagccagttctaggcaggattggggagcacacaggccacatcctcactgctgtgataacaagtcaggagcttccacttcaacctctgattgaccctgggccaatcctccacttcagcctctgattggtcccaggctaatccttcatagggtgtaaccaattggaggcctctaaagggcatctggggtgttctttataaaaaccctgagaagcattgcaattgggaggtccttgagccgtttgcttgggcccgctcccacccggtgggttgcacgttcgcttcaatcaatctgtgcctttggtaagctgttttcttgttgctttgtctttttttttttttttttttttagtggagtttcactctcattgcccaggctagagtgcaatggcacagtctgggctcactccaaactctgcctcctgggttcaagcgattctcctgcctctgcctcccaagtagctgggattacaggtaccggccaccacgcccagctaatttttttgtatttttagtagagacggggtttcaccatgttggcaaggctggtctcaggtacctcggcctcccaaagtgctgggattacgggcgtgagccactgcgactggcctgttttgtctgtcattgtttcattcttttgttactttgtgagttttgttcacttctttgttcaatacaccaagaacctggacaactcagtcaggaccttccatcctataacacctcaacctcggacttctcagccttcataactgtgagaaattccttttctttataaattacccggttttaggtattctgttataagcaacagaaaatctactttaaaagcctccatggcacaggtgagccctgcagtgtgtctgggtgatgcctgcagctgtcgagaaggaggagacagctcagagtcacctgcaatctggctcttgccattacagactccagatgatgaagttgaaaatactgacaggctggaggccatctggggtcctgctggctcccagttccaggaagcctggaagagcactggggtgagctcgggccagcgcatgtttactgtcacaggggacatgtttcagcactttcattgtaaggctgtggccttctgtgcttgtggatcctcagtctcagtggccttcctcttcccccsaccccaactcctgtgttgcgtgtttaacacacctacscccaaccgggacataactaaatcctagactgtggacaaagaatacagtcacctcagggggctgcgagctctaaaggctcagggcccagctacccctttaggatgggtcagtaacaacacgactgactctgtaaattggtgatcacctgagactggacctcagcaccacacggacctgtgcttcaccttggccatcgggggagagtatggaggtcttttgctggcaggaatcagcacccttatcctggcaatcagcactcactggccattcatgaggctccagcaggacgagtggccacagtgtgcagggcacaggggatggggctttccaaggtgtttctggatgacatcaatcacacaaggagttgtaggaatgctggcgtcctggttcacgggtagacgccagaggatgccaagggtgctgggtagaaagcagaggatgccaagggtgctgggtggtgggccccttgggggtgcccaatggctctggcagagttgttggggcagagtcgggaccacccccacctcttccgggtccaagcccaggcactgcactgagcacttgatgagcctgacctcaccatggccttgtgacgtgggcactgtgggcaggaatgcttatggaatgaggcccactgtaaccctaacacagcatcacaagtctttccccagagagaaaacgcacaggcaatggaaatctatggttaggaacaaagattcccgtctaagaaaaagggtggaccacgggcctctagaagggactgagggggcaaagtcctgcccgtgcactggctaacactcttcctttagcttttcccccccactttccatattgtacattttatctgtttataatttttcttagtgctgactaaattccagagttagaccttgaaatccacaagttcctaattggtggtcaacagaaacctcagcaagacaagcagaaaatgctcctcttcccctaaagctgtagaaaggcagccaccaacctgggctaggaaatggtccttacagatactatttttttttaactgtggtaaaacctatataacaaaactgatgctaatttaactgtttttaagagtagaattgagtgacattagttcgattcactgttgggcaaccatcaccactctctatttccataattttttcatcaccccaaatagaagctctatatccattagctaactcctcatttcccctccctctaacccctggtagcctctatcctttctgtctccatgaatttgccttttggagatatttctcataagtggaattgtaatgttttcaaagttcatccatgttgtagcatgtgtgggcataccataccttttttttttttttttttttaagaagcggagtttccctcttgttgcccaggctggagtgtagtggcacaatcccggctcaatgcaacctctgcctcccgggtttaagcaatactcctgcctcggcctcccaagtagctgggattacaggtgctcatcaccatacccggctaattttgtatttttagtagagatggggttttaccatgttggtcagactggtcttgaacttctgacctcaagtgatccacccaccttggcctcccaaagtgctgggattacaggcatgagccattgcacctggcctttttatgactgaataatattccactgtatgttgctggcatgcaatggtgcattctcttataaagcattatcttctcatcctttttatttgtgtaaagttggtaggaatgttcccactttcattccaaattttagtaatttgagtcttgtctcttctttgttcatctaaagtattgtcaattttgttctttagaaataaccagtttttggttttgctgattttctctatttttctattctctattttgtttatctctgctgtaatctttattatttccttcattctgctagctttgggtttagttcgctctttttctaattcctaaatgtgtgcggataaattattgatttgagatctttctgcttttttaatgtagtcgtttacagctataaatttcccccaagcactgctttcgatttcaccgcatgctgtaagttttggtatgttgtgtttttgttttgtctcaaggtgtcttctaatttccctygtgacttccttttagacccattggttgtttaagagtgtgttaagcctgggcacggtggctcacgcctgtaatcccagcactttgggaggctgaggcaggtggatcatgaggtcaggagttcaagaccaggctggccaaaatggtgaaaccccatctctattaaaaaatatataaaaattaaccagctgtggtggtgcacacctgtaatcctagctactcaggaggctgagacaggagaattgcttgaaccttggaggtggaggttgcagtgagctgagatygtgccacggcaccccagcctgggcgatggagcaagactccgtctggagtcggggaggggaagagtgttaagatccttttgtagttgatgaacaatgatgattgggtgttcatgcacatgcgtgagatgtgtcaccctcaaaccctgttacgtcggcacgttacccatctgacgtgaaaaagaagagagtgcattaacttccacatattcatgagtgttccagtttttcttctgctatggatttataattttatcctattgtaattggaatgatactttgtataatttcgttttaaaaatttattgctgggtgcagtggctcatgcctgtaatcccagcactttgggaagccgaggcagggagatcacctgaggtcag

SEQ ID NO: 17664 - DNA, 46878 bp, Homo sapiens
aggtgatctgctcgcctcagcctcccaaagtgctggaattacagtcatgagccactgcgcctgtcatgttttcttctttttctgcattgctattaaaaattttggctggggccgggcgcagtagctcatgcctgtaatcccaactctttgggaggccaaggtgggtgaatcacctgaggtcaggagttaaagaccagcctggccaacatggtgaaacccctgtctctactaaaaatacaaaaattagctgggtgtggtggcgggcgcctgttatctcagctacttgggtggctgaggcaggagaatcacttgaacctgggaggtggaggttgtagtgagccgagatcgtgccaccgcactccagcctgggcgacagagcaagacttaatctcaaaaaaaaaaaaagaaaagaaaaaattgtttcctcataatcgtaaagctgttatactcactgcaggcacagctagtacattttgctcaaccccacaggctccgttccctttacgaggtatttatttatttatttatttttatttttgcgacggagtctctctcctctgtcatcctggctggagtgcagtggcatgatctcggctcactgcaacctcggcctccagggctcagtcggttcttgggcctcagtcttccaagtagctgtaagtacaggcatgcgccaccacgtccggtgaattttttgtatttttagttgccatgttggccaggcttttactagctatttataatatgcttgagtcactcacaggaatgaaatactgtcagcatcaatagttagcagctctttcaaaatacattttattgcctctataagaaaccttaactattctattagtccagtaattccaaatggtcttattatttcttgggttttgtttgtttgtttgtttgtttttgagacgttgtttctctcttgttgcccaagctggagtgcaatggtgtgacctcggctcactgcaaactcctccaaggttcaagtgattctccggcctcagcctcctgagtagctgggattacaggcacgagccaccatgtctggctaattttttgtatttttagtagagactgggtttcctcatgttagtcaggctggtctcgaactcctgacctcaggtgatccatccgcttcagcctcccaaagtcctgggattataggcatgagccaccgcacctggctcgtcttattatttctatacataatatatgctcttttggctgggcgtggtagctcaagcctggtggcagacgcctgtaatcccagctacttgggaggctgaggcaggagaatcgcttggacctggaaggcagaggttgcagtgagccaagactgaaccacctcactccagcctgggcaacagagtgagaacccatctcaaaaaatactgataataataagatcatcttcagaactcagttcctggtgcatgaagagattcaatacagccccctcactctcagttcttagaaagaagaatatgccagcctgaccaacatggtgaaacccccgtctctaataaaaatacaaaaattagctgggtgtggtggcgcacgcctgtgatcccagctactcaggaggctgaggcaggagaatcgcttgaacctgggaggtggagattgcagtgagcccagcctgggagacagagcaagactcattctcaaaaaaaaaaaaagaagaagaatatgaaagagataggatcaataactaccttcattgtttaatagcctaagagtgaaagcccagcacagtggctcacccctgtaataatcccagcactttgggaggttgagttgggaggatcacttgagcccaggggttcgagaacagcctgggcaatatgtcaaaagctcctctgtagaaaaaatacaaaaattagccgagtgtagtggcacacacctatagtcccagctactagggaggctgaggtgggaggatcacctgagcctgggaggtcaaggttgcagtgagccatgattatgtcactgcattccagcctgggagacagagccagaccctgtctcaggaagaagaaaaaaaaaaaaaaagccaaatctttttatcccaggatgtctgaaaaggacagagtctatggagcatggatgcagaaaagtagttattcctaccagaaaaaaaaaaaatgaaatgtggacacagccactcaagatcagagactcaaccagtgaaagcaattagcttcaatttcattgtcaccaggagggcgcacaccagagaacctgggagaaagcctgggctagagcccttagcattctcagtgttactggtgctgtggttcaacaacctttgtgggaatgaggagaaccagagaccatcaccatcacacgtaaaaaggatcctatagcaacaatgtggctgtcaaaaatcagctggaggccaggcgcggtggctcacgcctgtaatcctagcactttgggaggccgaggcgggcggatcacctgaggtcaggagtttgagactagcctggtcaacatggtgaaaccccgtctctactaaaaatgcaaaaaattagctgggtgtggtggtgcatgcctgtaatcccagctacttgggaagttgaggcgggagaatcacttgaacctgggaggcagaggttgcagtgagcccagactatgccactgcactccagcctgggtgacagactgagaccctgtctcaaaaaaaaaaaaaaaatcagctggagcttaaattatacattgtttgcaatccagactgtacttgctttcttgtcaatggcttgagatatgtgcagaggccccttaaacatgtgtaggtgacctttctctgtcgcccaggctggagtgcaggggcacaatctcagctaactgcaacctccacttcccgggctcaagcaatcctcccgctgcagcctcctgagtagctgggactacaggtgtgtgccatcaagcttggctgatttttttgtactttttttttttttttcgagatggagtctcgctctgtcgcccaggctggagtgcagtggcgcaatctcagctcactgcaagctctgcctcccgggttcacactattctcctgcctcagcctcccaagtagctggtactacaggcgcccgccaccatgcccagctaatttttgtattttttttagtagagacggggtttcaccgtgttagccaggatggtctcgatctcctgacctcgtgatccgcccgcctcggcctcccaaagtgctgggattacaggcgtgagccactgcacctggccgattttttgtatttttagtagagacagggttttggcatgctgcccaggctggtctggaactcccgacctcaagggatccgcctgtctaggcctcccaaagtgttaagattacaggtgtgagccaccacgcctggcccagaaatactctttttttttttttttgagatggagtctcactctgttgcccagcctggatggagtgcagtggcgcgatctcggctcactgcaagctccgccttctgggttcacgccattctcctgcctcagcctcccgagtagctgggactacaggcacctgccaccatttttttttgtatttttagtagagacggggctaatttttttttgtatttttagtagagatggggtttcaccgtgttaaccaggatggtctcgatctccttacctcgtgatctgcccgcctcagcctcccaaagtgctaggattacaggcgtgagctaccacacctggcccagaaatacttctttatcagaaatattactggcgggtgtagcagggcacgcctataatcccagcactttgggaggtcgaggcaggcagatcccttaagcttaggagttcaagaccaacctgggcaatatggtgaaagccgtctctacagaaaattagccaggcacagtggtgtgtacctgtggtctcagctcctagggaggctgaggtgggaggatcacttgaacccaggaggctgagattgcagttagctgagattgtgcccctgcactccagcctaggcgacacggtgagactctgtttcaaaaaacaaaaaagaaatatgacttatttacaaatatttctttcttttttatttttagagacagggtctcactattacgtaagtattataaattatatatatatgtttgtttgtttgtttgtttttctgagacagagtcttgctctgtcacccaggctggagtgcagcggcacaatctccactcactgcaacctccgcctcttgggttcaagtgattctcctgcctcagcctcctgagtaactgggactacaggtgcccgccacaatgcccagctaattttttatatttttggtggagatggggtttcactgtgttagccaggatggtctcgatttcctgacctcgtcatccacctacctcagcctcccaaagtgctgctaggattacagacgtgagccagtaagtccgacatcttttttttttttttttttttttgtggaaacagggtctcactgtgtctcccaggctggagtgcaggggcacaatctcgactcactgcagctttgacctcccaggctcaagcgatcctctcacctcagccttccaaggagctgggactacaggcaccaggcccatgctactggtccctgctgtttacaaatacactagacttgggttttagctgctctctcaacaccaggtgggaaatggattgttcggaaggtagaggaatagaggagggacctgcttaggaaggtgggggtgctctagatgagagaggaggtgctgtgacctcaaggtctggggaaagtgggtgagtgcagggccccatcaaggctctcaacaaggcctctctctctggagctcagatgtgaagcccagaaggcaggtcagaggcctgaggtcagaggcaggtcaaaggtgggggtcccacctggtccccttggcgccttcccttggaatgcagtgaccagctgcctggaagggtgggcaaggggacaacaggatggggtaaaggccagttacaagtagaatcctggaaggccgggcgcagtggctcacgcctgtaatcccaacactttgggaggccaaggcgggcagctcacttgaggtcagaagtttgagaccagcttggccaacatggtgaaaccccgtctctaccaaaaagtacaaaaattagccgggcgtggtggcacatgcctgtaatcccagctactcgggaggctgaggcaggaaaatcgtttgaacccgggaggcagaggctgcagtgagccgagatcccgccactgcactccagcctgggtgacagagtgagactctgtctcaaaacaaacaaacaaaaaccaagtagaatcctggatagacagtggctcagggamtcagctgtccccaaatcacctaccttagctctttgtgcaggggatgggggatccccaagatcttcaaagatagggaggtatcctcaagatcttcaaaggtggccaggcgtggtggctcacgcctgtaatcgcaacactttgggaggtcaagatgagaggaggccatcttaaggccaggagttcaagaccagtcggggcaacatagcaagactctgcttctgtttctgtttttgtttttgttttttaatgtttcctcgaaatcccaccttaacatctacacaatggtgcctacagttttccccattaacttcctctctggggacagaatattcccctacccacctaagttcagccagaaggagatgcctcatcccccccacccaggcttcccagtgctgagaacaaaagaaaccagtttagttagcatttcctgtgaattcaaatgggggccagcagtgcaactgggaccagcccattccctgggggagactcagcagtgctggccactttgcagagccccgtctgggtcccccaccctggcccccaagggccacagcatccccttccacccacaggcctgggcaaggtgcagtccccagacttctgcaatcttaaccgctgtgcttccgtcgcagtgggaggccccgccttttcccctgcctgcccttcgggcacctcaggaaggcaccttcctctgtcagaatggcyaccatggtaccatccgtgttgtggcccagggcctgctggactctgctggtctgctgtctgctgaccccaggtgagaccagtcaagccggggagggctggagagggctgcgttttggggatcagtagagggtagaggaatagaacgcaacgctgttcacatcctgccacactgcgacctggccgctgactctgtatcctcgggagaaagttctggttccttagttcagccttcaggtggtcaggccccagcataggcttgtacgccatccctctcccctaacacacacacacacacccctcatgcttcctgctccatctgaactcctgaaatttgccctttgcgtatgtgcttccctctgccaggatcacctgtccctttcacttgctaactcctacttagccttcagtttcgggctgcaatggtccccgcttccaggaagccttccctgactcacctcctcctatgctggatcagagcctcttctggcctccttctgagttctccccggtctctgatggattctacctttcccactggaccatgaaggcaggaacccttctgtctcggcacaaggagagaggtgttaaatggtggggcctgttgatgcgtgggttggggracaaggaaacaaacaccaggacttcttcatgttcctgaaggtgtccaggggcaggagttccttttgcgggtggagccccagaaccctgtgctctctgctggagggtccctgtttgtgaactgcagtactgattgtcccagctctgagaaaatcgccttggagacgtccctatcaaaggagctggtggccagtggcatgggctgggcagccttcaatctcagcaacgtgactggcaacagtcggatcctctgctcagtgtactgcaatggctcycagataacaggctcctctaacatcaccgtgtacrgtgagtcracgtgtccggaggtgggactggtcttgggtagtggtgtgggcaagtggccaatggctcaggagagtggggaccctcagtttgcaaagaatggaccacagttctgacccagagctcagacctggacatttgtgtgtgagatacaaagayagacagagacagagacacagagacagagacagagatatagagacgcatctcaatctcatgccaaggcagcagttgtgaaatcaattaacttgggccccaacaagcattttttttttttttttgagacagagtttcgctctttttgcctaggctggagtgcagtggcacgatgtcggctcactgcaaccttcgcctcctgggttcaagtgattctcctgcctcagcctcccgagtggctgagattacacatgcacgccaccacacccagcaaattttgtatttttagttgagatggcatttcaccatgttggccagtctggtcttgaactcctgacctcaggcgatccgcccacctcagcctcccaaagtgctgggattacaggcatgggccactgcgcccggccccaacaagcttttttttttttttgagatggcgtctcttactctgtagcccaggctggagtgcagtggtgcaatctcggctcactgcgacctctgcctcccaggtccagctaatgcccagctaagttttgtatttttagtagagacggggtgttccgcccacatcagcctctcaaagtgctgggattacaagtgtgagccactgcgcctggccccaacaataatcccaacactttgggaggccaaggcaggaggattgcttgagtccggaaatttaagaccaggcagagcaatatagggacaccccgtctctacaaaaataaataaaaaatattagctgggcatggtggcacatgcctgaagtcccagctacttgggggaccaaggtgggagaatcgcttgagcccaggagttcaaggctgtagtgagctataattgcaccactgcactccagcctgtgcaaaaaagcaagacccttgtctcttaagcaaaaaagggggtacccctttcagtcagcagtaggcaaatggaggttttacatttacacttttttatacctttattttagagacaggatctccctatgttgcctaggttggtctcaaactcctgggctcaggcaatcctcccacttcagtctctccagtagctgggattgcaggcctgagccactgtacctggctacttttttttttcttttcttttctttttttttttttttgagacagagtctcactctgtcccccaggctagagtgcagtggcgcaatcttggctcactgcaacctctgcctyccgggttcaagcgattctcctgcctcagcctcctgagtagctgggattacaggcgcatgccaacacgcccagctaatttttgtatttttagtagggacaggatttcaccatgttgcccaggctggtctcaaactcctggcctcaaatgatctgcccgccttggcctcccaaagtgctgggattataagcgtgagccaccatgcctggcctactttttgacttttyttttctttgagacgcagtcttgctattgtcccccatgctggagtacaatggcgcgatgtcagctcattgcaacctccgcctcctgggttcaagtgattctcctgtcttagcctccttagtagctgggattacaggcgtgtgacaccatgcccggctaatttttgtatttttagtagagacagggttttgccatatgggccaggttggtctcaaactcctgacctcaagtgatccgcctccctcggcctcccaaagtggtgggattacaggcatgagtcaccttgcccagcctttttttttttttttttttttttgacatagagtctctctctgtcgccaggctggagtgcagtggcactatctcagctcactgcaaattttgcctcctgggttcaagcgattcttgtgcctcagcctcctgagtagctgggattacaggcacgtgctaccatgcctggctaatttttgtatttttagtagagatggggtttcaccatgttggcaaggctggtcttgaactcctggtctcaggtgatccgtccaccttggcctcccaaagtgctgggattacaggcatgagccacagtgcccggcctgaggcccagcgttttgtaggtgtactggggagggcacccagcctgggagtgtcaagtctcctgtgactgtgccggagtatcttgagaggctgccacagggctggtgaaccaggaaagccctgagtgtctgaacctgattggagagaactgaataatcctgaccttttgatccacccaccccggcctcccaaagctctgggattacaggcgtgagccaccacgtctggccataaacaggaatttttaatattcatatcatagtcataaacgttcatcccttccatcctcatttttttttattgtgccatctttgagaacagaaagttttgtttagcgccttgcaaggtatctgacaacacaggaaatgataatcactgcgctaatgataatagcaaacgcttcgactggcccagctctaagccctctaagtttattaactcaaagctcacagttctcggcaggacyaccctgtctcctccccagtccctggggtgagtgggtgggtttgcaggacccgctaagtgccatcctcccctcctctctcagggctcccggagcgtgtggagctggcacccctgcctccttggcagccggtgggccagaacttcaccctgcgctgccaagtggaggrtgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttggtgagagaaggggcttcagacggtgggtgacgagctgagccagggtagacggtgccctgaccttggggttcctgagagtggggtaccccggacctcacaggcttctgggaaggaaagcccccggccactgggcaaggtggccccggaagggaggcccgagccgtgggatctttgaagaaggccgttttcatggccctgtgtgtgtgtcctgtgaagaagggtgacccagtcagcaagatatcctgactgggggggatgagggtgtcctggggaaggcacagtcctgggggttgtactatgcccacctttctccccagtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggaratcgtctgcaacgtgaccctagggggcgagagacgggaggcccgggagaacttgacggtctttagtaagaggaggcgtgggaagggggcrcggcctcagcagtctgggggcgtggcagagggggcggagactagccgaaaaggtggggcctggcttgccccaatagcagttgcaacgtgggttgggcctgagtgcccgaagctggacacagcgcggaaagagggcgaggcttgaacggccgaaagcgtggcccggatatyccgagaggaaaggggagggcggagggagcggcttgacccacaggaaggtcctgttcattaagctcctgggcaatgccccgcctttaggcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtgtgagtcggtcaccctgacctttaatccctccacccctkccctggaaagattagacgctcctctgcaccactgtgcctcgggtgtgttgggtgtctgatcacacatggtggttccacagatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgagggtgagctaayacggggctgcgggtctggaccsgtaagccggggggcgggggggttggagacagaagggacgcatattgacttagcgctttctctgcacagctgggagctcccactttgtccccgtcttcgtggcggtgttactgaccctgggcgtggtgactatcgtactggccttaatgtacgtcttcagggagcaccaacggagcggcagttaccatgttagggaggagascacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaatctgtggtttgattccacccgcgctgcaagtctctcccacccaggtgcacatccactgagtagcgtcgctgcgacggaagggggcggggcctgtggcgcgcagacgcagcttgaactcttgagaggtgggctggggcttagccaacggggcaaggggggcgggaaggaggtggggtttctcccagccaatcgacgggcgcgccctcgttgccgctctatgccgctccgccccggctcgctggtcccagaaggcgccgggtttcccaagatggcggcggacgtgtcygttactcaccggcccccgctgagccctaagtctggggccgaagtcraagccggcgatgccgcggagcgccgggcgccggaagaagagctgcygcctctagatccagaagagatccggaaacgcctggaacacaccgagcgccagttccgtaaccgccgcaagatactgatccggggcctcccgggggacgtgaccaaccaggtattggggggggcggtgtaggagcgtggcgggaaataccacggtgcgcgtgcgcggggggaaccgggcgacaccaacgctgaggtgcgcgggggtcgttggcgggggcgcccaagcaccggatccacgcgggatcgggagagaccaagagcgggacgtgggggggcgatgatgaaaggggaaaccgactgcgaagtgagggagggcgttgctaggggcgaccacaggcttgggcgacaccaagtgatggaagcgggcggggaatggaagggggcggacagctttggtcctgttggggaattgtgaatgggctggtacattggaccaccagttgccccctgcttggatgatgcttttctccacccactctaccacagggtggcgggrcctcacatccagaagtttcaggactgcggagagtacgcccctccatatcacgcgtttattcactgctctcagagataaatccggaagttaacagcagcccctgggtctcagcccccaaaacctcaggattaatttgggaaaatggggtcttctgccaccagcctacagacctacaggaaggaagcgaggcctgtgttctatggagcccctcgtggctaatcttcctgctaggagtgcccttctcatggggccagcatggggcagcgcttcccaatgctctttggacccagggaaatggcatctatactgccctgccctatggcggtgaaataggttctcgcttcctgctgctgagattccctgctctccggcccaccagcacaccgggtgggcacgtggctagtggaaccccagggatgttgggaggggctgaatttggggacagatcgggacagggatcattaaggatggtcaggtttctttctgggtcttcctctcagtgtctgcagtctctcagctgggaacacattgtctctcctgcaagatgcacagtgtgtctggtcccagcaggcgccagcactttgccttcaaagctggcttgagaggctgggcatggtggctcatccctttaatcccagcactttgagaggctgaggcaagaggctgtattgagcccaagggttcgagactagcctgggcggtatagtgaaaccctcatctctacaaaaaatttttaaaaattagccaggcatggtggtgcgtgcctgtagtcccagctacgcaggaggctgaggtgggaggatcacttgagcctaggaggttgaggctgcagtgagctatgattgtgctactacactctagcctaggtgacagaacaagacactatctctaaaaaaaagaaaaataaatgagctggcttggaagagggcagctttatcagcaggaggaaattgggaggcatgtgaacccacacaacgtggggcttactagaaggtgggctccccagtcaggtacccatgggtggctgcgctgcccaactgcatggcctccagcagatctcttcacttctcctagcctaagttttctcatatacaacatgagtttgttaatacttcacttacagagttgttggaaacagtgaatcttgcaaaaggaggttcatgcaggttaaatggcttccctaaaggcatactcttttttttttttttttttttttttgagacggagtctcactctgtcgccaggctagagtgcagtggcttgatgtctgctcactgcaaccttcacccctcgggttcaagcaattgtcttgcctcagtctcccgagtagctaggactacaggtgcacgccaccacagccagctgatttttgtatttttagtaaagatggggtttcaccttcctggccaggatggtctcgatctcttgatcttgtgacccgcctgcctcagcctccaaagtgctggaattacaggcgtgagcccggcctctttttttttttttttttttgttgttgttrttttttttttwttttttttttttttttgagacggagtctcgctctgtcgcccaggctggactgcggactgcagtggcgcaatctcggctcactgcaagctctgcttcccgggttcacgccattctcctgcctcagcctcccgagtagctgggaatacaggcgcctgccaccgcgcccggctaatttttttgtatttttagtagagacggrgtttcaccttgttagccaggatggtctcgatctcctgacctcgtgatccacccgcctcggcctcccaaagtgctgggattacaggcgtgagccaccgcgcccggccttgttgttattgttgttgacagtgtctccctttgtcacccaggctggagtgcagtggcacactgcaacctctgcctcctgggtgcaagcagttctcctacctcagcctcccgagtagctaggattacaggtgtgcgccaccactcctggctaatttttgtatttttagtagagacaaggtttcaccatgttggccaggctggtctcgaactcctgacctcaggtgattcacccgcctcggcctcccaaaatgctgggattataagcgtgrgccaccccgcccagccagctaaaggtataccctctaagagcatgttgcctgggtaatagcacagtctgcagctaggttctgaatcccatctctgccaggtatgagcagaatgaccttgacaaaattactgcatcgagcctcagtttcctcattggtaaaatggggggtggtaattgacctgccttcatagctggtggcagctatgaagcggcactgggttgcccccttccatctccagtaactccctgtcttttgtcttgtatctccacaggaagtacatgacctgctcagtgactatgagctcaaatactgttttgtggacaaatacaaagggacaggtttgtggggccatggggygggccagggcagggagtgaccatccctgaagatgggagggcctrgctcactgtctgctgctctgagcttcaggcccagtattgccccccaggccaacatggcaggttgccccaatctgcctgtcatcctgtcatcttgggacagccttcatgttctccttggagaacactgggcatcgggctgattctcttcctactccactcgcttggcattgagctaattcttgacaacgtttggccgtgggttcattctcttcttacccctcttgcctcactcagccagtcacccctgcttgtgtggtctttttttttttttttttgagatggagtcttgctctgtcgccaggctggagtgcagtggcgcgagctcggctcgctgcaacctccgcctcctgggttcagcccattcccctgcttcagcctcccgagtagctgggattacaggcatgtgccaccatgcccggctaatttttgtatttttagtagagacagggtttctacctgggtgggtccaggttaaccaggtgaggaggtggggctcagtgttccatgctcaagaaacagcagctgcaaaggcccctctggagtgtgcctggcgtggtccgggtggcagcggtgagatgggaggggaggtcagcgagcccgcacaggctgcactgcaccctgcagctagaagccacaagatggatgtggcgtgatcgttttgaacaaagcttcctgcggccgctgggtggatcgcaaatctggggcagcacgtggcagcagggttcaggggcactggtggcctggaaaggtggcaggggtgggcagtgtgtagagtgggcctctggagtccggctgcctgggttcaagtccaggctcccctactcggggcacaggggtgctgctctgggcccgtttcctctctggcaaaatggtgattgtgatgattaagttatatccatttgagagatgaggaaactgatacccccaaagccacctggggcttggggcttaaatctgggccccagtgagcatgggcttaaccactgcccttggtatcacccgagtgacccacagcgttcttaggacagagccaggcccacagttggtgagcgctgctgtgggtgcaggtggacgcagggctgggagagggagtgggcttcgtggagcctagagtcaatggcaggcgctctcgcctgtgtgagtcgccaaggctggcaactgctcagatcagcaggcacctgagatgcccagcatttggaggtcccacctggtttgcagggtggcggggtggaggggcaggccctcagggcccggctgacctcgcactgccctcctcccaccgcagccttcgtgaccctgctgaatggggagcaggccgaggccgcaatcaatgctttccaccagagccgcctgcgggagcgygaactgtcggtgcagctgcagcccacggatgccctgctgtgtgtggccaacctgccccccagcctcacacagcagcagttcgaggagctggtgcggcccttcggcagcctggagcgctgcttcctggtctacagtgagcgcactggccaatccaagggctatggctttgcygagtacatgaagaaggactcggctgcccgtgccaagtcrgacctgctgggcaagccgctgggaccacgcaccctctacgtgcactggacggatgccgggcaactgacgcctgcccttctccactcccgctgcctctgtgtggaccgcctgccacctggcttcaacgatgtggacgctctgtgccgggcgctgtcagctgtccacagccccaccttctgccaggtgagccctgtggagagcattggggagcaggtgccaggcccggagcacctgagagagtctttggagtcatctgccttttcttttttttttttgagacagtctcactttgtcacccatgctggagtgcagtgatacaatctcagttcactgcaacctccgcctctttggttcaagcaattctcttgccttaacctccagagtagctgggattataggcgccccgcccccatgcctggataatttttatatttttagtagagatggggttttgccatgttggccaggatagtcttgaactcctggcctcaggtgatcctcccaaagtgctgggattacatgcgtgagccaccacacctggccaggggatttgaatccctctgcagcctcaggcctcactgtccctctatcagatgcatgcaaggccactcttgtaactatggatctcgaggcttgctcaccactcacctcctcattcgctggtaccctcgtcaaacctcccatggggtcccagacctggaccaggcattgaggaggctgcagaggagcccacagtctatttgagccttgaggtcagagactgaggctttgccagatcccagccccgccctcgagctcgggccagtcactggctctctgatctgcagtttccctcctccataagcagggactcaatacttgcacaatgggttggcaaaacagtcccttgttcattcaagccacacatgccaggcacttctgtgtgtgtgcctcgccctgtaacaggtgcagtggggcgagaacaggccagactcactctctaagagcccccagaaggtcttgatccccagagatcccaaaggggacattcccccagcactcgctgtggactctgagtacrtaaccttcagttgcttcatcctgtagcaaccctgagaggcaggtatcactcccattttcaggtgaggataccaaggcacagaggggtcaagtaacttgcctagagttaaacagccagggtctggcagagctgggatcagaacaccgcagcctagctccagagcttgggccagtgagcggaggccagtgcagaggcttaaaaggggtaggcctggccaggtgcagtgactcacacctgtaaccctaacactttgggaggctgaggcgggcggatccctcgagcccaggagttcgagaccagcctgggcaatatggtgaaatcctctctatacaaaaattagataggtatgatggtgtgcctgtagtcccagctactcaggaggctgaggtgggaggattgcctgattctgggagtccgaggctgcagtgagccatgatcgcaccacagcaccatgacactacagcctgagcaacagagctagaccctyatctcaaaaacagagagacagtcctgggctcggacccccagctctgtgggcttgagtgggtccctctcgtgtaagtggggtattggtgccccatttaaactaggtgtctgttgggaggcagaggcaggaggatcactcgagaccaggagttcaagactagcctgggcaagatagtgggacaccatctctatatttaaaacaagaaacaggctgggtgaggtggctcatgcatgtaatcccagcactttgagaggccgaggcaggtggatcacttgaggtcaagagttcaagaccagcctggccaacatggtgaaaccctgtctctactaaaaatacaaaaaaaattagccaggtgtggtggtgcaggcctgtaatcccagctactcaggaggctgaggcaggagaatcgcttgtacctgggaggtggaggttgcagtgagctgagatcacgccactgtaytccagcctgggtgacaaagcaacactgcatctcaaaaacagaaaaaaaaaaaaaaaaaaaaaacaggccaggcgcagtggctcacgcttgtaatgccagctctttggaggccgagacggacggatcacctgaggtcaggagtttgagaccagcctgacaaacatggagaaatcccgtctctactaaaaatacaacaamaaaaaaaaggtagccaggcatggcgccacgcgcctgtaatctcagctactcaggaggctgagacaggagaattgcttgaacccagaagactgcggttgcggttagtggagatcgtgccgctgcactccagcctgggcgacagagcgagactccgtctcaaagaaacaaaaaaaacaaaaactgagtatccatgagccacgggaaccccctctctgtttacttatcattcatccattctgctgctttctcttggacacctgctacgtaccaggcctgctatgtaccaggccgcctgtgcgggctcaggacagaagatgagttagcacaatggcctcacctttcttttattttattttatatttttttaagacagagtcttgctctgtcacccagtctggagtgcaggggcgcgatcttggctcactgcatcctccgcctcctgggttcaagtgattctccagcttcagcctcccgagtagctgggatgacagcgcctgacaccacacccagctaatttttgtgtttttaatagagatggggtttcgccgtgttggccaggctggtcttgaactcctgacttcaggtgatacacctgcctcggcctccccaagtgctgagattacaggtgtgagccactgcgctggcctggccttaccttcttatgtggagatcaaaggtcacagggtcatgaccagctacaggtactctcctagcctgtttccacatctcaaaatrgggctggcagtgcttcatgatcaggttgttgtgaacagctgcccattcattcctccactcgaacattcactaaacttaattttttttttttttgagacaggttctcaatcacccaggctggaggagtacactccggcctcgacctcctgggttcaagaaatcctcctaccttggcctcccatgtagctggggaactacaggaatgcrtcaccatgcccagctgatttttaaaattttatgtagaggccgggcacagtggctcatgcctgtaatcccagcactttgggaggctgcggcgggcagatcacttgaggtcaggagttcgaaaccagcctggccaacatggtaaaaccctgtctcatggcacggtggctcacgcctgtaatcccagcactttgggaggccgaggtgggtgcatcacgaggtctggagatcgaggccatcctggctaacatggtgaaaccctatctccattaaaaatacaaaaaaaaaaattagctgggtgtggtggcatgtgcctgtggtcccagctatttgggaggctgaggcagaagaatcacctgaacctgggagacagaggttgtggtgagccaagatcccactactgcattccagtctgggtggcagagcgagactccgtctcaaaaaaaacaaaacaaaaaacaaaaaccctgtctctattaaaaatagaaaaaaaattagccaggcgtggtggtaggtgcctttaatcccagctactcgggaagctgaggcaggagaattgattgaaccagggaggtggaggttgcagtgagccaagatcatgccaccgcactccagcctgggcaacagagcgagactccctcaaaaaaaaaaaaaattatgtgaagatggggtctccctatgttgcccaggctggtctgaaactcctgtgctcaaacgatcctcctgcctttgcctcccaaagagctgggattatagattcgagccactgggcctggtctcaccaaacatttgttgagcatctgatgagtagcaggcgttgaagtgatgtcctccgaggagcccacctttaatgttaggtgacccrgctgaatggagggtgggcttgacagtgaagcagcttgaggttcacacatcagtccctcgacttaggaattgtgtggccttgatcactctgtgacccctctgagtctctctctgttcatccctaagatgggtgtgtttatggccgggcacagtggctcacgcctgtaatccagcactttgggaggccaaggcaggcggatcgcttgaggtcaggagttcaagaccagccttgccgacatggtgaaacctcatttctactaaaaatacaaaaattagctgggcgtggtggtgcacacctgtaatcccagctaccaggaggctgaggcaggagaatcacttgaacccaggaggtggaggttacggtaagctaagttcacatcactgcactccggggtgacagagcaagactctgtctcaaaaaaaacaaaacaaaacaaaagccgacaggtttggttatgggagatctgtgcccagaccttggcacagggcgtgggcagaggtgaagggctgctacctgcacctttgctgcccgggcattcagcaagtgccggtgcccagcccaaccacttcccttagcactgctacctggcttggccactgtctggaaygagagcccttccttccccacccgttgctgattatctcttttttttttttttttttgagatggagttttgctcttgttgcccaggctggagtgcagtggcgcgatctcggcccaccgcaacctctgcctcacaggttcaagtgactctcttgcctctgcctcagcctcccaagtagctgggaatacaggcatgtgccaccacgcctggctaattttgtatttttagtagagacggggtttctccatgttggtcaggctggtctcgaactcccgacctcaggttatctgcccgcctcggcctcccaaagtgctgggattacaggtgtgagccaccgcatccgcccgtggccttggctttgttggtgaggtggctcccagctccgccctccctccagctgtgtggccttgggtgcgctgacctctccgtgcctcagttgccttctctgagaaatgggtatgatgcagcctcccagggtcattgggaaaatcagatgagctgatgcaggaatgaggcacagggcagtggaggcctggcgtggagttcacccttatggggcagctgagtctggttacggttgtcacttcccggggtggtgcagtcactgctgcccagatgctcatgactgcctgccttcctccggcagctggcgtgcggccaggatgggcagctgaagggcttcgcggtgctggagtatgagacggctgagatggcggaggaggcacagcagcaggcggacggcctgtccctggggggcagccacctgcgagtctccttctgcgcccctgggccccccggccgcagtatgctggccgctctcatcgctgcccaggccacggtgagcctgtgcgggcagaggtggcggggtggggatgggagccccatggggatgtcagggccccagcggcactctgagctgcttctgttccttcctgcaggccctcaatcgggggaagggactcctccccgagcccaacatcctgcagctgctcaacaacctgggcccatccgcgtccctccagctgctgctcaaccccctgctccatggcagtgcgggggggaagcagggtaaggtggggctggacaggggccccactgtgcagaacaggggctgcagcgctgcccccggcacttcccgaaactgctcatcttggctgcagtgacaggagccccaggagtagggccgagggggagtatggagtcatagcgggggctgctgctgtccacaactgggggccgggaccagggccacacagcagcctgcagtgaggtggggtgctgacaagagggggctgaccttcactggagtagcctctgccccttctaggcccttcctttgggcaagtccactgcccaccccccggccccagagtgtcagtttcctgccccatcaatgggttcagggctgtgtttcgtgaggtggggcagggaggacacagggacccccacacatcctcctatgtctccctccaggcctcctgggtgcccccccagccatgccgctgctcaatgggccagccctgtccacggcgctgttgcagctcgccctgcagacccagggccagaaggtaacacacgcatccccctcacccactgctctacagcccctacaggctcttttcaacacagctggtgcgatcggtggggtggggggacctctggctgtgccctgggggcgcagaaccagggtgagggcgactcccccaaacccctgcctttcccacccacatccccatccccctctggcaattgctcatgatggttcgccatctttccctccattctgagagcgcccctggacttggtgcctggggtggggtcaggggacctggacacgcccatttacagcctgaaactgggtgtgggctgggagcgccgctgctgggcaccagtttgtgaatagactctgctcggaagctctatagacatgcctgggaaaaaactccaggtctatcccctcagtgygtgcrcacacacacacgcacacctagaaacacaggtatacatatagactcacacatacaaagatgcaaatatacacacagagacatagacacacaaagacataagacaaagacacacacatagacacagacacacatatagacacaagacagactcatgcacacagaaacaaagacacagatatacacgcacacacacacacagacacacacacacatagacatacacccatgctccgtcctgtctggtgtggttccctggattctaagtcaggtgtgtctgtctggtggtaactgacagaatatgtgagcctgtgggtctggccttctgtgactaaaagtggctgaaacactgtgtggctgtcccattccatgtggctgcagttgatactgtgctgcaatcattggccagggaactggggcctggagctcaggagaccctcggtcaccatggctgatgggacagtgatagagttggagtgtggcgggcactggggaaccctgtgcctgtctgcccaggatcggccrtgccctggagttggggtgtgtctgccaagactctgggccacacctgtctgcttccctgggccmccctgcccccatctgcaactgtctgtgctctgtccctagaagcccggcatcctgggagactcacccctgggcgccctccagcctggggcccagccagccaaccccctcctcggggagctgcctgcaggtaacgcagaccctgcccacacggtgtcccccagccacttccccttccttccctgctacgtggcctcgggtgagtgacccaacctctgggtcccagcgcccttgtccatcagttgggtgccctccactcagggcccagggatgagctctgctcagtggccagcatggatttgtctcttgacccctgggccctggtccaggtgggagctggagggccctggggagaggggtcctgtgagcctgggcccctgaaatcctccttccctccctaggagggggcctgcccccggagctgccgccccggcgagggaagccaccacccctgctgccatccgtgcttggccctgctgggggtgaccgggaggccctgggcttgggtcccccagcggcccagctcactcctcccccmgcccctgtggggctccgaggctctggcctcagaggcctccagaaagacagtgggcctctgccgacgccccctggggtaaggccctgccctgcgcgcggcaccacaccagcctcctgttccgcagggttccctctcccgggggccctctcgaatcctgccttcccgccacaggtctcactgctgggggagccccccaaggactaccggattcccctgaatccctacctgaacctacacagcctgctcccggccagcaacctggcgggtaaggaggcccggggctggggaggcgccgggagaagccgccgcccagctgagggccccccaactaaccccccagcccctggaggtggcagcagcagcagcaaagccttccagctcaagtcccgcctgctcagccccctcagcagcgcccgcctgccccccgaaccaggactgtctgacagctacagcttcgactacccctcggtgagtgcctggctgcagctctctgtcccctaaggccaaatcattctccaaactgatatttctctaggattgactatgccaggccatgtgctagggaggcggcagggaacgtgccagatatggtctctgcttttttttttttttttttttagagacagggtctccctctgctgccctggctggagtgcagtggtgcgatcatagctcactgcagcctcaacctcttgggctcaagcgatcctcacacctcagtctcctgaggagctgggaccacaggcaygcacctccatgcccagctaatttttaaatttgtggtagagacggagtctcattgtgttgtccaggctggtctcaaactcctgacctcaagtgagccacccgcctcagcctcccaaagtactgggattacaggcaagagccaccgcgcccagcctcatgcccttaaagtttcccgtctgtctgcacatcaccccctgcttccggtccacctgcctgtctgtccattctcgagccctggaggatcttgggtctcagtctgtctgtcatcctgcgtctgtctttctctcccaagaggacttaggccacactgtctctccccagagacagggcttgccctttctatccctctctcccacctttgattcctgtctgtgcccctggagatttggtccttctatgatgccaacctccttggcaggtcagaaattgcaaactgggccaggcacggtggctcatgcctataatcccagcactttgggaggccgaggcgggcagatcacctgaggtcaagagttcaagaccagcctgaccaacatggagaaattatatattataaaatatataataaaatatatatttcatatataatataaaatataatttatgttttatactaaaaatacaaaattagccaggtgtggtagacatgcctgtaatcccagttactagggaggctgaggcaggagaatcacttgaacctgggaggcggaggttgtggtgagccaagattgtgccattacactccagcctgggcaacaagagcaaaactccgtttaaaaaaaaaaaagaaagaaattgcaaactggccgcccacaggtcacctgggtgatgtttggccccctctgtgtttcaaacaaataacaacaggaactaacgccaacacaggaaaactgcaagagtccacacagctcgaattcccagcttgcctgggaaactccaaacacttaggcccatggggggcaccccccttcacagcagccatccctgccaagctgcatccagccccaaatttgcctcttcctggtcccagagtggtggggactgtcttccctgatgacagctctgccatggagttcagccaggggtgaggctgggacagactccaacccaatgtgcttctcccgctttcattcaggacatgggacctcggcggctcttctcccacccacgggaaccagcccttgggcctcacggacccagccgacacaaggtaagagccacctggtatggcatgtgtagcaatcagcttttactacatgacaggctgtgccatgacttagtagcctggaacagcagaccttgtattttgtgtgttctttgtgggtttttttaagacaggatctcactgtgttgcccaggctggagtgcagtggctccatgatagctcactgtggcctcaaactcctgggctcaagcaatcctcccactttggcctcccaaagtgctaggatcacaggcatgagccaccataccatgccaggcattktattacttcttgccactctatggggcagtgggcggtccccggcactcacctgggtctcagtgagctatgtggcctcacatatttggcgtccacaggctggaacagtttctstgtgcccattcgtgcggtgatgatccctgggttcctggaggaggaagaggaggcgggtacccacgtgccagctctcctcagtcctattagccaaagctagtctttgcaaagcccagaactgccgggcatggtggctcacgcctgtaatcccagcactttgggaggccgaggtgggcggatcacctgaggtcgtgagtgtgagaccagtctgaccaacatggagaaaccccgtctctactaaaaatacaaaaaattagctgggcatggtggcgcatgcctgtaatcccagctactcgggaggctgaggcaggagaatcgcttgaacctgggaggcrgagggaagattgtatacaaagggctgggtactacaattgtctgcttcactccaccggcccttyttctacagatgtcccccccgcccagtggcttcggcgaacggagcagcggtgggagtggcgggggccccctgtctcacttctattcaggctcgcccacttcctacttcaccagcggcctgcaggctggcctcaagcagagccacctcagtaaggtgaggaacctctctggccaagcacaggccccctgggacagctaggatttgggggtgcctgccaccggggctctgtaaccctcggtgcccaggccaaagctggggtggtggcagrggttggtcttgctcagggtggagtagcaacagcctattgtcctccatccactctgcatcaagcacctagcactgccagcattccgggctttctgtcacttcctctctctacagcccaggctgtgggtgctactggccccatctgacagatgagaaaaccgaggctcaaataaaatggagcaattggccctaggtcttatagctagaaagtagcagaagcaagatttgaacctgaaactgttcgctttccctcagggctggggggcagtggcaggggggcggggtgggtgcttcctctggcccccagggagtgacctgttccacctctccatttctcccaggcaatcggctcttccccgctggggtccggagaagggctcctgggcctcagccccgggcctaatggtcacagccacctgctgaaggtacgggcagggggtggggacatgcagggctgggaagccccggccccccagcggcccctgacccgccccgccctgccctctgtctccagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgwcaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgscaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtmtgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggttttaaagaaatcagagttggctggttcttgggacaaacagtgggcttgagtgggaggtctgggatggccccgcgggtttacctgagatggattccgccctgctcttcccacctggtcaccgcaggccctaagcaaacatctgcgcttatgttccattgattatgggctttccctcgcctccctggcgcggcgcatgctcagtcggtgagtcacgtgatgcatgtcatggccgcctccatggcccggggaggcgtgagtgccagggttctrctgcaggctgccaggggcacctggtggaacrgacctgggggcacttccgggtcgggggagggggtggcgctggggacaaccagaaagtttcaagcgacaggtayctggggcgcccrgggcgggcagcgttaatccgtcagatgccggcggggcggggctcggcgcagccgctcaccgaaccgtgttttccaggctcgcgcccggckggagaggaggacgcgggcggcccggagcggcccggggacgtgtgagtgcagggggccaagtcccccattcctcatcccacggaattcctctggtccccatcttgccctgtagcttcatctcgaggtcccccttctgctttgccctattcagtacctgtgcgtcaagcctcaattcctacttcctaaccctagattctacccgggccctgagcccatcatccagttcggcattcgcacttycatctgtccccagggtgaacgtggtgttcgtagaccgctcaggccagcggatcccagtgagtggcagagtcggggacaatgttcttcacctggcccagcgccacggggtggacctggaaggtaggaaccgggcagagggaattaaggaggtccttatmcatttgtccaaaaaaaaaaaaaaaaaaamccacaaatyaggtgtgtctcttcacgtctttttcccaccaaatatggactaaaatccaaacccctcaccatggcctcatctgttgccaagctcttatttgttaagcatttattagagatcactaggactcctggctcccaggattttgtgttctcttcccccttcctccctgtattctagccacattggctttctttttgttgttgttgttttgagatggagtttcactcttgttgcccaggctggagtgcaatggcttactgcacctcagctcactgcaacctccacctcccgggttcaagcgtttctcctgccccagcctccagactagctgggattacaggcgcccaccaccaagcccagctaatttttgtatttttagtagagacggggtttcaccacattggccaggctggtctcaaactcctgaaaggtgatccacccgcctcagcctcccaaaatgctgggattacaggcatgagccaccgcgcccagcccacactggctttcttgtggttcctcaaacaaccaagctcattcctgcttcggggcctttacatttgctgttccctctgtctgaagtgctttcccagcaaacattctggctctttctcatccttcagacctcagtgtaaatgtcatgtccctaacaatcccattcccctcagcccagctgaagtacccatgccctagttactctgtcttatcagtgtgatatgatatatagcacttctcactttttttttttcaagagacggagccttgctgtgtcgccaatgctggagtgccatgatgcaatcatacctcactgcagccttgaactcctgggttcaagtgatcctcccacctcagcctcccaagtagctgggattataggcacaagccacaatgccaggctgttttgtttcctactttgtcatctgtcccccagtgagattggtgacccatgtccttattcatgcttatctgttgcctgtcargatgtaacagatgtttgataatttgttgagagaaaaataataatagaaatttcttgtccaggcrcagtggctcatgcctgtaatcccaacactttgggaggccraggcaggcgactcacttgaggacaggagtttgagactagtctggccaacatggcgaaaccctgtctctacaagaaacacaaaaattagctgggcgtggtggcacatgcatataatcccagctacttgggaggctgaggcacaagaatcacttgaacttgggaggcagaggttgcagtgagccaagatggcaccactgcactccaggctgcatgacagagcgggactctgtctcaaacaaacaaaaaaaaaaggccaggcgcggtggctcacgcctgtaatcccagcactttgggaggccgaggcgggcggatcacgaggtcaggagatagagaccatcctggctaaaatggtgaaaccccgtctctaataaaaatacaaaaaattaggtgggcgtggtggcgggcgcctgtagtcccagctactcgggaggctgaggcaggagaatggcatgaacccgggaggtggagcttgcagtgagccaagatcacgccactgcactccagcctgggcgacagagtgagactgtctcaaaaaaaaaaaaaaaaaaaaaaaaaatatatatatatatatatatatatgtctttaaccatgttaataaatattcactgactgaatcttcatgacaacttgagtagtagagactgttattccctattatagatgaggcaactaaaccccaggttaagtagacctggtctaagggcaagtgagtgacaatactagactcaccagtccattgtagccactaatctgtgctgcctttctatgaatacctactgcgcgtcaggcagcaatatacaaaacaaataaggcctctgtcatctcacatccatttcggtctaatagggacaataatcccacaggtaaatacataattatgaccaacttgggaagggttgtctggaagaaaatatatagggtttgcttttgggatgaatatatcagggatcctgattttatcattaaaggggaagatatgttgggaggggttatgaaaggcctacctaaagttctgttctggaatccagcrgccaatagtctaggacagggattggaatgtgagatagatttatttgttcatttatttatytgagacagagtctcgctctatcacccaggctggactgcaatggcatgatcttggcttactgcaacctctacctccagggttcaagtgattctcctgccttagcctcccgagtagctgggattacaggcaactgccaccatgcccggctaagtttttgtatttttaatagagatggggtttcgccatgttggccagggtggtctcaaactcctgaccacagttgatctgcctgccttggcctcccaaagtgctgggattacagacatgagccactgtgccgggctagtagaggtaagtggcctggcaaggtgtggtggctcacgcctgtaatcccagcactttgggaggctgaggcgagcggatcacgaggtcaggagatcaagaccatcctggctaacatggtgaaaccctgtctctactaaaaatacaaaaacaaaattagccaggcatggtggcaggcgcctgtagtcccagctactctgggaggcggaggcaggagaatggcgtgaatccgggaagcggagcttgtagtgagccgagatcacgccactgcagtccagcctgggcaacagagcgggactccatctctaagaaaaaaattacaaaggaaaacaaaggaatgaatgagggggatgggggaactgcaagactaagtgaaggagtttggattttattctgagtgtgaaaaccctttggaaagttttaggccaggagggacatgatccccaagcaccggtctctgtgatcagaggatgtgggggtgtgaccaagggcaggtggtcagcagaaaacttcaggttctgtctctttcaaccctaattcctggtctggtgcagtggcatatgcctgtagtcccagcattttgggaagccaaggcaggcagattgcttgagcttaggagtttgagaccagcctgggccacatggtgaacctcgtctctacaaaaaaaaaaaaaaaaaaaaaaatatggccaggtgcggtggctcacacctgtaatcccagcacttagggaggccgagataggtggatcacctgaggtcaggagttcaagaccagcctggccagcatggcaaaaccccatctctactaaaaatacaaaattagctgggcgtgatggtgggcacctgtaatcccagctacttgggaggctgaggcaggagaatcacttgaacctgggaggcagaggttgcattgagccgagatcataccattgcactccagcctgggcaaagagagcgaaactccacctcaaaaaaaaaaaaaaaaaaaaattagccaggtgtggtggtgcgcacatgtagtcccagctactcgggaggctggggtgggaggatcgcttgagccgggaggttgaggcagtaagctatgactgagccatggcactccaggctgggcaacagagtgagaccctgtctcaaaaaaaaaaaaaaaaaaaatcctggccgggtgcagtggcttacgcctgtaatcccagsactttgggaagctgaggygggcagatcatgaggtcaggagatcaagaccatcctggctaacatggtgaaaccccagctctactaaaaaaatataaaaaaattagccaggcgtggtggcaggcacctgtagtcccagctacttgggaggctgaggcaggagaatggcgtgaacccrggaggcagagcttgcagtgagccgagatcgtgccactgcactccagcctgggcaacagaacaagactccatctcaaaaaaaaaaaaaamaaaatcctaatgcctgattccttcccccaccacactgactgctgagtcagccggtccatcctccaagagcagyggagaggtggggacacattagcccagcacagtgatagggtcacagcaagggctcacagactgcggggagcctgcctggcctttcccctctcagctacctggcagccaagtccctgctccttaatggttctgcatctcagcctgctagggagtccctgggaaatggggcctcccagatgtccgtttgtaaaccctacacactggggaacagctagctgaggacattgaggacatgacacagtgcctggtacacacagtggagctgcaggcccaggagggagacgtgaggcacgtggtggaagagaggtctactcctctacgccattcgcatagcagccccttcctgactctgccactcacctgcgcccccttcacttcccacccctaggggcctgtgaagcctccctggcctgctccacctgccatgtgtatgtgagtgaagaccacctggatctcctgcctcctcccgaggagaggtgagtgggtcagccctgtctagctggcagcttcaccctggagcattcagcagcccccaccatcctccccacttccagttcctggaatgggagctgcctcccccaccactaccccctgcgctcagtcagcttcctccctccccsacctctggccccccacccacccagctagcttgccctcggctaacactgcccgtgtcaccaccctagggaagacgacatgctagacatggcccccctcctccaggagaactcgcggctgggctgccagattgtgctgacaccggagctggaaggagcggaattcaccctkcccaagatcaccaggaacttctacgtggatggccatgtccccaagccccactgacatgaacacctggaccattccacattgccatggccccagggcccagattgagggaatagccaggtgccagccctgcccagagtgcggacaggcccgggagagacgtggaagcccctgtgaaggacaacacccctgcttgggagagagtcccatgtccaggctctggtggggacagggcccctagtggggtggccttccccaggcccctgagaatcagggtttgagtaggagtggactcatattggagctgcaataaatcgataacacaggccccagcatgttgagtgtccttgggggacagatctggggtctacaggtggctcacacctgtaatcctagcactttgggaagccaagatgggaggatcacttgaggccaggagcttaagaccatcctgggcaacatggcgagacctcgtctctataaaaacagtaaaaattagcgtggagtggtggtaagtgcctgtagtcccagctactcgggagactgaggtgggaggatcacttgagcccaggggatttaggctgcagtggagcggtgatcaggccattccactccagcctgggtgacagagtgaggccctgtctcaaaaaaaaaaaaaacaaaaacaaaaacaaaccacacctgcatctgctgtgctgggcccccggttctcttttccctctgggatctaagatgccgctggggatccaaggcagaggcctgggagcccccatttccgagggggagggctagcgtggaaggccccgccccggcagctgcggagggatttggtggggtccaggccgcccttgccacgcaggggtgcgcggatgacctgaaaaaagccagaaagaggaaaggtgccgccgaggctggtcgctctcagctggggctcatcgcatcctctaccaagagcgctcccaccacacaggtcccgcccctcccaggtgggtttcatcgggtgggcccagcgggacagggccgggtgaaattagggagggggctgggctggggcgcaatggaggccgagccaatcccggactcctcaatgccagcaaagcttctggcgccgccctgtctgaacctggagcggctgggaggatccccctcccaggagaagccgaggaccccaggatgctgcagaatcagtgagaggtgcgtaaggccaaaccccattccccggaccccgctagcacttcaccacctggctcagtgatcaaggggtyatgacctctctttgctggggttatcgagaagtggcaattttataatagttactgaaacttacaaagaggttctggtgcccagagacacttggggtcatctagggatcagaggccatgcaattccatgtctctggggctgatgtaggcactccccagggatcatccaggggttatggagggcaactcaataataatgaaaatgataaaaatcgtaatcatattatggcaagccagcggcgtggtggcgcgtgcctgtaagtcccagctactcgggaggctgaggcggaaggatcggtcgagcccaggagttctaggctgcactgagtcctgatcacgcccctgcactccaggcgggggtacagagtgaggctcggtctctaaaagaaacacaaagaaaaaaagtaacctttttctcgatcctgcagccagaggcttgatatcctgcctcggtcacctagggcggtccctgcctgggtgatctacgggtgccgtaaggggttgattgatgtggagggctgggcgtgcctgggaggcccacagtgggcgaggtgagttgcaattactgcaactcttaaaccttccacccagagttagaaatgactgaacctcaggtggggtgtgtagcctgtccaagggtacacaaagagccggcccaagttggaaccccctggccggctaaacccaggagtcacccaagaaaacgtgaccccactgcccttctccccaggtccctctggcctgcatgccaggagtcggtcaccgccctgtgcttcctccaagagacagtggagaggctgggtcagtcccctgcccaggacaccccrgtcctggggccttgctgggacccgatggctctggggactcagggccgcctgctgctggacagggattccaaggacacacagaccaggatcagccaaaagggccgccgtctgcagcccccggggactccctcggccccaccccagagaaggccccggaaacagctgaacccctgccggggcaccgagagagtggaccctgggttcgagggggtgactctgaagtttcagataaagccggactccagcctgcagatcatccccacgtacaggtaggggccggctggggccaggycgccctttctcccagttacaacgcaaacaccagtgtgggaggtaggggtgctcyctggcgtcggtgtggaccctcacctgtgctctacgttacacgtggcccagtctctggttgacaacttgagctggtgccagatacagtcctgccgctcctgactcagtggctccccactcccaatgtgagacctggtctctttaggaatcaggcctggccttgcttaggctgcagctgcggctgcggtgatttttcccaataatgctaacagctactatttgttggtagtgacaacaataagaggttaacaggcagtattttatgtgtatgggctcattcaaaagcctggggaggccgggcacagtggctcacgcctataatcccatcactttgggaggccaaggcgagcagatcacctgaagtcaggagtttgagatcagcctggccaacatagtgaaaccccatgtctactaaaaatacaaaaaattagctgggcgttgtagtgggtgcctgtaatcccagctgctcaggaggctgaggcaggagaatcgcttgaactcaggaggtgaagtcttcagtaagcagagatagcrccacctcactccagcctgagccacagagtgggactcagtctcaaaaaaaaaaaaaaaactagctgggaatggtaatgggcacctgtaatcccagctacttgggaggctgaggcaggagaatcgcttgaacccaggaggtggaggttgcactgagcagagatggcaccactgcactccagcctgggtgacagagcaagactccatccccttaaaaaaaaaaaaaaaaaagctttgggaagctgggcctggtggctcacacctgtaatcccagcactttgggaggccaaggtgggaggattgcatgagcccaggagttcaagaccagcctgggcaacatagtatgacccccagctctaatttttacctatttattgttattataaaaattataattatgacttttttaatcatgccgccaaaacaatatttttttttttttttgagatggagttgcactctgtcgttcaggctggagtgcaatgacacaatctcggctcactgcaacctctgcctcccggattcaaacgattctcctgcctcagcctctggagtagctgggattacaggtgcctgctaccacgcctggctaatttttgtatttttagtagagatggggttttgccatgttggccgggatggtctcgatctcttgacctcaggtgatccatctgccttgccctcccaaagtgttgggattacaggagtgagccgccaccatgcctggctgcttttttttgcttttgtttgtttgtttgtttttgagacagggtcttgctctgtcacccagggtggagtgcagtggcgcaatcatggctcactgcagcctggacctcccaggcccaagccatcctccctcctcagcctcccaactagctgggagtgcaggcctgtaccaccactcctggctattttttttgtttgtagagacggggtctccctatattgcccagactcccatctctttttaaaaatcaataaatcaaattttcaaagaaaaaaaaactgttgtattgggaagcccattttacagatgaggaaactgaggcacagagtaggagataatgtgtccaggctcacacagcaaggacatggagaactgggattggaacctggcaggctgtccctgtgcttactatttttcaaataataataataataattaggtcgggcacggtagctcatgcctgtaatccctgcactttgggaggccgaggtgggtggatcacttgaggtcaggagttcgagaccagcctggccaacatggtgaaaccccgtctgtactaaaaatacaaaaattagctgggcgtggtgtcgcgcgcctgtagtcccagctgcttgggaggctgaggctcaagaattgcttgaacccgggaggtggaggttgtagtgagctgagatgacaccactayactccagcctgggcaacagagcgagactccatctgcaaaaataataataataataataataatwttactaatgagaggcaaagccaggccattcagatattagttgcctcctcgggggatggctgataccttgatactaaatcttcatttcggagggctgttggggacaagctacagatcccccccagtgctaataccttgtctgccccacagcctgccctgcagtagccgttctcaggaatcccctgcagatgctgttgggggccctgcagcccacccaggaggcaccgaggcccactcagcaggcagcgaggccctgggtgagtcctgaaaacccaagagctataaatattttgggggccaatttcctgtcttccctgcctttctccctgccccccccttctccatcttgcttccccatttagagccctcagggaggagtcgcagcacccccctccacttgggctgagtcacccccacccccagcttcctcctctgcggaatgctgccatctgtctcccttcctggctttgctgtggcttagagctggcaactcccagggctgatccagagctaggtggggcctttactgagacccccacaaaatgcccgactccgcacaggcatcccgagctcacatgcttggcctctgacccctgccctttgacctctgacccttcagagccccggcgctgtgcttcctgtcggacccagaggaccccgctctggagagacgctgaagatgggacccctctctgcaacgcctgtgggatcaggtccttagaatggaggagggagttggggcgggggtccccaaatcagtccacgtgtaaccaggatggcctgtggggaaagcaaaaagcaaaacacctacctcttgggaaaagtggtttccttgtggcggtttccgggcccccactgcatcctaaatggcagtttcttgtcccccaaccctaggtacaagaaatacggcactcgctgctccagctgctggctggtgcccaggaaaaatgtccagcccaagaggctatgtggcagatgtggagtgtccctggaccccrttcaggaaggttaaacccagcttcaccctgctgagctgctgcttctgcctccgtttcaccagtgggagaatgggcagaagcagctctcctaggaggattggggaaagagccggcctgcctcctctctgccatytccagattcaaggatcccgggggaagacccaggcctcaggtggcagagcctgctaggggtcaccagccccttctccagtcagccttggccgaggccccctcaggagacgctctcaggaaggatgagcattgttacagcagggacaataaagtacagagatatgccgagagaaaaagcctgtgatttgggatcccgcctcctgtgcccctgtgccagcccaggaaggtggacaggtgttttctcgttggggttgtgaggggcgtgcacacacgtgcgcatgcacagagacacagtcttatccacaggcagcagcccccacacagggaattagccacatttaccacaatgtcccatgcagggaaacagccactacccacagacacacacaacagatacagaaagacacacacaagccgggtgcagtggctcacgcctgtaatcccaacactttgggaggctgaggcaggaggattgcttgaggccacgagtttgagaccagcctgggcaacatagtgagaccctgttatatacagaagggaaaaaaaaagacacatgtctagccaggcacagtggctcatttctgtaatcccagcactttgggaggctgatgcaggtggatcacctgaggtcaggagatcgagaccagcctggccaacatgatgaaaccccgtctctactaaatatgcaaaaattagccaggcgtggtagcatgtgcctgtaatccgagctacttgggaggctcaggcaggagaatcgcttgaacctgggaggttgaggttgcaatgagccaagatcgtgccactgcactccagcctgggtgacagagcgagactctatctcaaaaaagacacatgcaagacagccgtgcgtgctgacagacacatcagcagagacacacgtcgacagggatatgctgacacgtagctgagtcacacacagatacagcccacacaggacacatgcaccagacacacgtaaaacacacaagtagatggcacacactggcagcatataccagtggatccttcatctgtcacccaacccctgcctgcagtgtgtcactctccttagcccctgctgtgtcccctacccccttttaagatctccctaatccagccaaaatgtgtctcccgggcctgaagtcaaaagccccaagtcagaggcatctttcagcaggcgggacacacaggccaccagcactcacagggagggagggaggatggagagtcaagactggtggcgggctgggcatggtggctcacacctgtaatcccaacacttcagaaggcagaggtgggaggatcgcttgagcccaggagtttgagaccagcctgggtaacacagtgagaccccgtctctaccaaaaaatcaaaaaatgagccaggggtggtggtgcatgcctgtagtgccagctactcaggacactgaggtgggaggatcacttgagccctggaggtcaagactgcagtgaaccgtgatcgtaccactgtactccagcctgggtaatagagggagacttggggaaaaaaaaaaaagtagggtgggcatggtccttgctgtgggcgtgagtgagccacaaagccacacacccttatgagatcctctttgtctctcctgggcagccctgaatgggagaactggagtccagattcctctgccctcagatccctgaattatttgatcttacccttccttggcctgaaacaccctccctccacatctccccatggctgacaccttctaatcgcttgaggaggcctggccccaacatcagctcttcagagaagccttccttgaccactcagactaaaatagacacctcccccgactcaggccgggtgtggtggctcacacctgtaatcccagcactcagggaggctgaggtgtgaggatcacttaaactcaggagtttgaggctgggcttggtggctcacacctgtaattccagcactttgggaggccaaggcaggaggatcacctgaggtcaggagttagagactggttaacatggtgaaaccccacctctgctaaaactacaaaaaatagccgggcgtagtggcaggcgcctgtagtaccagctacttgggaggctgagggaggacaattgcttgttatctacagaatgaaaaaaacaagacacatgcccagccaggcagagtggctcattcctataatcccagcactttgggaaactgaggcaggtggatcaccggaggtcaggagttcgagaccagcctggccaacatggggaaaccctgtctctactaaagatacaaaaattagccaggcgtggtggcatgtgcctgtaatcccagctacttgggaggtggaggttacagtgagccgagatcgtgccactgcactccagccttggagacagagactccatctcaaaacaaaaacaaaaacaaaaaactaattaaaaaataaaataggccagatgtggctcacaggctcacacctgtaatccaagcactttgggagcccaaggcagcaagatcacttgaacccaggagttcaagaccagcctgggcaacatggtgaaaccccgtttctaccaaaaatacaaaaattagccggatgtggtggcatgcacctatattcccagctgcttgggaggctgaggtgggaggatcacttgagtctgggaagttgaagctgcagtgagccacgatcgtgccactgcactgctgcctgagcaacagagtgagaccctgtctccaaaaaaaaaataaaatagacattcccactctcaccctgtgtcagcctccggttcagctccttgctggtctccctcttagaacctatcagaatttccattgtctggaagccttccttgaccactcagtctaaaatagaaaggaaggcttatggttacattatccacatccatctcccctactgccccaggagttctcaagtctgaggtcgccacatctatgtccttgcccacgacaggcctctccagtgccaagtatagagaagctctctgcaaggacacaccttgaacacatatctgcaagctcgtggctgtctttacccacttattcaacatttattgagcaactgtgtgtgctaggacccaatgaggaccctcagtggtgaacagaacaaagatccctgctctactggggctgatgttctaggagacagtaaaaaaaaaaaaaaaaaaaactcagaggcaggacgcggtgcctcatgcctgtaatcccagcattttggaaggctaaggcaggcggactgcctgaactcaggagtttgagaccagcctgggcaacacggtgaaaccctgtctctactaaaaaacaaaaaatcagccaggtgtggcggcatgtgtctgtagtcccagctactcgggaggctgaggcaggagaattgcttgaacctgggaggcagtggttgcaaggttgcagtgagctgagagcacaccactgcattccatcctgggtgacagagagagactccctctcaaaaaaaaaaaaaaaaaaaacctcaggtgtatgtctaagaggatgttaagttgtgagctgggctacagagaaaaagtgtgcaaggaaataaaagagttaaggaggtcgggcgtggtggctcatgcctgtaatcccagcactttgggaggctgaggtgggcgaatcccttgaggtcaggagttcgagaccagcgtggacaaaatggtgaaaccccctctctattaaaaatacaaaaattaggcaggtgtggtggcatgtgcctgtaatctcacctactcagggggctaaggtgggagaatcgctttaacccaggaggcagaggctgcagtgagatcttgcctttgcactccagcctgggtgacaaagtgagactctgtctcaaaaaaaaaaagaaaaaaaaaaaaaaatgtcgggcaccatggctcatgcctgcctgtaatcccagcactttgggaagctgaggtgggtggatcaggagttcgagaccagcctggcaaacatggtgaaaccccatctctgctaaagatacaaaaattagccaggcatagtggtgggtgcctgtaatcctattgggaggctgaggcaggagagaatcacttgaacctgggaggcggaggctgcagtaagccaagattgcgccactgcactccagcctgggccacacagtgagactccgtctcaaacaaacaaacaaacaaacaaacaaacaaaaaaaaaaacagaaagaaaaagaaaaagtaattgcagtttttgccattactttttttttttttttttcctctgagacagtctcactctgtggcccaggctggagtgcagtggcgtgatttcagctcactgcagcctccgcttcagggttcaagcagttctcctgcctcagcctcccaagtagctgagactacaggggtgtgccaccatgtccggctaattttttttgtattgttagtagagacagggtttcaccatgttagccaggctggtcttgaactcctgacctcgtgatctgcccacctcggcctcccaaagtgctgggattacaggcgtgagccaccatgccctgcctgccattactttcaatggcaaaaacagcaattacttttgcaccaacctactaaaataaatatctcatctgaaggctctgaaagagaccttgaggtcagtaggagcggagagagatcattaagtagggagggcacaggcagaaaaggtgaggtgctgttagtggcagggactgcacctggctggtgcctttttgggtgttatacctggcccctggctccagcaccgagcactggcctgccctcttgtgccatttccccgtctcatctttgctcattacatgtttgcatgggactggcttccttctctagggctccgtgttcctgcttttgagggaggaggggcagaggaggaggctgtggggaggaggcccagctgctgtgccttatgctgttggggatgaggggggaaggtgccgtgtagtgggggttgcagcggataccctgtgtgtgtctgttctgaatcatgatgggctgagtggaaaggcagggtgggggtaaactgaagcactgtgggtggacacaggacaaaggaggcattgagggcggggcaggggtgccccctttaacagggaggacatgctaagggctgacacccatagcatcagccagtgcctgcccaggaaggtctcaccgaagtctcagggcaggggcacaacggagagggcctccacccaccctggcaaggcggcctcagctctgccggtaaccaggcctgggggaagcacctagcccccacctccaagagtgacccggatcagagggcagtgctgggtggaagagataagtaggaggaaggagtgaggcccccacccctgcccaagggtgtgaagagagcagaaaacaggcactgagagaggacgagctctaggtcacactgagaaaagacagccagccgggccaggcacagtggctcaggcttgtaattccagcacgttgggagaccgaggcaggtgaatcacgaggtcagtagttccagactagcctgaccaacatggtgaaaccctgtctctactaaaaatacaaaaattagccgggcgtagtggtggcgcgcgcctgtaatcccagctactcaggaggctgaggcaggaaaatcgcttgaacgtgggaggcagagcttgcagtgagctgagattacaccactgcactccagcctgggcgacagagagactccgtctcaaaaataaaaaaaagaaaaagaaaaagacagcttagattgtgcctgatgcatagtaggtgttcaaaaaaagtttttggattttttcgttgtttgtttttagagacagggtctggttctgtcacctgggctggagcacaatgacaatatcatagctggaagtggctttgacctcctaggctcaaaggatcctcctgcctcagcctcccaagtagctgggactacaggcatgcaccaccatgtctggctaatttttgaaaaatacaccaggcatggtggcttacagctgtaatcccagcactttgggagaccgaggcaggtggatcaccttaggtcaggagttcgagaccagcctggccaacatggtgaaaccctgtctctactaaaaatacaaaaattagctgggtgtggtggtgcatgcctatagtcccagctatttgggaagccaaggcaggggaattgcttg

SEQ ID NO: 17665 - DNA, 13575 bp, Homo sapiens
ggcttgagaggaggagggaggatcggccagagaccgaccccaggaggatggccggccaggcagcaggaccacccacccgtgctcctggaagcataggagcctggcacgggctggccctggggtcctggtctgtatcagtcctgaggaccaaccagacggcatccggtgaagtgcagtggctgggccccacagccgggcggggggctgcggaaggaaaaaaccttgttttggattcactcataattacaaatgccccctccagcaaggccggcctctgcctgtccagtcactcacggagaaaacaggcagaaagaaccttctaggacaggcgtggggtgccagtgggggtgggaggcagaggagccggcgagaggcccccacccatccacccaggactagccccatgagcaacgcccgcgtgggcagccacacaggcggaagggacaggctgggcagccatcgcctaaggtctggggttaaatctcaaacgaaggggaggcttcctctgggttgccacacagggctgggcagagcctgcagagaggggatcagaggtctgaggacatcctcccggatggtggcccttggaggtgaagccaaggctctcttcttggggcgttttggccatgctttcctctgctaggctcttgttggtttgaggaatatagtcaggaaggaaaaaccagcctagcagttattgaaacaatatttcaaacagagttcagacagagtgacagaatggctcaggtattttgtagccgtcctcacacctgcagcaccagactgtgttgccgcacgtgggcagctctggggttttccagcccccttggagctggggcttccctgaccacagcccctctctgggagccatgtggcatccagcagccctgttctctaggggtggggatagcacattagatctggaaggtgaaagaactcaacaggtgctcagagagtagcagccgttataaaggcagaggcgatagggatagggggtggggcctcgttccccccctaaacacactgcagctggggaaagaacggtgcgtgatgaaaactcgtggtactctgacactgaccccacaataaagcaatataacaagaatcaatattgcttcggttggatcaacacctttgtgcatgtgaaaggtacgaactgactctgcagggagaacagaggagccccatttgggctgcgtgctccatgtgtgtcctcccggtgacttccccttctctctctcactctatttatttttttagagacaaggtctccctatgttgcccaggctggactcaaactccagggttcaagtgatcctcctgcctgggcttcccaaagtgctgggattacaggtgtgagccaccaagcccagcctctcctttctttttttttttttttttttttcagagacagggagggcaggggtctccctatgttgcccaggctggtctcgaactcctgggttcaagtgatcctcctgcctcggcttcccaaagtgctgggattataggcgtgagccactgtgcccagcttccccttctcttgagctgagagctggtttgagatctgttattgcacccacataaagcttacgtagggccagatatggtggcttgtgcctgtggtctcagctacctgggaggccaaggtgggaggattgcttgaacccaggcaggaggttgaggctgcagtgagctgtggctgtgatcaacagagtgagaccctgtcttaaaaaacaaaaaaaggccaggtgcagtggctcacgcctgtaatctcagcactttgggaggccgaggtgggaggatcacttgaggtcaggagttccagaccagcctggccaacatggcaaaaccctgtctctactaaaaatacaaaaattagctgggagtggtggctcatgcctgttatcccagctactcaggagcctgaggcagaagaatcacttgaacccgggaggcagaggttgcagtgaactgagatcacaccactgcactccagcctgggcaacagagcaagactccatctcaaaaaaaaaaaaaatgcttaacgccactgttatctaggaggaggttttggccaggtgcagtggctcacgcctgtaatcccagcactttgggaggctgagacgggtggatcatgaggtcaggagttcgagaccagcctggccaatatactgaaaccccgtctctactaaaaatacaaaaattagctgggcctggtggcgtgtgcctgtagtcccagctactcgggaggctgaggcagaagaattgcttgaacctgggaggtggaggttgcagtgagccgagatcgcatcactgcactccagcctgggcaacagagcaacactctatctcaaaaaaaaaaaaaaatgcttaacgccgctgttatctagaaggaggtttcagcggggtgcagtggctcacgcctgtaatcccggcactttgggaggccgaggcaggcagatcacgaggtcaggagatcgagaccatcctggctaacacggtgaaaccctgtctctactaaaaatacaaaaattagccaggcatggtggcacgcgcctgtagtcccagctactcaggaggctgagggaggagaattgcatgaacccaggaggcggaggttgcagtgagccaagatatcgccactgcactccagcctgggcgacagagcaagactccgtctcaaaaaaaaaaaaaaagaaggaggtttcagcatcacggagccgcgtctctgtagaatggacacgtgtttcactcatgctgcagcgctaggagacagccaccttagcaatccacaccccatctgcatgagaaagcctgggttcagtgttcccaactctagatgtgcagctggaaccactgattaaattgtcccgtaggcagcaggcaccagtcttcgaggggctactttgatgaattctgctagtatatttcccttgaaatggacccaaattataccctagctcagtatgaaaaggcactactttagaacaacacattatttttcattattcatcgttctttcatcaacttggaactccaagcctgtctctaagctgtcaggccctcttccaagccagcatcagacccctatcactgaaatcagtgcagaatgggcttttgatggacgaaactctagttataagtgacaaaaaacaatgtggcttccaagcctcttctttttttttttttccccagagatgaggtcttgctctgtcacccaggctagagtggtgcagtggtgtgatcacggctcactgcagcctcaacttcctatgtgcgagtgttcctcccacctcagcctccagagtagctgggaccacaggcatgtcacaccattcccgggtaattttttaaattattattttggtagagacagggtcttgctttgttacccaggctggtctcaaactcctggcctcaagtaatactcccaccctgcctctcttatttttattttatttattgatcttttttttttagagtctcgttctgttgcccaggctggagtgcagtggcatgatcctgactcattgcaacctctgccttccgggttcaagcaattctcctgcctcagcctcctgagtagctgggactacaggcacccagcactatgcccagctaatttttttgtatttttagtggaggctgggtttcgccatgttggtcaggctgatcttgaactcctaacctcaaatgatcacccacctcggcttcccaaagtgctgggattacaggcatgagccaccgcaactggccctgcctctcttcttttaaacccatatgtaactacctggatccagtggctggaggaccagcaggcctggcccttgtgatgccagtgggcacagccctctgcgccaggctgatgacaccatctgccacctccactacagggctggggaagcagctggagccgtggctgagtcactgtcggagcagctgagcgtcgcgtatgctacaactgatttcacagcatttgacaaacgtccccccacagaaaatgaacctcactgagtttccctgtccaacaagtcaattcattaactcagggcattaggacactaatcccccctgggagactcaaagccactgttcgagtcaaacccccacattctaagggctctttcatggttggggccatgggttagaaccaggcaccttttcatttttcgtggacagtggtattgtttgtgagatgtggccatgattgggaggcagccaaagagctgggagctctcctccccaagcacaactcccaggcctgtgaggggctcagcacggtgacccagccttccccagcacctgcccagcgagcctggcggcccaacagggttccattctcagggaggcaggcaggcgcctccgaggccacaaggggtttctaagggacaagcttcttcggcagccgtgccttgggcactgcagcacctgcccagcatcctggatggtggctggaaatgatatcctggagaaacaacttcctcaaagggaaatgagttcgtgttttctagagtgaaagttcctccccggacaaagctgagacctgcactggctttgagtgactaaatgtctttctgggaggctttgactcactgggtaacgtggaatgggcagtgccctaggctgcaaggcttctccgacatcatcccggaaccagcctttgcttccttcctcacatcgcagagcgcacctgcagtgcccgttccgttccctccgacctgtgcatcctccccttcccttcctggtcccgctggcagcctgccacctgtgccaggacaaacagctgcacagggatgccctttcctgttgccatccagggcagagctcaccgtcttctcggtactcctgcagacaccagccacacatgtgcagacgtgcatggctatttgctgacctgtcttcccaccgttcagaaaacaaaaacccggggagctcactgcaagagttgttcctgggcttcaattcctggatctggcacctggcgcacagtaggtgcacaagcaaatacctgagtgaatgaatggatgtctcctctttggggatcacgtggaaaccccagaagtcaaggccccagtttggtcccatccagctgaaaacaggtgtaaataatgtaggctaagcccagcggagagaaaatctgcagcttagttagtcctttgctttgttgagctagattcagctgagtcaggaaatccttcgtgatggcaagacgggcttggggcaagctgggccgcacaactcaccctctcaacacagaccttggatgttgaaagtgaatacagtgcactgtcctcacaacggggaaaaggaggagaacggtatgcgggatcccctgtactagccttacaacttcctgtgaattttcatttcaaaataaaaggttacaatgtacagagaggatctatgaaagccttggggaggcaggtgtcagctccatatgacagcctttctgacaaagctgtctgaaaatggaatggggtgctttaaagacagccctcactccctagaatcagacagccgaccatagccaccctcccaagctgacagtgtccttcagcagtgagggcccagctctggagccagattgcctgggttcaaatcccagctctaaaagttacttattcgactatcctggacaagttatttcatttctacaagtcttcatttctgcattaaaaaatggtagctaggtcaggcccagtggctcacgcctataataccaacaagtcggacgctgaagcaggatgatcacttgagcccaggagtttgagaccagcctgggcaacaaagtgagattccatctaaacaaaaaaaaaaatttttcaattagccgggtgtgatggcgtgcgcctgtagtcccagctacttgggaggctaaagtgggaggttcacttgaacgcaagaatttgaggttgcggtgagctgtggtcattccactgcactccagcctgggagggcaaggccttgtctcaaaaaaaaagaaaaagaaaaaaaaagtagataaaaccacatgagactttattggcaattgtgagttactctttccacatggcgacagcctgcaatgggggctccagtttggcttgctggtctcttctgggcagcgggcactgctgtctctactttccaggatggcagttggcccgaggggctctaacctgccattggaacctcacccatagcccagaagcctcattcacaacccttcccagactccactccaacttagagaacctgaaaaatggacatgtrgacatgtatctgaaagaaagtctaggcggttgcrcttagacaagggcctacggctttattaacagatgtcgaggaagctttcaggtgctggyagccatgagggtctggttttaaggatggcctttaaggaaaggccgtggcaggcgggctgagaggggckgctccagctcagccctgcccacagcacaggctcacagaagccgagatccacatcaccgcctggcatgcaaaggagttgaagacaaaaccatttttttccagcttctctacaaagccaattactaagcaacagttattaaagtgaagtatccatttacagactgacacaaatatcaaaaataagcagcttagatgagtacagaggctggagtgcattttctgctaacaaaaaccactgtgatattctcccagtttagagggaaaagtctatctcaggccgactcagatgtggcakaaataagtgggtctgaagtgcattttcagttgtttctgcccggaaggagcccggatgatacaaacaggtctggggttcgtggctctggcaagcgcccagagacaactgcgtctctgccaggacgctcatcctcactgcggctgtctgggcagatggctgttggcaggctagggacgacgatgaaaaactgacaatattttaaaaacccagtagggtccacagcagtgtttgaaatgacaggctttttatttctcaggaacagccgagatgacctccagaggtttccagcgaagctgtaacaatccaccctgcagctctatgacagggaggagggcgaatcaaatccatcatcttacgccagacttcagccstgcgggagctgctgcctccaaagaaagcggggacctgggcggactgcgtctctcccccgtgtggagaacgtgacagatgtgaaggttgggctgacagacacacggcctgcagcagcccagccagtcccccacagcatcgagccaagtcatttaaaaaggatttaggccactgcctttttctgagggaggagcggccagcatgtgccccgcggctcactgggcctgtctaatcacacagcagtggcaaaaggagtatctgccagacgcttcctatcactctattctgtctcctcatccacctgaagttcaccccgtttccccaatgacttagaatggctttgtgcttagttttaattgtagtttgtgctattctgtgaattaacaattcaaacaaaataagaaagccatgttgttaaacagtagaggagccrgggactctgtctccattctctcatcacacacaagtcatgcatctaccaaaaaaaaaaaaacaaaaaaacacaacaacaaaaaaactgtcctctgaggaggcacaggtgtgacagataaggaacctgcagctcagattcaacaggcacctgccaagtccacactcaggactgtgacagcctcaacaacatgaggtccagacacattcactgtggaaggctctgcccacgcgaacaaagctgtcawctctagcaaaagggacactgccttcttcctccctcacttctcacctggtaagcccgggaatcaaaacagcaaaaatgagcccccaaaaaagagagagagagagagaagcagccactgttaccagcagcacccgctgcacaggcagaagcacctctggtgccactttcaagacaaaacaagagcacagttgaaacatctaatttgaaaatgttgatctcctttcctaagacattgctaaggggcccacaggaaggctggtggcaccagggaataaaccctggaagtggtgcagccactctgggaccaggcagctccggccagaggcctcaatccatggcagccagctgctcgatggcacggcgcactttctycgcagtttcctcaaattctttcttcttattgttggtttcctttgcctggaaataaagaatagacacatgacactgaaaccagagcttcccagtcacatcctgtagataagatgacaaaggaaaaaacaatcagggaacactgagagagcacctaaataaactgggcactgggctaggcagattcccagctacctgggacaaacatcctgattcagctcaactccctctagtttaagctgcctcctaatcatcgaataacaggaaacactgacggagtgcttggtatgcacccagcaccactctacctgcttcctccattaactgatttatgttcacagtgatcctgcgctgggtgctcccatatctctactatacaggtgaggaaaccgaggtccaggctgaaggagccactcaaagtacccagctagtctaggcaccccagctagtctgggcaccccagctagtctaggcaccccagctagtctaggcagagctctgctcttaaccactgccctacctttctcctgaaactcctggaggaaagtccagagccttcctcttcatgtccagttaaacagaccctggcaaacatcaggctcttcctcgaacagaaattcttttgcttccagtccctccctgaatctggcttccaattttttcattctgctaacagagctctctcctaaggggcaaatgacaatcacattagcaaatccagggacccccttccctaccatattttttataaaccctaactcctctactacattaaaaaacaaagacctttattgggttaaatttgtttgctgacagaggttaacttaaaaaaaattactttttttttgagacggactttcgctcttgttgcctwggctggtgtgcaaaggcacgatcttggctcaccgcaacctctgcctcccgggttcaagagattctcctgcctcagcctcccgagtagctgggattacaggcatgcgccaccaccccggctaattttgtatttttagtagagatggggtctctccatgttggtcaggttggtctcgaactcatgatctcatgtgatctgcccgccacggcctcccaaagtgctgggattacaggtgtgagccactgtgccagccaaaaaattacttttcaatatgtactttatatatcctaagttttacctcatgtataagtaataaaaatttgtcattttttaatataaatttataatttataaattattaaaagaaaatttaatttaaaaataataaattgataagaaaaaagaaaacagtgcaccgtttggtttttttttttttagagacagggtctcgctctgtcatccaggctggaatgcagtggcaagatcatggcttactgcagctttgacctgcaaggctcaaagtgatcctcccacctcagcctcctgagtagctgagactacaggcacgtgccaccatgcctggctaattttttgtgtattttttgaagagatgaggtctggccacattgcccaggctcgcctcaaaactcctgggctcaatgaatcctcctgccttggcctcccaaagtgctgggattcaggcacaagccactgcacctggcccagcagcgcacttataatggactgtgatggacaactctgcagtcccagggagcctcagctttactgatatggaaagatgaccatggcttttaaaatatatatacacacatggattattcagtttcttctctttcaaaaaagccttaaattagcgaagctcctttgcatacatgctataatttaaccaccccaatgtggaggtcaatatctccattttatacatttttccactaaaggtaggggcgaagcaaacacaactcttgctattgaaagacaaaacaggccgggtgcggtggctcacgcctgtaatcccagcactttgggtttgggtttgtaatcccagcgcctgtagtcccagctacttgggaggctgaggcaggcgaatggagtgaacctgggaggcggagcttgccgtcagccgagatcacgccactgcactccagcctgggcgacagagtgagattccatctcaaaaaagagaaaaaaaaaaatttaaaattagccaggcatggtggcatgcgcctgtagtcccagctactgggaggctgaggcaggaggattgcttgagtccaggaggtcgaggctatagtgagctgtgattgygccactgtactccagcctgagcaacagagcaagaccctgccaaagaaaacaaacaaaacactcctgccacccaggtctacaactcgcctctccttctagtgcttcgttttgtcctcatcacaagtatttaccaagtaaactcttatgaagaactaagttgttcagtttatttccacattaaatttatttcctgatcgattttcacactggttctaatttatttcattgtttcaaaagctaagcaccgaggcagcagcaggaacaagaatcagcgcccaatgcatcgccctggatggccgggcctcagcttccacagcagcgccctcctggcaccctggcaaggcagcagacaggggcatcctgccatcaaatctgggatcttgggaatccccagcatcaccagcaacagcatccttgtcttcaggatttgtatagcgcaacacacgcacctgtggtcccagctacttgggaagctgaggtgggagaatcatttgagcccagggggtcgaggctgaggtgagccaagatcacaccactgcactcagcctgggtgacagagtaagaccccgtctcaaaaaaacaacaaaaaaaagattatattgtttcaaaattaaagtaataaaaacaaatccataaaagtattctgtattctgaattggggaaaacaaacaaacaaaaaaaacagttcaaaataaaagccaagcagtttttaaatctccctacttttcttgcaggctgtaatgtctcccctctttccagtgtggctgggtctgactatcaggagatagagaccgagaggtctcctgcagggactgaggcctctacttctgcctactgcgccttcagctcacacatcatgaaagcctacttttttttttttttttgagacggagtctcgctctgtcgcccaggctggagtgcagtggcgcgatctcggctcactgcaagctccacctcccaggttcacgccattctcctgcctcagcctcccgagtagctgggactacaggcgcccgccaccacgcccagctaattttttgtatttttagtaaagacggggtttcaccatgttagccaggatggtctcgatctcctgacctcgtgatccacccgcctcggcctcccaaagtgctgggattacaggcgtgagccaccatgcccggccctgaaagtctacttttcttaatcacatcttccaacaggtgagtggactccccctaccagactgcatcttcatccctgtaaccctagagcggagcaccccgcagcgtccaccagcacttcagggctttctggaactggatggtgtcagatttcagttgctctatttgcaagggcaaaaaccctctgtctttctcagcgctctgggacctggtttccagctcacacctccacatccactctgctcctcccctgtgcccatgatggttccaggcacacaagctgctccttgtctaaaacagggcttggcaagcaagggcctgctgggccaaatccatacagcccgtcatggcctttttttgtccagcccacgggctaagaatgctttttatgtttctaaaaggttgtgaaaaacaacaaaagacaatatgcaacagagactctgacccacgagggctaagagatggtctatggcacgctgcagaaaagctggctgacccctgacctggaaaaagatgatccccagcccactttccagttcccacgctgcagctcccacaacctcaaccaggtgacaagctctctcacagcatgcttcacccacaactggcctcttcctgacaaaacacaatctcagtccttagcacttaaaagccactatattgaggccaggtgtggtggttcacacctgtaatcccagcactttgggatgccaaggcgggcagatcacttgaggccaggagttcgagaccagcttagccaacatggcaaaaccctgtctctactaaaaatacaaaagttagctgggcctggtggcacacacctataatctcagctacttgggagcctgaggcacgagaatcgcttgaacctgggaggtggaggtcgcagtgagccaagatcgcaccaccacactccagcctgggcgactgagtgacactctgtctcaaattaaaataaagccacatataaggacagaattattttacgctgatctctacaaaggaatacaattttcaagctgaaaagcaacctgagaaaccatgggatagggggtctaacctctatttagcaaggaaagcatgagcacgactggcttaaactcaaagtctgcaagtggcagagacagaactacaacatctcctgactctccacccagggctttgctacaaggatatggaatcccccagtacttattctgtgtggggctgccagacttagcaaataagaatatatgacgcccaggcctggtgcagtagatcacacctgtaatctcagcgctttgggaggccgaggcaggcagatcacttgaggtcaggagtttgagaccagcctggccaacatgatgaaaccttgtctctaataaaaataccaaaaaaaattagccaggcgtggtggtgggcacctgtagtcccagctactcaggaggctgaggcagaagaatggcgtgaacccgggaggcggagcttgtagtgagctgagatcgtgccactgcactccagcctgggcgacagagcaaggctctgtctcaaaaaaaaaaaaaatcaaaaaattttaaaaagaccacgcatggtggctcatgcctgtaatcccagcactctgggaggctaaagcgggcagatcacaaggtcaggagtttgagaccagcttggccagcatggtgaaaccccgtctactaaaaatacaaaaattagccaggcatggtggtgcgtgcctgtagtcccagctactcgggaggctaaggcaggagaatcgcttgaccccgggaggcagaggttgcagtgagccgagatcgtgccactgcactccagcctgggtgacaaagtgagactcgtctcaaaaaaaaaaattaaaaataaataaataaataaataaataaataaagcccagttacatttcaacttcagataaatgactaagtttctagtaaatactgacacaaaatgtgggatttacttataccggtatatacttataccggccacactccaggagctttaaaatcacacagacatcctaggggctttaaaaatgattcctagctgggcacggtggctcatgcctgtaatctcagcactttgggaggcccag

SEQ ID NO: 17666 - DNA, 203127 bp, Homo sapiens
  misc_feature (1)...(203127): n = A,T,C or G, or insertion/deletion polymorphism (see Tables 1-2)
caccatttccttttgtgagccagtaactatccataaaaaactatctgctgatgattaatttaagtcaccgactgctgatattaccctgttcaaaccccctatcatgaatagtgaggtcaatacctaaattatttgaggaaaacaatggcacagaaatgcagataatgtaaagaagaaagcaaaaatcaactcggggaagtaccccagctctatcatatgctatttgtgtggtttgcggcaaatcacctcatgcttcctcatcaataagatgaggatagtaattcatatcttaaaattctgattagattttgtataatgaatattatatagtatcatatatataacatatacaacacaattatatattgcatgatacatattgtatgcaagtacatttctattgcattatctaaactgcatgataaaatagcttatgtaagctatttatcatgcagcatttatgtaaaggcaatagaaacaaatgtcttatttcttagtacttgagaaatttggtgtagcttgaaagatacatgttagtcttcaaagtaagtttattatgaatttaataactccatattttaaacttctaatttatgaagaattcttacttttggaaaacaaaaaaatttacctttgcagtagcgttcgctctcacttcaggactgctactgatgtccacagtctcatagacatgttcatatacctgtaaaagccaaagttatatctcagaatataccatgcttgagttctctgtgaagttaaaatttcaggcgaagttaaaatttcaggcaaatttatgcatctttataaaatggttttatcagaaattccaaaaatgagagggactggttttaatgttttctaaagtttttcttaagaaatgttgaacccaaatttagagtattatctgacctaattaactcaaatttttgtaaattttaatgatgtttactcacctctctcacagcattgcagaattcactttgaaggactctttgcaaagcctgaagtttctgtggtggtacttctccactcctttgtagtttttccaataattcaattgctctacaaatatctagagttaaacacacacacagataattttctccaagggttttctcaatgcctatgtaacagtggggcagttaggattcattcctcaagggcaaataatatacagacaatcgaggggaaaaaaagcattgaatttgcacatttggtgggaaggagactgtgtgtgtgtacacacatggagggtgagaatgtaaaatgtaagaacactaaattttacagtagataggaaaaactactgagattacagaagcataaaataagaccttggagaaacacaggcaaattgaacacaaaataccaaatgtcatcggaaaggactgtgactcaaatgtgaccgatacatgaacattgtactgcttcagaaaagctagcaatattgtcagaaactagtcaataaaaatttacctaattattattagtaaccaaagcactgaacagtacaaggcactataagctagtaaaatcactggtcattcctcgaaagaaacatgatacataggtagataaccactcgagagcagatgcagttagtggcagggacacatttaaaacaaccataaaaatgcaaaaaacaagcagtacaaatgaaataaactgattttttttcaacttaattaacactgttaattcaaacaagctccaacacttatgtttacaaaaaagaaaaataaaaacaattagctttatcaatctggtctcaataccacctgtgtgaccttgggcaagttacatgatgtccttatgtctcagtttctttcactgtacaatggaaataacagtaccttccatataagggttatgaggaagagttatgagttcagttaacaactgaaccacaaaatacataaaaaagggcttagcaagcaaaagtgttatgttacattggtaccaattaatcataagaaatattggctgggaatagtggcttatgcctgtaatcccagcactttgggaggccgaggcgggtggatcacctgaggtcaagagttcaagaccagcctggccaacatggtgaaaccccaactctactaaaaaaaatacaaaaattagccaggcatggtggcgggtgcctgtaatcccagctacttgggaggccgaggcaggagaagcgcttgatcccaggaggtggaggttgcagtgagctgagattgtgccactgcactccagcctgggtgacaagagtgaaactccatctacaaaaaaccaaacaaaacaaaaacaaacaaacaaacaaaaaaaaccctaagaggttgtatacatttatacaaatgtatgaagcacattagggaattctcactgagaagtgtgaggataagtgttttatgaattgagacattttagaagattcaggaagtcagctataacactgttaactatctctacttttatttttccaaaaactgttttggtatactgtttttgtacccctggtactacaatgcccagtattctattattgctttgcttccttttgacttaagtagaagttcctgatttcgttacactcaaggactggaaatttttctttatagagttagtatggccttcttcgtgtttgcagatagaaaactatgaataaatgtagtaaagaaagatatttatttatttatttgagatggagtctcactctgttgcccaggctggagtgcagtggcgcmatctccactcactgcaacctctgcctcccaggttcaagcaagtctcctgcctcagcctcctgagtagctgggattacaggagtccaccaccatgctcggctaatttttgtatttttagtagagacagggtttcaccctgttggtcaggctggcctcaaactcctgacttcatgatccacccacctcagcttcccaaggtgctgggattacaggcttgggccatcacacctggcagaaagattatttatttatttatttgagatggagtctccctctgttgctgaggctggggtgcagtggtacgatcttggctcactgcaacctctgcctccagggttcaagtgattctcgtgcctcagtctcccgagtagctgggactacaggtacctgccaccaggcccagctaatttttgtatttttagtagagacagggtttcaccatgttggccaggctagtctcaaactcctgacctcaagtgatctgcttgcctcggcctcccaaagtgctgggattacaggcgtgagccactgcgcctggccagaaagcagatttttaaatttgaggtaaagaaagcttaaacttaaaaagttaatcaaatgcaatggaagcaaatagaccttcaccattctgatttcccatcaccagaatgaccgatacatggggactgttggttcatcaattattttgatttataaagttataatatataagccatataaaaatttccagtgaagaaaaaaatggaaaaaagtaaaatgcttttgactaaatctaaaatgtacctactatgtgctcaaatttgtgtttcattaaatcatagtttgatgatttagaaggcactctaaatcatcatatgtgatcaggcactgtattgtaattgtactgtaggattttctactttaggatcgttgggagtgtttgttaatagagtctgttagaattctaaacaagaatcagaggtgatgtaatctgactttcttaccctgctaaatggcaaccactagtacagctgtcttggtaacagtgggggattcattaggaccttcttcagataccacagatatcaagatctgcagatgctcaagtctctgatataaaatgatatagtattggcataaaacctatgcatatcccccctctatactttaaataatctctagattacttacaatatctgacgctacgtaaacagttgttatatcacattgtttagggaataaggacaagaaaaaaatgtctgtacatgttctatacagacacgatttttttctgagtattttcaatctgcagttggttgaaatatggaacccatggatatggagggctgactgtaattcatcctactaaggggtggagtcttctactgaagaacagaaaagaaatctgtaacagcaaaaaacaaagccaagactatcaaaactaaatgccacagaagttccacattttgtgttgcatttaaaaatacaaagaccggccgggtgcagtggctcacgcctgtaatcctagcactttgggaagccgaggcgggcggacttcctaagctcaagagttcgagaccagcctgggcaacacggtgaaaccccgtctctactaaaatacaaaaaacagccgggtttggcggcgttcgcctgcagtcccagctactcgggaggctgaggcaggagaattgcttgaacccgggaggcagaggttgcagtgagccgagatcgcgccactgcactccagcctgggcgacagagcaagactacgtctccaaacagcaacaacaaaaacacaaaagaccaatacgttagaatcttaactagctttcaaagaaaaaacttactcctgttaacaccaaacagatttgctcccatctataaaacacagtgccactgtgctcaagaggaagatgtcagagacttaggcctaactcggcaagtcttcccagagtagctagtcctctaaaatgatgctttaataggcttaacggaaacaatctcatttacagtgaggcttccaaatggtgaacacggtaaagagcaaatcagcaacattaagtgcacatttgtttgtgggaaggcattaggaaagaggtttttctaagtacagtaattctaaaaatgtgttttcttagggaacaatagtaatatttagactaattgcaaatgttaatatgtgcaatataatttcagtctccatcctacatatacatttttttttaccaccagtactcaaaatgtttatttgtacttctcaattcctatcaatgatttctaatgctggtgtatgaaaagcatgcttgaaattgtttgaaataaaggacttagggacagagtggaatgctggaaatctgtaaaaggactggaaacgctggaatgctggaaatcatggtaggcgcatagccagttattttcgtaggcttctctatctctaattactcagcagaggtggttttattttccttgacagtctgctctaggaagcaatcagccaaccagtttgcaattgtagggtttgtaagaaatgaaaaacactgcacctgcaagtgttttagcatctaccactattcggcttacttacgtaacctccttcccaagaccaagtcagtaggattgtttttaaagcaacctctccatttctaggaggggcacaaaagctagcaaataccccaacccgaatacaagcgaggttgtggagaaagtaatgaaggagtttgtgtgcaaacagcggggaaaggaggttctgttgaattgtaccgtgtgtccgttctcgtgctgtacaggcaatgagtgtagtctgtgcgaaccgggtgtgtgacgtttgcttttcgggtgtacgggtctccgaatgctgcttctgctgtgctcaccaagggagcgcgtgtgcggcgtgtgtctgcgaagcgggcaggttgtgtttagttgtgctgtgccttggaacagtccgtgtgaacagaggagggcttacggttaacagacaaaataccgtaagcgcccttcctagagccaggcacagagacaacggcggcctctggcgccggcacaagggacagcgtggcccggatctcagagcctgggtcactcctcctcccctccagcgacacagcactcccccaacccttccgcccacctccgccgagcctcggctgcactcacctctctccagccgcacgggttcccctagcgccgccatcttctcccttaacctacagacccacaggaaatgacgacagaagggctgaggtggsggggcggggcctaggggaagccggaaaagtgagtaccggctagtatcgcgagatcaggaaggtggccgagtgtgtcgccgcggccatcagggtaagggtacctggacttgcggctttttaggtcggcctggctccgctccttccgcggtgacgaggtcccccggcctcctagggttgggaagagctgctttcctgactctcgttccctgcctcaggcttcccttatcccaatcgcttcgaacccttggctcagcgtagaggagtcaagcctggattctagtcccaccttgcccattagcagctctgtgacctgggactgttcacttaccctctctcagcctcagtttccgcatctgtacaacgagaggtcctatctcttaggtccttacaatttttaaactctgggattcggtggcaattaaatgtgtaatgacatgttgtcagttctcaatttgtgacagcattgctttaaatttraaaatccacggcttgaatcttccctccaaatctgttaaggggtggaaagtacaaagagcatgaaacatatctgggtgagggagagaacaaggtgctttggtgcaccacaaagtaacaattttataagcagctgattcttataaaatcttaagtaawtgaaatattgtgaagcaaataatattcttaatgcattacagatttttgagccacttctgaaattttcgcgaaccaagaagaattttagtatttggatttgactaacatttatccaagcccttagtctgtactgatactgtggtaggtgtgtttacatccagcatttcaacacttcatgatgggactgttttaataacctgtttgcccctggtccaccctttccattcacctttagtattttcttctccaaatccatcatggatgccaccactatgctcctttttctccccttgaattctgatttcatcatcacaagttctgttcagaaactttcaatggtttctctcctgtttcctatttctaaagccttgcatactctgaccctaactcatccaactaacttcatttctcattaccactaagtgcaaccaccacttcagtccagatagtatagtttcaaccatatttattcctgattccaagtctttttgtttgttttagagacagagtttctctctgttgtccagactggagtgcagtggtgcaatcacagctcaagagagcctcctgtctcagtcttgccagtagcgaggactacaggcaagcaccaccatgcctggcaaatttttaaatttttagtagagatgggggtcttgctatgttgcccaggctggtctcaaactcctgagctcaagcagtcctcctgctttggcctcccgaagtgctgggattacaggcgtgggccactgtgccaggctccaaatcttcatttgtgttgttcttgtgtggaatgcccttcttcatcccttcctagtctccaaactttgtacacactcagttgaacccatttcgtgggtccctgctgaaggcatgccacttctaccaagccttttctccatattattccccttttttgtcctctgatggcctaaatacgttgcagtaacactcaggtgcttatctcttactcgttgtcatttttttttgctgcaaatgtgttcaagaaatgtttattaaacacctaatatataccaggtgccttgataggaataccaggtagagcaagacaaatgcaaacattgcccttatttcttcaaatattttttctttccattctcttgctcctctcctttggtgtgactattggagtcatgtgcatgtacataatatacatgtatattgaactaactggcattgtctcacagctcagtgacgctctgttcatttttttttcaagattttctttatgtttccttttggataattgctatgttttcatattcattaatcttttttcaatatctaatattgaaatcctgtccagttcattcttcatataaaacattgtagttgttgcctctaccagtttgatttgggtgtgggtgtgtgtcttacatcttttatgtcttaacatgctcaacttttctgcagcttcttaaacacatagactacaattataatgacagttttaatatccttgtctactaattctatgatctatgctatttctggcatagtttctattgattgatttttctcttcattacagttcataatttcctgcttcttgcatgcctggaaatttttttttttttaacaagatgctagactttgtaaaatttacttacttgaaaaacaattttgttcttttgggttttgattttttttaggtggaaccaattcagtcatttatgtagggttaattgtatcccactactaagacagtacccttcaaagttccttaccccatacccaaagtgaattatgtggtttttctactttggtaggaacgggaactattcttaggaactgagtttgtggacttttttttgctcttttcctttccctgtctggtaatttatttcttcttctttcttccttctccttcttcttcttctttcttcttcttcttcagatggagtcttgctctgtcacccaggctggaatgcagtgacgcagtctcggctcactgcagcctctgcctcctgggttcaagtgattctcatgcgtcagccacccgagtagctaggtttacaggcacctgccaccgcaccctgctaatttttgtatttttcgtagagatgggatttcaccatgtttggctagctggcctcaaactcttgtcctcaagtgattcacccaccttgatttcccaaagtgctggattacaggcgtgagccgccacacccgggtggatgtttaacacatgtaatcatcataraatttcagaatcctaggaatagatagaagatcctagaagtttccagagaggataaaaaattatattctaaggattggaaatcagaacaagattgtacttctcctcagcagcactggaagctaagacacagagagcaactaaatttttagaaaaaattatttgcaaactagaattctatatccaactgtattaggtttctagggctgccataacaagatacaacaaactgggtgacttaaaacaatagatagtcactgtctcacacttctggaggcgagaaatcagaagccaagatgtcatgtgctctctgaaagtgtagaggattccttccttgtctcttcctagctttctggtagtttgctggcaggctttggtgttccttggtctgcaactgtattacttcaatctctgttgtcattatcacatggcgtcttcccttgtgttatctgttgtcagctggaaatcatcttacaagaacttcctatttcggtgtgaccttaccctaaattagttgcatcatcagtgacctcatttccatataaagtcacattttgaggttctgggagttagaactttaattttttttttgaagggaagagatacagttcaccccgtaacaccaaccagagtatcaatcaggtgtgaaggaataatgaaaaatattttacacatgtaagttctaaaaattgttaaccttccatacatactttctcaagagctactagaaaatgtgctccatcaatagtaggaagtgagccaagccaagtacagtagctcatacctgtagttcaaacaactcagaaggctgaggtgggagaatcacttgagcccaggagtttgaggctgcagtgagctatgattgtgccactgcactccagcctgggtgacagagtgagatcccatctttaagaaaaaaagttagctggccagggctggtggctcatgcctgtaatcccagcacttcgggaggctgagacatgtttatcacttgaggtcaggagtttgaacccagcctggccaacatygcgaaactccatctctactaaaaatacaaaaattagccaggggtggtaatcccagcccctcgggaggctgaggcaggagaatcacttgaacccgggaggtgcagtgagccaagattgcgccactgcactccagcctgggcaacagtgcaagaatctgtctcaaaaaaaaaaaaaaaaaaagttagccagtaaaggtatgtgtaatccaagaaaaagaggatccaatatagaggagattaaggtgatttcaaaatgattagtgtatcagggtgcctcacagaaacagaaccaatagaatatatttagatatatagaaaggatttattatgatggattggctcaggagactacagaagccaagaaatcccataatttgctgtcttcaagtgggagacccagaaaagatgctttagttccagtccaagcatgaagaaccaaggcctgagaaccagaagagcctctggtgtaagtactagtctgagtccgaaggcctgagaactgagaacactggagtccaagggcaggagaaagatatctgagctcaaacagaaagggcaaatatgccctccctctgtctttttgctctatttgggccctcagtggattggatgatgtctgttcacattagtgagagtgatctttactcagtttgctgattaaaatgctaatctcttctagaaacttcctgacacactcagaaatattgttttaccagctatctgagcatcacttagcccagtcaaattgacacataaaattaatccaccacaattgtgaagggaagcctagggtagcagacatgcagctggcaaagagagcaatccattcacactgaagcagggcagaagtggaggtgaggtgttgccaagaaaaaaatgaaatatgtagttcaccagtgtgggtgagcatactgataacacatttatgcattttagtggagagtttgggaataaattggtgataggcacatagaaaactaagcaaacgggaggaaataaagcaattattaactccaaaaaaacctgaaaagccatgtaataaaggaaatgtttatgagtataaggtggatcagctgcatacaacatattcagcaacttttaatttttttgagtataaaccctgtaatgctgtttgcatttttaaagacattttaataaaaatgaaaattaataaataggaatcacaatactaaagataatatttgatatattttattttgaaatatttaatttgtattggcctcatcttttcaatttgaaatctttgctcttgggaaggggaataagaaaacttaattataagcacaatttgctgaaaaagcacagacttactaggtttaaagtagtgtttaatgattagacaattttcatttaatagatttgtacatctgctttgtttggtatttgaatctcattgtgctgtagtctatggatttgctacccttgatcagatactcacccttggttcaatcaattctatctggtacagtggaagtaatggttcacccaggtccctgataagtctgggggtagaatatcttcccttagaaaaggctagagtacagcaggcaatgtatttggcctgtctaatatagtacattacatatacatttgggaaaaatgttgcaaattccataagagtagcagcctgacattatgggaagagcrcaggactaagtgtcaggagctctggttactaatcatagatgagccaccttgtgatagtgtgatcttgacaatgtcacattctcactctggacctgtttccttatttggcacgaccactgaataagatctgtctgagccagctgcagtgacatccacctgtrtgtagtcccagttcttggaagactgaggcaggaggatggaggccgggagtttgaggctgtatgattgcgcctgtaaatagccacttttcttcagcctgagcatcacagcaacaccccaaatctttaaaaaaaatctgtcagcacattaaaaattactttactctatgtcaataaagtaattaatataaatacagattcccttgaacttcatggacttatcaaatcagaatccttaggagaaggctctgggaatctatattttaaaaaatccctagtgattctgacacagctagcctgacacagggacctgtgttcaggatttaaaagattatttctagggcctttttctactaaaattcagtttccctataaaactgcagagaaaaattattgagaaaatgattttcattataaaagaatatgtagctcttgcataaagggcagcatttctagctaattttaaaatttattttatattattttaggcatagataaggaagaaaaaagttttggaaactacttctgagagggaaaaatatgcctgaaattaaccaacagccagcttgtacttaacatacaaaataaacaaaagaatcaactattgtgtaaggagagaaccccgaaatgttcctcgttaatcgaaattcaagagtattagcgtcgggaaagatctagagagtcaactccctcatattaaagaagagaagatggattgctgtcctacattcaaaggaggccattaggagcatgaaccaagggaagctggttttccttctatgcctctgccaggttattaaatcaccaggcctcctaatcaagaattgctcttcgtgtggaagaactcctcttcacctgttgcttcctcatattatttcctgcctcagagatgtagaggaactgtaaaattagaataggatgtttgggtctagacaaatcccagtgaaagctaaattatggaaatttagtctttgtataacaaatgaaaaccctaagtaggctgccaaggtacaaaagctttcttaacccgagacattgcaaatacaacgtactaagtgaaaaaaggagtgggtggggaacagtgggagtagaaggctgtctaaagggaagctaggaaaatggaaagtaatatggagaagcmacatgctccaagtggagtgttttactatttcattgcctgttgaactgtacacaaataggcactactacataaaatagctatttgaaacagttatgccattgcagggtagaacattactctcaagtaaaggcttctaactgtacaattaaagtctcaatcttctttttttaacagaatttctctgatgtactcagcaaagtaaaattttgaatagattattttatttgaagtgaatgatattgtcaaatgttaaagagtctgcattttaaaataatttaaacaatatataaaaacacttggcctaattaagtaatcataacagtatggaaaaatctcttcaagagcacctttgaagggaaattttatcacagatctcagatcagaacatagaaacccatctgtgagttccagagatctaacataaaccctacttttccttgtaggatgagttgcagattctattaaagtgtaagggttgacttttttaatgtcacttgtttcatcatcactctgtagtacatgtaaaggcacagattgatgtatttttctggcatcttcctgacgcacccttgccctatataaatcggtttgccaggatcttgttgcttaaattagcgattgcaaactcttggtcctgccaacacagccgattgtgccaaggttctcagcatctactggcacatgaactgttgccttttctttggctttctgcatgtacctggggccatcatccttccttcacaaagcagcagtctggcttagttgtccctgagaaagacttcaggattggttggactcaactctggccctcttcaggttgtgcatcctgcacaatgtattttcagccacacaatgtattgttcaggatttgtcgtgcacatacttgcagattggcagagccaactgccagagatgagaaccttttaagttgttgtcaaacgtcataaaatgtgttccgtgattaattttgtgggcacagattggtttttgcacagagtccaaaatttaggatatgtcacagtgactaaatggcaccggcatgctgaatgaatttggaatttgttttgtcaagtgtgggagcaggcacacagatgggctttgatccagtggtgctgcttggaattctcattatagcaatgatgtcmcttgtcacgtggagtaagtgataatgctgccaaattgtggaaaaagcaaggcaaataggaaagtacacagaccaagagaaaggacttaggtagcacagtaagctttcactatcagatgaatggacataaacattgcttttgggctgccaaaaatatgcatagtaaaaatacaggcagaaaggaaaacttccaactgaaagggcccttaaagtagggcccctgtaatccaagaagtcttcacttcttagagaaaatcaagtaaagcaaacatgtccttgatttttatattaggctatgaaagaaatttctgagctgcaatcaagagtctttctgcaatatctaaccaaaccaaagccaaagtattttgctttataaaaaaaacctttgtctatgaagaagatcagcagtcatgctgggaaattgaaaaaaacaaaaaccttatagtggcaaagaagtacagtatactctcaccaagcatgcacatcagaattctctgtagggctttaaaaatatattcttgatgcagctacagcagtgcttagagggaaatttatagctataagtgcctatattaaaaaaaagaaaaatatcaaattaacaacctaaacttctatcttaagacacttaaagcaaaacaaactaaactcaaactaagtagcagaaaggaaacaacaaaagttagggcagaactagaataaaataacgatacagaataggaaaacatagaatataaataaaaacaattgagaaagatgatgaaaccaaaatctggttccttgaaaagatcaacaaaattgacaatgctttaactagactgaccaggaaaaaaagaggaattactaaaatcaggaatgaaacgggacatttctactaaccttacaagaataaaaaagaatattaggaaatactataaaaatctctctctcttgccacacacgcagtatatactatatataactgaatgtatgtcatgtaacttatctaatttgttgaaaaatatatttgtcacacaattcacgtcagagggtcaccatgtaaattttgattcaaaaactcgagtatggcatgaacatttgtattttctgaaaatataaaggtttttgtgagtgacatgtactttttgttgagaaccattgatctaccacatggaaggcataaaaattgtggaattacaattaaatatgcatcaattagaattaggtatagctgcatataaacacaaaaatccaggctgggcatgttggctcatgcctataatcccaactttggcatgatctcagctcactgcaacctccgcctcccgggttcaagcaattctcctgcctcagcctccccattagctggcattacaggcgcctgccacgacgctcagctaattttttgtgtttttagtagagattggatttcatcatgttgaccaggctggtctcgaactcctgacctcaagtgacccacccaccttgaccttccagagtgctgggattacaggtgtgagccaccgcgcccagctattcccagtattctgggaggctaaggcaggaggatcacttgaggccaggagtttgagatcagcttgggcaacatagcaagaccctgtctctacaaaaataaaaaataaaaaaaattagctagtcataatagtgtgtgcttgtagtcctaactacttaggaggctggggygggaagattgctcaggcccagaagttcaaggttgtagtgtaccactacactccagcttcggtggcagagcaagaccctgttttggaaaacaaacaaaaaactattttgaaaaaaaaaaaaaaactcacaaaagtccaaaataatagtgcatttaaagtgaatgaaagaaatccatagataggtaacttggtgcaagtatgacagccccatggtatcaccaggatcccagcttttttcattttgcatcaccatcctaggacatggcttccatagtcaagttcactcataatctgagatggctgcaggaatttcagtcattacatgtgagttgcatgccagaaaaaaagaataaggaattgcagaagggtaaaaatcaccctttccagttgaataagcatctttaaagcacccttttcagatgtccaacataatattttgacctatatcttcttagccagactcagttacatgtctccatcttactgcaaaagaactaggaagtaaaatcttttattttgagtgacaaagagcccagctacaaaatctcaactctgtccccaaggaagaaaggtaaaataaatatggggataagccttcagcaagctttgccatactacaccacaacttctggaaattacctttaaacctagttcctgcagcattcccggtcaatagatttatttcccttcattggaaagttttcaacttaactcaaaaacgtttactagcaggtgctacaggagagaggagaaatgtcagatgtgttcatgtccttgaggaactttcaggcaatttcagcaaacggaaactacaccaatgagacagtaggaatgttatctacctgtatgtactgcaatgctatgttttatggtttggaccactactttatattttaaacctaaaaacccattgtctgcaaactgactcaaactaaattgaaataagccacattactgttttaacccaaactgattctgaaagctagtatttactcaactacaaaccattcagtagtgtgaagattaaacaaacaagcaaacaaaaaaaccctctccagatcctccagatccatgtttccccttccttcctttcctgtctgtctctctctttctttctttctttctttctttctttctttctttctttctttctttctttctttctttctttctttccttctttctttctttctttcttttctttctttccttccttccttcctttctttctttctttctttttctctttccttctttcattctctttctttccttcttccttctttccttctctttctttccttcttccttccttccttctttccttctctttctttccttcttccttccttccttctttccttctttctttcttcctttcttcctttctcgcccaggctgaagtgcagtggtccaatcttggctcactgcaacctctgccttgattctcctgcctcagcctcccgagtagctaggattacaggcacctgtgaccatgccagggtaatttattttttatttttagtagagacgggatatcaccttgttggctaggctggtctcaagctcctgatctcaagtgatttgcctgcctcagcctcccaaaatgctaggattacaggcatgaaccaccattccctgttcttagtgtttcttataacttcccagatatgaacaaaaccttgcaaaagagcatttcaataatctttagcttctcgatcttccaactgatgtggccatcaaatggctagtcagaagacaaatagatgaagacaatagctttattaaagtcaattcaaattatgacctactatggtaagacactgtgctggggtctagaggcaccaggacttcacccttctctcaacagctcacaaacccagtggaaagggtcagacatataagcaaccaacagaaacaaaggagatggcattaaatattattctgctcttgttgctttagttgttgctgcttattgttggtcttgttgttgctttagttataggggtttttaacagagttgcaaagtgttgtggagtaatgagtggggagaaatgatttctcactggaggtaaccagaaaacagattagagagcagtgattctcaaccaggggcaattttcaaacccataggacatttggcaatatttggagatatttttaatggttatgacaatggatagatggatagtcagggtgagggttggtactggcacgtagtgagtagaggtcagagatgctgctaagcatttttcaatgcataagacaactccctacaacaaagacttactcagcataaaatgtcagtagtacctaggttgagaaaccctgcttgaataagatggatacgttgtacaagaaggatcagaattttcacaagtggatgaatggggacaagaatcccagagagagtactaaatgagcaaagccccattggaaaaaaaatataggccctgttcaggaagtaggagggagggcttcagtggggtataggttacacaacggaacctgaggaagctgtaaaaggaaagggggcttagcatttagattgaggctgagtgcaagctgctaaagtttggattttattcttttggccagagtgagctattgaaggatttaaaaaatggaagcaataggattaaaagtgtgttttagaaataaaatcagagggaaaagctttgattctcatagcagattgtaagaaaattcctttaagggagtcacccttattttgggtgttgtctgatgtttattaacctctggttgttggaaaatagcaaaactgcagagaagggagaaattctgcatatttgggcctgggttggatgggcagtgaggggtgaggaaggccaagggaatgagagagtggtgcaatgctgatgtttgtgctgtgagacccttcttcatggcttccagagctttggtaatctttacaaaaattataatatgcttgtgcttggatttcttgtgcaaaatgactatatttgggttgattgtgaagattgggagaggaggttggtgacaatggtgcaatggtagcatagaagtaataatttggatgcttctataatgggcagtttcttctcctacttcttcctttcagatcctgtagtcctgtcccacagaactgctcatgcttctccagtacgccagtctgcatcatacttacatgctcttctttctgcttggcacgctttccttttctaacaaacttctgctcatccttcaagacccacttcaaatgttccattctctgctctgccctgtatacaaaatatcaatattgtattgtgtttgctaaagtgtttattttccccaaccagagagtgagccccttcacggctaagaatggcattgtaatcatcactgactctccagcaggtagcaaagcatattaccgaagctccttgatcatttgctgaatgaaccatgggtaataaaatcagtgagtggcagaaagattgtggctctgggcctacatagcctttgcctggttgctgttagaactacattttcttctctttattaattttatattttaaacttcatccccaagcttaaacatttccttccaatagatgatattctatcaggaagagaaaaaaaaaaaaacccaaagtacaactttaatccttgagtgaatgggcwaaaatcaggtttcaatatgctttttagaatacttccatgtaattaatttaacattgacctgcttattaagagtccattattaaggaaacaattgtaaaagtcattaagggcatttccacagatcttagctactgactcatcttgctagttctcaataaacgtgacctgaaaatctcycattcgcagtatcaggtaaaatgttatttttctaaccattaggaaacatttactcttgggctgatttttatgtgtttttattgttgttgttaatgtgaagaaagtcctatacaggaacagctgcgcatatgggtaaatgcctgggaatggtttaaagatgccttttcaaaacatcttccccacactggtattatkcaatgcctctgtctcaacaattaataagtatttccttttgagttaaaccatgaagtatatagtcacactagctcattttgagatagggcaagactcttctggcatcagaaacccatatttggaatgtggatattttgtcttttctgtttgttatttcatcttatgttttccttcaggatttagtaaaattctttatgaaagtataagctggcttaggttaggggttttcaactctgctagggggcaagtttaatgagggagccattcatcctggatctgaggaagtcgtaaagatgacaccaaagtttcaaagggccccagaaccctggcaargttctggcatgaccctcatccctcgtcccccaacactgacagcctctccaccacaatctgcctaagagacaatccaggacaatctcgccactcccttcatcccatataccaaactataaggtcattcctaatagtctagayctacatcctgtttgtttattccctattctgaccccattgcccatttcccacttccaccccttttctgtgctctgtggcccattatcggctaaagccctcatattctcaaccttttctcttagtgtctcctacacattatttttttaactgaaacctggacctctgagtcctgctttcttgtagcctggttgagtggtgcttattttcttttccacacccctttgagttaaggcaggaagcctgtaattattccaggttcctttaggatagagtatgactcttgtgagaccagaaacatatagcctatatttggaatgtgaatttgaatagaattccggacttagagatggggagatgtctccctggtttttattgctcctattagaccaagttctcttctcccttggtgtgaaatttagacatcattaccagctaccctttcttattgcagttatctgctgactgggttactttccacgttctttgaagatgtaaactcccagcttatccgcacttgtttgtgacaacaatttgtctgtcacaattcctagatgatcatttcaatactctctggcatctgagtcccttgacctcttctcctataatgatttcattctcttccaacctcagccactcatgctcatggaatgagccattcatagcctcccctcaactttgtccttatcaataactcctcatcttccataatctccatctcccatccaagaactaaccaggtccgaccatgcttagcttctgagctcagacaagatcaagcatgttcagggtggtatagccatagatcaaaatctcaatctcaagcattctaccctaggcccaccacctcatatctttccagctcactgtccctcacattctgacttaaaaatccgttgacctaacaatgaatttgtcctaccatcttttcactgtcctttacatcctgtgtatccttacctccttatccatcctagatcttatagtctatcataatcatcactcactttatacaactgtaactccctggagcctctttcatgttttttttccttctttggaaaacccccaatcctagttatttgcagcccttttcttactctgtacctgttttctggttgctgaacttggctggaggaaagtacccaatctactgcttggtatcactttaaactcatgagcccccaaatttaagtgggcccagcaattctaattcattcaaagagtttgtgaactcttgcttcacaaacatgatctcaaaccttctgctctctcctcaaacttttgcgacttcttggttctttattctcagctgatggccttgatttcttttacacggcgaaaatggaaacaatcagaggagaccttccacatgtggttcccatcacttcttccaaacctgcttgcatcttcgcctgtgtcccctcatccattctgtcctctgaggaactgtccatgggtctgtccaaggcacagccctcctgttctacactaggtcccaggatctcacatctactcaaggagatcactctagcaattttactctagccattttggagaggctctctcttcctgtttgtttttttttttaatttttttaatttttatttatttatttatttattttagatggaatcttgctctgtcacccaggctggagtgcagtggcatgatcgtggctcactgcaacctccacctcccgggttcaagaggttttcctgccttagcctcccgagtagctgagattacaggtgtgcaccaccactcctggctaatttttgtatttttagtagagacggggtttcaccatgttggccaggctggtctcaaactcctgacctcaaatgatccacgtgcctcggcctcccaaaatgctgggattacaggcatacrtgatgacgcccagccaaggctctctcttcttcctcctgatcaatttatgtccatcagtatataaatatgctttatttctatattaaaatactttcccttgatctcaagcttccctgcagctacctttgcatttttcttatcttctttataacaaaacttcttcaaagtattgttcatacttgtagtatccatttctgctctcttactctctcttcaataactctaagtagacttttatctacaccactccaccaaaacaaccccgtcagcatctccagtgacttccatgttgtcaaagcgaattgtcagttttcagtccttatctcactcgaaacaattgatcactgcctccttgatacattttcttcatttgatttctgggatatcatcctttcaagtctgagcacttacagtgtggccatctcaaatagagatgtctgagtcttctatcaaaatcttcgctgaccttattgggtactttctcaatctttctaatggtttctcttacttggcttcttaattttggaggaccctgagaattctatccttagacctgttctttgtctacactcactcactagatgacctcatttggtctaataactacatactatctaataactatatactatcagtgctatcccatacaaatataatgcaagccacattgtagataggtgagtcacagatataattttgaattttctaatggccacattaaaaaatgaaaaggaaacaggttagattaatttggtaacatattttattcagcccaacatattaaaaaattaacatttcaacatgtaatcaatgtaaaatgagtaatgagatgtttttcattttttaaaaatattatttgaatttcagtgttcattggcatttatagcacatctcaatttgaactagccacgttttaagtgctcagtagctgcatgtggctagtggctactatattagatagcacagacctatatgctggacattggcttttactgagtgagatagccaatggaaaggttttttatatacaaagttttaaatttaaaaatatatatacagatagggtcttactatgttgaccaggctggtctcaaactcctggcctcatgtgatcctcccatctcagcttcccaaagtgctgggatttacaggcatgagccactgtgcccagcccaaatggaaagtgttggggagggaaatgacatgactactcttttttttttttttttttttgagatggagtttcacttttgttgcccaggctggagtgcaatggcacgatctcggctcactgcaacctctgcctcctgggttcaagcgattcttctgcccagcctcccaagtagctgggattacaggcgtgtgccaccatgcctggctaattttgtatttttttttttttttagtaaagacggggtttcaccatgttgggcaggctggtcttgaactcctgacctcaagcgagtcacccgcctctgcctcccagaattctggcattacaggcatgagccagcatgcccagccatactactcatttttaaaaggccatcctggctgctccgttgaaaataaacaatgtgggagtaagggggcagcagagagaccagctagaaggttagtataggtcaaagatgaaggagagagtgggatagactggaagaaaagtggtatgttgaaggtagaacatgttgaagaataggatttccagatgaattgtacagaaagaaagcagtccagggtgatccctggatttttaatctgaaccactggaggaattggaagaatagagttgcctttaggtgagatggggaggactgagatcaataaattttggagaagcagagatcagtagtttgaattttggatttgttaagtttgagttttccattaaacgaacagacgaaaaccacaaacaacaacaaaaaaatgaagatagcttctgatagcaacatgtgtcatgaagaaaagaaaatagccatagagtgactgaggaggagtttcttagacaagcttgtcagtgaaagcgtctctgaagaaggggcatttgaactgagtcctgaatgatgaaatgaggccagccaaacaaaaatctggaagaaaatcatttttagttagagggtactacaaagataaaagcttggaggcaggaatatctgagagacagaaaagcggccaatgtgtctgaagtgggtaagatggagaagcagatagggaccagtcatacagtgccttgtcagtcacagtgaaggagtttggatgctattttatgcactgaaggaagcctttgggaggttttaagctagacgtagcatgatctgatttatgtattacaaagaaaactctggctcctggatggcgcatggatttgtattatactaattattattgctattattattacaggagacaaaagtagaagcaaggagagcaattagaagcttttacactaactgggcaatacattatggttctttccactacacagctcttcttctcttgcctctaagtcttttcttgatttcaacgaattcctggagtgagagaatgtgtattcttagtctctgtgccctctgacatgcccagcactatgtcctgcccacagcagaaggctcagtacttatttttgagtgaattatatggctcttctcatcaaggctgaggagcacatttttaaaaaatatatatttgtattttttgtacatagcatattgtctgtcccatagttaagactcaatgaatgtctgttggagtggggcaagacctcacttcagataaccagtttactgagagagatccttggataggcagaggcagcaaagagggtttgggccttgctagcatggagggtaggaggaaggcagggaaggtggagcatgttgagagaagagaggtggataaagtcacccagctctgagcaggccaagggtagatttggtctatattttaatttaargctggcctggtttcattgatggtgatatgatccctatgtgtgggaataggtgaaatggtttgatcaccatgggaccataatccattacccaaagccttcattaaggagataattctgttcagcctcacacatagccaggcctacaggaatttgccatccagcaccaatactgatgctacaagtcccagcaaacacaggatggcaggccaaattcaagctttctggcactcctcctcttctggctgagcccaatgtcctcaggcctaatctcaggctggcagagagttaagtgctgggctgagtctgtgctttgctgcatgtgctggacttgcatttgattctgtccaaaagaggtctgtggaccagagggatgacatttggcaccaagaaagtaacccaggtgtctgtctctttttcagtcccaaagccttattcttttccctcaagtctatgcaatcgtttggaatccatcactcatcacctagaggtttcagtgcctttagattagggttctrcacccatagctgatgatccactggactaccacacttggcacctgaacagagccaacaggactggttacaaattcgttgttaattactgtgtgtaattacactagacccaaggttggagggagacaccctactctgttgttgtcttatatacgaattctgtataattttttaaaagcscaccatttttactttctaattaggatatggggatttggggcagcaacctttgttatttaatcatgctttttctggggaggggaggagaggaaaatattttcctttttctatcaacaattgctctcttttccgcattaagagggtggaaacttggttcctccctcatcccctttaggcaaagagtccatggctcagattcataaaggttgttgattttgactttgggttgccctactctgtttttccccacctttcatgctaactaacacaatacataagtcttcctagccagcactccctaagggtggggtagaaacacagcccattaaaaaaattttttttaaagctttgagtaatctcctttttatattcacccaaatgaaccaggttggtggcatattctcctttgtttttacatctgagacgtacttaaagtttaaatagtgccagaatgaatcacattgcttgtgttcttatacccagctgcaaatcatgccaggctcaagcccaggaacacaagattgcatgcacgcagagagggtcactgctgtcttatctactcctgctctgctaaaaaattgcatttatttatttatttgtttttgagatggagtcttgctctgttgcccaggctggagtggcagtggcatgatttcagctcactgcaacctctgcctcctgggttcaagcaattctcctgcctcagtctcccaagtagctgggactacagggggcctgccaccatgcctggctaatttttttgtatttttagtaaagacgggttttcaccatgttggccgggctggtctggaactcctgacctcaagtgatccacctgccccggcctcccaaagtgctgggattacaggcgtgagccaccacagctgaccagaaaattgcatttattatatactgccccgtccccatcttggcattctgatatcattgttgcccatcctttccttcccattgagagagtcaacatttcccctttcccatcctattctcattcctacttctagctttactatctactgtataacctgctgagcctcagtttcctcaggagtaaaatggagataataagaaacacctgccttgccagtgtcacacagctattgaggatcaaatgagataatgggataggaaagtgctttatttctacaaatgcaagctattgtcagtatcatttacttaactattcttcgttagctagctacgtagtctagcttaccttgtcgtgttccaaatgtggaaggcttgctgtttstggtaagttgaggaccatttcaaagcctcaagaaaatgattagaaatgaaccaatgkgagaacattttctttgttgggtagttcatccgattattatgtatgttgtttgtcttcttttmatttggatataggttgccttcagctgccagtactgtgaaataagagacgatattataaatcctttggagattaagcatttccatcctaatagctgctgctcaaaatttgatttccccttgattttcaataaaaggaggataacagaatgttattcattctaattataaagcaacgggaattctaggcattactttacaaatagctgctttcatgtcagaataatgagtgttgagaggaagagctctgagccctttactatattctttgttttcattatttttgtacctgtaaggaagatggacacattgagggacagagactccacagaagttgtctgagttgtgacagcttctcatcttctttttcatttccgcatttaacatattttctacaggctttgtaaagaaaataactcagtctatgtttacaattttcacactggctttaacttattttaacttattttatttttggttggtgttcaccctgggtttctgagggttttaagctgtctgcaaaaagctgctatctttgtctccaaagaatggttaagccacttttgtagaatcagaatgttaggtgaagcccatctttacataggaaaaagcaaaaggaactaatattaattgaatgttcactacatgctgggtctcatgcgaggctctttacacatatcattttacataatcctcatagcagctctatattatataatatgatctacatttttttcacaagtaaaaaaatatttaaagggagcaagttacatcatcagagcttaaagatacctgtgctatacccctatgaaaaatctaattcactatgtgttttggtctatggcatttacatttttgaaacattttatctttcctaaattgtagttacttccccctaccttgacagatagatattgtattgtaaaaatacaatagaacaagtatcttttaaaaaatatgaaaacaaaacatttctagtcaattgttgaacttctttcaaagttctgggttaatatcaggtaggccttttactaatgcattttatttccttctgtctgccaccagctggagctactgtataaaagccaaccattttgagttcaaaatataactctgcaatatgaaggtagactacttttgctcctaaacaatttgagaataaattgcaaggaattaaagattgagaaatgcaatgtcatasatggttaagtaattgctattgatcacttactagttatgcaatttgggcaaattattttgactgtgactcccagtttagttagttatgaaatggttataactaccaatcttgtggggatcactgtagggaaaattaaatgttaagaaattagtaaggagcctaccacatagtatgtactccacatgtgttcattagtatcattggcagttattattattcattttgttatcagtatcacagccccagggatgctcaattcattgtaattacaattcatattattactcattatcgtgtgcctggcaaatggcaagtgccacttgacctcccattgctcagtgtgtgatttttgggtttcagtrtggtggactgtaggatggcacccacacaaagaggcattctgcttggatgtcaaaggaaaggaacctgtgagaggcatttttgaggttgatcgggtcattttgggtcagagcagtatttcccaatatatgttctgtaggattcttgtctcaatggatcaaataagaatgagaaatatmccatatatatcccttttccacttcacggagccacagtgcatgtaagtatatttaaggctctgaaaaatactgtgagaatcaacccttcttctatttatacctaatcataagtgatttctccattttctccatgaaattttaaaaagttgatatgtaatatataaatttagatgaatataggtattcatgatttcatattatagaaaaatatgtttagaaatatggcttttaactcaaattttatgtcttttttccactcaaattttatgagaaagacatcagtgttttcctccttattagcaccacctttggagtcatgtaattttctggagcacttactggctcactggtttgagtcacagcggtttttaaatgtgtatgatttgccacagtagattttatttctagttataagtatccgtttgtataatacctgaattaaaaaattcatcctagtgtatttttataattgttataataaatgatctttaaaaggttttttttttaaaaaaaaaaagcaagtaaaattgtgaggttgtaatttcagaaataattgtgaattttagttaaatttactggccttccatttaatactttttgtcaggtaacctctactaatttgacaccaaaactagcatttatttggttaatatgttcgccctaaataatacgtggttgataaagcaattataagagagcccagtaatacaggagctgctataagaactggaatatatgacaattctttcttttctgagggataatttgaggaaaaaccttgtctcatatctatatttacataacccagtgttgtttgtgtgtgaatgtgtatatgtgtgctgaaatacctstttacgtgctagaaacaccctcgtggtaatggtggcatagtgggtaattgttttcatcaggatttttcttgagaataggctgctagcaagtgctgtatgtgacagaaactttggccaaaaatctgtatttataactatatcaatttcttgtattttcttgttcattttaacttgcttttccctcagaatttaatcaagtcttcaaaaaaaattatggcagagtcactcccatccctgagacacttggtcaggagctttacagaaggttagatactccattaaggttagaatggtggtggattggtggttagaccacagaagaacccccaggggaaggtaaaggcctggggataaagacatggccctttttattctgtcatccttctctccttgtaatctcagyactgatgaaccattagaatctccatggaaggttttaaaaaaacacatgctgtcacctgagaacatttaagtcagaatgtctgggagtggaccccaagcattagtgtctctcaaagtcttcttcaggcttaaaagggttaaaccttctagacaatcatcagtccttttgtgtcttcctcctaaaaatttgaacagtagtgacctattagaagtcaagagttggatctaaactgagaaagcatctgtgcattgtgctctatttcttcgtgtagcttctccccactcccaagtcactcctaatatttccattatagatttagacacagaaaacccagatgaagaagctgcatgctcccgatgggatgggatgatattggtaatgggaagtctcatttctgaattgaatttgagtgctgggaaagcatattggctaatgtttcagtcctttggttgaatttgtgtctttgacaacaaatgcttgtggttgaagttatacaattctcatctctttccatttcccctcactggggcaggcttcctctgtgtatttttttcctctgatgggaaagagcatctgcagctacttttcttctcagccaatagactaccttcttgtgagttataaagaggataatatgtgaatcagaagccaagactagaacccttctcctatggacatggtctattcaggaggcaattttagagataaaaatcaggaacaccagttcaataataataataataccttagaagttaacataccttttaaaacactttcatatttgtcccttttctcttgaacattccaaagagattgacaggacaaataccaatcgcctcattttaagattaagaaacgcagatgctgtgaagataactcagttccccatgataacatggacagggacagaggtcggactaataactggttcttcagtaattactcaccttgagcagctctgaaggtcatagagtagaccagtgagtggttcccaaacttggctgcttactagaatggcatgggaggattataaaataacacaattatgccaacttgcctctggggctctaattcaatacacctgggatggggctcagggaatctgtcatttaaaataatttcttcatagttgttctcaattttgactaaatattagaattacctggcagggaggggctttagaaaatcccactggagaatcacttgagcccaggaggttgaggctgcagtgagctgtgatcatgctgctgcacttcagcctgggtgacagagtgagactctgtttaaaaaacaaacaacagcaacaacaaaaaacatttcccagattgtattccagacaaattaagttagaatttctagtgctgggacccaggcatcagagggtttgtaagtatctccaggtgattccaatgtggaactaaggttgagaaacactgctatagactagagctttacaaactctgtttttcagaatttcagcacagcaagaaggaaaagacaagtgtagaattgtcacatgtctggagtaagaagaccaggattcaagtcctggctctgcctcttgggaatgtcacttcatctctctgagcctcagttttttatttcataaaatgaggaaaatgagcagtacatacctctcagggaggccatgagggttagatgggatattgcaggtggaataaccaagcaccagctattcctgctgttttccaaagaactccattaagattgtgtgtgtgtgtgtgtgcgtgtgtgtgtgtttccccctagatgttccctttgtgttcaaagtttccaccctcaaccttacacagagttagacttgtagggcatgaaacagagctccaaaagtttccactaatgaaataaggtttggaaattaaaggaatgtcgttaaggcttctttttgctgttgctattggcatgttcagccctctgaaccttggagttatgaatctgccagtttgctaaatgyatactcagaagggcaatttcgttttcagaatacaaggacactttagctattactactcaccctccccattgctcctttctagctctttgagctcccctgaatgtgcccccaagcacctcttgtttattcccattcagcaaattaaggaaggttctagtatgcgtttcttatgcagcaaatgctgagttcactggaactcaggcctgctggagaacaaattaacccatactataaacacccactctcttgcctgacaatttgcactggttagaacagaaccttctaatattaggaatggtggtgtgaggatcatttcataaccacaaacacagcaaaagcaatcatgaaattatggatgactcattgtcaaaggaacacttggatcattttgagcaaccccctaggttgatcaaatgaggaaacttctgcaccaaactcacaccgtgccattagtcttctctgtaattgattgttattgccagatttgtctcaaccacatcagacctatttttaaacctctcataattgccttctcactaagtaaaatattgttttttgagcacctttcttttatttcatatgtgtctatttgtttctttcttaaactggacagtgcattgagaacagagattatttcttatttatcctaaataaaatagtacctggtgcacagtaggttctagtacataaatgttaaatgtaccataaattgtacattctttcccaatgaaagaggttgtttctaacaagctaaggaaactaagatttgctttgtataccactttctctagggttccatgaacaaataaattttgccatgatatatacacatatatattttagagaaagaaaggagcggggaggaaaagggaatggagaggaggggaagggaggagagaggaacaaaaggaagggtgagagagagataatactaagttcttgatactatttaaggtgttgggatacaaaaatgaacaaaactgcccaaaatacttgctctcagagtttccactcttgcgtgtgtatgtgtgtgtgtgtgtgtgtgcatgcatgtaatgaggaaacagacaaaaaacaaaaaagtaagtacaatataatagtgttagatcatgatcaatgctgtagagaaaaataagttagagtaagggaatagagagtgctggatggagtgggctattggattttaaaatggagtagacagggaaggcctcgctgtgaagatgaaacttgagcaaagacttgaaggaggtgaggctgagagtcttgaagctatttgggtgaagaatattccaggtgggaggaataggaagtgtaaagtctctgaggtgagacagaaattcaggagtttccaggatgacgcaggcagttggcctggagtggagcagtgcaggttagagtgtaggataagagatcacgggagtggctggacagctgagtggcagtgttgggagagctttggagggacctgtcattgtaaagaccagcctttactctgactgagatgggaaaccattgaagaatttgatttgatttaaggttgaaagggttatttttgctgccaggataaaaatggtgggtgggaaggtaaagagggaaacaagaaaatcagttaggaaattatggtaataagacaggtgtctcagaccatgatgatagaagaggaagtagtgtatgttaaagaatctgaatagatgttgaagatagaactaatagaattaaccctcagattgatcatgaatcatgggaaagagtgaaaaattatcccaagttgtttgatctgaatagctcagtggatggatggagttgccagtaattgagaaagggattcctaaagaagaggttttgaggtaaaggggaagatgatctatctgtctctttctctttctctagctatttatctacttatctatctatgtatctgtctagctgtctacatacttacctgtctgtghctatctatctatctatctatctaatcagatgttttatatatgaggtattaaaactcaagatgttaggtatctggctgaagatctcatagctaacatgggtgatgctgagtttgaagtgaagtattcctgtatagacttcaaaatccctagtttccctrccctaccagacctttttcatatatcattgcttttaatcttcacaacagcttttatccacactttaaaattataaaacctaaagtttagagagtttacacaactggcctaagtcatgcagctagtgagacagcagagattcaaacttggtctctgactccaaaattcatattcttttttttttcacttttattttaggttcaggggtacatgtgcaggtttgttatataggtaaattgcatgtcacagggatttggcgtgcagattattttgtcatcaagcatagcaccaaataggtagttttttattcttacccgcttcccactctctaccctcaagtaggccccagtgtctgttgttgccttttttgtgtctatatatactcaagtgttcagctcccacttagaagtgagaacatgctatttgattttctgttcttgtgttagtttgcttatgataaaggcctccagctccatccatattacactataaaagacaagatattgttctttttatggctacatagtattccatggtatatatgtaccatattttctttatccattctactattgctgggcatttaggtttattccatgtctttgctattgtgaatrgtgccgcaatgaacatatacatgcatgtgtctttatggtagaacaatttacattccttcaggtatataattaataatgggatttgctgggtcaagtggtaattttgttttaagttctttgagaaattgccaaactgctttccatatggctgaactaatttacattcccaccggcagtgtataagcattcccttctctttacaacctcgtcagcatctgttattttttgactttttaatcatagccattctgactgggtgagatggtatctcactgtggttttgaattgcatttctctaatgattagtgatgttgagccttttttcacgtgcttgttgactgcatttatgtcttcttttgaaaagtgtctattcgtgttctttgcccactctgtgggctttttgtttgtggggttgttttttgcttgtaaatttgtttgagttccttatagattctggactttattgtcagatgcatagtttgtaaatattttctcccattctgtaggttgtctgtttactctgttgatagtttcttttgctgtgcagaaagtttttagtttaattaggttccatttgtcaatttttgctttcattgttattgcttttggcattttcatcatgaaatctttgtctgctcctatgtccagaatagtgttgcctaggttatcttccagggtttttatagttttgagttttacatttaagtctttaatccgtcttgagtttttgtgtatggtgtaaggaaggggtctaatttcaaacttctgcatgtgactagccagttatcacagcaccatttactgaatagggagtcctttcctcattacttgtttttgttgattttgtcaaagatcagatagttctaggtgtgtggcatagtttatgggttctctattccgttccatttgtctatatgtctgtttttgtaccagtaccatgctattttggttactgtaggcttgtagtataatttgaagttacgtagtgtgatgcttgttgttttgttctttttgcttaggattgctttggttatttgggctcctttttggttccgtatggattttagaatagtttttctcattctgtgaagaatgtcattggtagtttataggaatagcattgaatctataaattgcttcgggcagcatggccatttttatgatattgattcttcctatccataagcatggaatgtttttccatttatttgaataagctctcatttctttgagcagtgttttgtagttctccttgtagagatctttcacctccctggttagctgtattcctaggtgtttattctttttatgcctgttgtgaatggaactgcattcttcatttggctttcagtttagattttcttggtgtataggaatgctactgatttttgtacattgattttgtatcctgaaactttgctgaagttgtttatcagatctaggagcttttgggcagagactatgaggttttctaggtatagaatcatattgtctgcaaacagaaatagtttgacttcctctctttctatttggatgccttctttctttctttcttttttttttttttaaaagagtttcactcttgttgcccaggctgaagtgcagtggtgcaatctcagctcactgtaacccccacctcccagctacaagcgattctcctgcctcagcctcccaagtagctgagattacaggcatgtaccaccaggcccagctaattttgtaaatttttagtagggattgggtttcaccatgttggtcaggctggtctcgagctcctgacctcaagtgatccacccatctcggcctcccaaagtgttgggattacatttgtgagccactgcgcctgacctggattccttttatttctttctgttgcctgattgttctggttaggacttccactactatgttgaataggagtaatgagagagggcatccttgtcttgttcaaattttcagggggtttgcttccagcttttgcctattcagtatgatattggcttggatttttcatagctgactcttactatttttatgtatgttcctccaatgcttaatttgttgagggattataacatgaagagatgttgaattttattgaaagccttttctgtatttattgagacgatcatgtggtttctgtttttagttctgtttatatagtggatcacatttattgatttgcatatgttgaaccaaccttgcatcccagagataaggcctacttgattgtggtggattagctttttgatgtgttgctgggtttgctttgccagtattttgttgaggatttttgcatctatttccattaaggatattggcctgaagttttcctttttagttgtgtctctgccaggtttgggtatcaggatgatactgacttcacttagagaggagtccctcctcctcaattttttggaatagtttcagtaggaatggtaccagttcttcttcatacatctggtagaatttggctgtgaatctggtcctgggctttttctggttggttggctttctttctacgaaactatcctccctattatttatgccttgcaaaaaggtggtaaagattaaatgtatgtaacatacccagcatatacaacgtctggtgcatagtatatttaaattaaaggatagctattagagattaatatagatctcatttgtgtatattgtgcttctacctaagggaactataaattcattaaaatacgggacttaaaataattatttagtggcctcaaggacatcataaatatttattatttattgagtatgtacaactactatatttccataataattagaaataataactttttaaaaaacaaagatgatagcaaccacaaaaaacatttattgagtgaatcacgttgggtacaaatgagtatattgtaaaaagtataccatcaacacactgacaatctttatcagtatttcctagtagaagaaacatgaaagtcggagcaggtaggactaaagaatgctagtgtacacaggaccatcagatgccttttagtagaagaggtctagagccttgcggaagagcttcccaccctgtacagagaatgtgttgcctgttctttgctttctgaaaactcttgcctattatcactctgtgattaattctgcactaggctgtctagagctttcacatttgggatcattttatccccgtctctcaaataagttcatgggttcattatgtcgcacatatcttatcttacatgcaaatgtaaatctgttgcacccttaactcacaggtctgagtattttttctaccacacaaagttttttgcaaaaattaaaaaaattgataacattaaatggttacctgagaaaagaagaaagtcctcaaacccttcactttaaacaactagaaaaataaaactaaaataaacccaaacaagcagatggaagaatataacaaagacaagagcagagagcaattaaattaaaaccagaaaaacaatagaaaaaaataaataaaaacaaaagctgattttttgacattaatgacattagcaaaactgaccaaaaaaagagataagccataaattattaatatcaagaatgaaagagggggtatcattacagatcccataaacactaaacagataataaaggaatactaagaacaactctatagacatagatttgaaaacctagatgaaattaaattaaaattatattagtgaactgaactttcagttaaaagtttccaaaaaagcaaccttctagctcagatggttacactggcaaattctaccaattatttgtggaaaattaataccaattccatacaatctcttccagaaataagaagagaacactctcaatttatgaggccagcattaccctgatgcaaaagacagcgtaagaaaaaaatcttttaaacacaaccaaatatacctaattaacataaatgtaaaaatcttcagtaaaatattaaccagctgaattcttaaacatataaaaacaataataatacaccatgaccaagtagagattgtagggggaatataagactggctcaatactggaaaatttttcattgtagtacaccatattaacagtctaaagaagaaaaatcacatgatcatatcaattgttgcaggaaaagtatttgacaaaattcaacattcattcgtgataaagactctctgcaaactagaaataaaaactttctcaacctaataaaaggcatacagaaaagctaacattatacttaatggtgaaagatgaatgctttttccctcaatttaggaataaggcaaggatattgatactttttgtctctgtgtccccacctaaatctcaccttgaattgtagttcccataatccccatgtatcatgggagggacccagtgggaggtaatttaatcatggaggtgtttaccctcatgttgttcttgtgatagggagtgagttctcatgagatctgatggttttatatggcgattttttcccttttgctcagcacttctccttcctgcccttgtatgaagaaggatgtgtttgcttccccttgtgccatgattgtaaatttcctgaggcctcctcagccctgcagaactgtgagtcaattaaacttctttcctttataaattacccagtcttgggtatgtttttattagcagcatgagaacagactaatacagatatctactcccatcattcaacaaacattttactgggtgccctatccagttaataaagttaggaaattaaataaaaggcatgcagattttcagatgatatgattgtctatgccaaaaatttcaaggaattcataagcaaattccaagtactaaaaagtgagtttaatgagattacagggtacagggttcaacacacaagaatcaaatgtatttctttatactagcaatgaataattggcaactaaacatttttaaaaaatttacattagctccaaaaaatgaaacacatagrtgtaagtgaaacaaagcatgaacagggtctgtatgctgaaaattacaaaaacttagtgaaataaagcaaaaaagacctaaataaatggagagatacacagttttatggattgaaagaattaacatagaaaaaatgtaactcagctgggcgcagtggctcatgcctgtaatcccagcactttgggaggctgaggcggatggatcacctgagctcgggagttcgagaccaccctgaccaacatagagaaaccctgtctctactaaaaatacaaaattagccaggcatggtggctcatgcctgtaatcccagctacggaggctgaggcaggagaatcacttgaacccgggaggcagaggttgcagtgagctgagactgtgccatttcactccagcctggacaacaagagcgaaactcagtctcaaaaaaaaaaaaagaaagaaaagaaaatatgtaactctgcacaaattgatctatagatttaatgcaattccaagcaaacctcaggagtatttttacagatccagacaagctgattctaaaatttatatggaaagtcaagggaactgtaataaccaaaacaattttgaagcagactagtaaagttggagaaatcacactatcagattttaagatttaatataaagctgtagcaatcaattcagtgtgatattggcaaaaggatagacatagatcagtggaacagagaagccagaagcagacccacacaaatatattctagttatttttcagaaagttgcaaaagcaatttcataaaggaatgatagccattcaacaaatggtgttggaacagccagacaatcatgggcaaaaaaatgaaccttcatcttaatttcaaatcttacataagaattaactaaaagatttacatgtaaaatacaaaattatacaaatttaaaggaaaaaatttaggagaaaaactggcccagagttagacaaagagttattagacatgataccaagagcacaatcatgaaagaaaagatttatgtattggatttcaacaaaatgaaaacttttgctctatcaaagacactgtataagaatgaaaagacaggctacagactgggataaaatatttgcaaatcacatatccaataaaggacttgtatctggaacacaaaaaaactctcataacccaaccataagaaaataaactacccacattaaagaaagtactgcgttcatcaactagaagtctcaatatagtaaagatttagttctcctcaaattgattcatagattcaactcaattcaaatcaaaatcccaacaggactttttgtaggtatataaagctgattctggaatttatatgaaaagaccktatagcatasggacaatagttaaaaatactgtattgtatacttgcaatctgctaagaagatagatcttaaatctcctcactatacacatacacaaatagtaactgtagaggtaatagatgtgttcattatggggaatgtggtcattatttcgcaatgtatacatatatcagaacatcaagttgtataccttaaatatatgctattttttcatgtcagtgatagttcaataaaactgttgaaaagtagaaaataaaaataggttatgtgaaagacaaaggaactaaaatatgacaaacaatttgggcaaaaggaatgcaaataagcaaattaacaaatgttaatttgctattcagaaaatgaaagttaaaaccaccatgaggtaccatggcacatctattagaatagctgaaataaaaaaatattgacaagggctggtagggatgtggagcaactggaacttgtatacattgctggtagcaaaatgaaaaacagccactctggataacagtttggcagtctcttgtaaaactaaacaaacactttccatatgacccagcagtcccatttctaggtacttgccttaaataaatgaaaacatgttcacacaaaaacctgtacatgaatgtttatagcagctctattcataatcacccaaaatggaaatacctaaatgtctttcaacaagtgaatgtataaacaatctctgttacatttatccaacggaatactactcagcaataaaaggaacaaactatttgtttacaaaacaacttggatgattctgaaaggtattatagtagttggaagaagccagtttcatgaggctgcatacgtataattagttccattcatatgccattttctaaaagacagaactgtaatgatagggaaaagatcagtcatttccagggattaggaatagagagaggatatgactacaaaagggataacaagagaatttatcttttggttatatggaactcttctgtatcattattgtggaggtagttacagaaacctatatatgtgttaaactctaaaactggacacaaaaacatcagttacattgtatggtaatctaaaaataaaatatttacttgaacttttggtgctgaagaacttgatttgtgtcttaaaatcagactttccaaattttggtttcatttgctccctgggttgtctgtattcatctatcaccagcagagagacagagagagaaagagggagaaagaaagttgattagtttatatacttatacacactaatgaagttggaaaaactttgggtgaaatataatgattttgtgggatgatttatgcattaaggtatatgtggaatatttctggtagagatatttgttatagatgtatctaaaattcaagtaagggtggggaattttatttagaaagtaagagatgtagatgtagatgaaagagaatacatagggcgagaaaaaaaactgagaatagaactcaaggatactaatatttgagggaaaatgagaaaaggaactcataaaggaactcatgagtgtaggaggagaaacagggcattgaagaaaagaaaaaggccatggaggctataatagttcattctcacactgctatgaagaactacccgagactgggtaaattataaaggaaagaggtttaattgactcacagttccacagggctggggaggcctgtggaaacttacaatcatagcagaaaaggaagcaaacacatccttcttcacatggtagcaggaaggagaagaatgagagccaagcaatgggggatacccttataaaaccatcagatctcctgagaacttactttcaggagaataccatggagaagctgcccctatgactaaattacctccaaccgggcccctcccaccagacgtggggattataggaactataattcaagatgagatttggatggggacacatatcagaggccaagaaagttgagaaagaagaggcagcactctccaatggcatggagaagttgagtaagatgaggtttgaaaagtctcagtgtgtttgtccaatagaacagcagttctcaaycttkttggcaccaaggaccggttttgtggaatataattttttcatggaggtgaggggatgggatggtttggggatgaaactgttctgcctcagatcatcaggcattatttagattctcagaaggaatggacaacctagatctcccacatgcacatttcacaatagagttcacactcctatgagaatctaatgcccagctgatctgacaggaggcagagctcaggcagtaatgctcgctggcccactgctcacctcatgctgtgcatctcaatttttaacaggccatggaccagtatctgtcagtgtcccagtggttggggacccctgctctagaaggtcatcggtaatgttgcaaaagcacttttagggttgatgtgggggcaagaatcttagggacatagctttagaaatacatgagaggtaaggaagtgccctcataaagctttggcttacctgtatttggattcttgaataaagttttggtgggaagattactcttatgtcaaatcattaggccaagctaagtaagaattttagtgaaattttgcatttctggcaaaacttaaagccaagtaatagtggcctggacttaagctttagacataatctttttttttttttggtagtactcaaaattaataagtcagttcaacactagctgagtacctacagtgttgcagatggtgaaaggtatacaaacatgtacaagaaataagaactgaatttatttaacycaaccttctcattttaaagataaagaagctgagacttaggaaggaaataacttggcccaaggacatgcttaatctgcctccctcctctcccattgccatattttgctagttccccaatttttccctttacataagctactctccaccacaaatatagtacacatgcagaagatactcataactacatggctagtccatttctaaatgtattcatgtagtttgttgaatcagattttttttttttttttttgagacagagtcttgctctgtcacccaggctggagtgcagtggtaagatctcagctcactgaaacctctgcttcccgggttcaagtgatccttgtgcctcagcctcctgagtagctgggattacaggcatgcgccaccatgcccagctagtttttgtatttatagtagagactgagtttcaccatgttggcgaggctggtctcgaactcctgacctcaagtgatctgcccacctcagcttcccaaagtgttgggattacaggcatgagccaccgcacctggccttgaatcagatatttatgagaaaagagaaagtacctacctaggcagtagctggcaacaaattcagtgtgcagagggtatgattgcaaatggttgtgtaaaggaagaagaggtattaggaaatagattgccttttgaaaacaaaacaagacctttggcagaaaaatattggggtagataggtacatattaacagatatttgactctctccctacctggggattattcttctagaattctttgctaaaactctaaaggattcttggtttgctctaatgagacaggcagtttctttaccatacttccagttagtgttttgagggaacatggaataggacaatatggctggagtttgcctccaagatgaattggagaggaagagtggatggcctttaaagcaagactaagtttagaagcacagtgaataagcatgttcatgctcaggttcggtgggtggatgtctgcttgagttcattcagttacttatggggtgtgtaaccttaaaaaagtatcttgacctctttaagactcagtttccscctctgtaaaatgggttccttgtgagtacaaaagatatacaatatacctagtgcagtgccagacttattaaacaaaatacttcatattagattttaattttatgattaattagaaatgtggttctattctttaggaaatggccaaagacacggcaagccaacattttcagacagaaatagttcctgtcttttgtaaattgatctttgtgtggcttcagctggcatgactaggcccctcgatgggaattgcagagatatttagagttgaatgcaaagcctgagctcaaatgggataaatgatgaagcactactaaagatataaatggataggcacactacaccagggggctggtgggtgggagtggaggcattatttgtcaagtggcatcaatgtacacagctgactgtgtctgtgtgaggagaggagatggcagttgctgttgcaaaagggacctggaaacagagagcagcatgagcaaactgctgatcaggtttctttaggaggatgaggggattataatgttctgagagattactgaagcttagaaagaggaagtagtagaatcacatcttcctgcccctgggaatttatgctgctggataccatgtttccaatgcttcttattttatccattcctttacaaagttattttaaaataaagatgaaaacataggtgaaaaaatgtctaacttgtttgtttattgtagatttactcttggattccaaagtaaagaggcaatggcacagggggtgctgtttatattcctttcatcaatcattgctgcaacttagatatttagtatatttatgcctatacacagatacatatgggcaaaagatattctataaaattcatttatgaggactcacagttgcacctctcagaaaaatttctcctccagtcattaaaaaaatttttttatgggcttgtaattcagttacctcttccctggaagtaaaattccagggtagaccagaaaactcactaacaaggcccagtggtcttaaaccccggctgcatgcaaaatcagcagtaaacttaaaacaaacaaacaaaaacaaaaacaaaaacaaaaaaagtatgtgcctggcctgggtctcattccagagcatttaagttagactctctagaagtaattgtcttcagtttacgctataaaaatttaagattttaaaaaaccaggccgggcatggtggctcatgcctgtaatcccagcactttgggaggccgaggtgggcagatcactttaggtcaggagttcgagaccagcctggccaacatggtaaaacaccatctctactaaaaatacaaaaatcagccaggcttggtgacgcatgcctgtaatcccagctacttcggagactgaggcatgggaatcacctgaacctgggaagcagaggttgcagtgagctgagatcctaccactgcactccagcctgggtgacagagtgagactccatctcaaaaaataataataaaaataaaattcaagttggcacaacatttttagctcttataacaaaattcttgacttaatgaatcttctgtgaataactttgggagtattaaaactttgtaaactctgacccagcatatccatcctgggtaatagagcaggaggaaatggtcatggatgcatgcaaaaatgtatcaatcttgagtcattacaataatacttttaataataaaaatcagacgcattataaatgtgcaataagaagagatttttctttcaagcatggtacatccatttagaggtctactttctagccattaaaaataatgtaagagaagaatttaatgcatataacatgcatgcaattcataaagagaaaagaaagatattattcaagtatggggagatatacttctttgaaaaaaatccatttgaatagaaaaaagaccaaatgaatatattccaaaatagtaatatgcattataaagaaatagcatgagaaatgtgatgatttttatactcttccttaggcctcatattatttttcagattttctatactaagcatgaattatttttataaagagaaaaatgctattaaattaaaagcagttatagaactctaaagatttatattaaaatactactctgtggagctgcccacttcatatgtttaaagtaactgacaccattttgcatatgctacctgtgtgaatagattccataaataaaataggcttataaaaacactgttgatttttgtgtgaaagtaaccataggtaagtccttcttcaatgtatgactttgatttaggaagtggagtctggaacaactggcttaatttgacaaaggtagaggaagatgaaattttatgctctgtgattggtttttgcagttgttctgaactaataggttgctttcttctttaatgtgttataatgaggaacagctgctatgagctgtgcagttcgtttttttccctcctttcaaacctccatctcctgaagttaaatcaatctctgtaattaaagaattggtgaaataggcaaggaggtgggctggcaaatttatatattctgttttaaaatgtttaatttaagtatcatgtggaagaactggactgttgtgacatggtggaataacatttacattttccaaaaaagtgtctttcaacatgtgttgttagacctggagaacacaataatattaattaattgggcattcgatgtaaaccacaaaagtgagcagactcacttctccttcaagttgatgggagttcagatcaaccaagaagctaaagatgagatgaattcaagactacactgtttgaagatatatcattatcccttgtgaaagagtaggtgaggtgtggttgatcctagtaacttcatggactaaaaggaaaaaaaaaagtctcattccttgagtatatttcctagttgttttggtgttttgataggtttgttcccaaactgaactgaaccagaaagcccctatgacacctctttccaagggaaagatgcacctagaaggagctgggcctctggtgacagctggaggagtcattctgaagcctcacctcccacatcactgtcatctctaatagtggagactggttgaacttcggaaagggaaaaatcgatggctgaagatgagccttggtgattgtattagtcaggattctccagagaaccagaactaattggaggcccagaagatccatgattgtttctttgcaaactggagaaccagaaacgccagtggtgcagtttggtccatgtccaaaggcctgagaaccaggatgaggtggctgatgctagtcctggagtctgaagacctgagaaccaggygctctgatgtcgaagggcaggagaaaatggatatcccagctcaagaagagggcaaattcttcctttctccaccttttagttctatgtgtgccctcaacagattgggaaccttaatgggggtgattattcttatcctgtgaggtaagaattagtgaaagtgattattcttaccctatcaattcaaatgctaatctcttctggaaacactctcacagacacacccagaaataatgttttaccaactatcttggcatcctttagcccaatcaagttaacacataaaattaatcatcacaagttcactaaccccttgtcaagtccgcacttatgcatatctctttaaaccatacttaatctccaagtaaatacaataacaaggtcaaaatcccatgtaacatcatacaactaacctgtgtacaaccaaaaacacactaatcccttccctcaaagaggaggtaaaattcttgagtgatgttttctcttctcctggaatcctgtaacttaaatactatgatgtaaaattaacaccatttaaatatggatgtaaagtcaatatatcttttgttactatgataagggaataggaaagaatacaaagatattttctttacacatacacacatgcacaaatatatttataacagaaggagaatatatgcaggacaattacagttctcatttctgtaactggttacatggttgtaagctgatatttataaggaccttcttctactaccattctgtattctcactgctttcagcaagcacctcagctggttgtggttctttaccacaggataaaggtgacccaaacctttattcttgaagggtctgggccattcatagttttgcctggactgggttgttgtagttcctattgaccttaatcacaggacatggcaatactcagaaactctttaagaaatctgtattccacacatactcttctttacctccattgtttaggagtagttcaattttggtggtttggatcaatcactccagccaacactgtaactcccttctttgcttattgacatrgaggcattrggagcccaacatggttgggtggcagtcttaacttccagttcaatggagtcattgttgtatctcctggtggaagcagtcttccctctagaactatgacctctaggccagtagagcataaagtcatggaaacaagaagcaaaaattttgccagtgtgtctccagggataatagtgaatgttgccacaaccatgttcaccccttgattcctggacctgtgattctggctatgggagaaacagcaccatatattggttgctgattcaaagtatatggagccttatggaggaccatgcccaagcactgcacctagctggagctgtaacgtgagtctcaaaaggccattccaccattttatcaagacagctgcttcaggatggtagggaacaaggtaacaccagtgaattccctgagtgtgggcccattgctgcaattcttttgctgtgatcagaagtaatgcctggtagaataccatgatggtggataaggcattttgtaaatccatggacagtagttttgtgtgcagggaaggaaaatccatatgcactgttgtctattccagtaaggacaaaatgctgctccttccatggtagaagtggtcagtgtaatgaatctgccaccaggtagctggctaattaccctggagaatggtgccatactggaggctctgtgttggtccctgctgctgacacattaggcacttagcactggccataacaaggtcagcctaggtgagtggaagtccatgttgctaagttcattcatgacctccatccctgccaccatggccactttgttcatgagcccactgcgtgatgacaggagtagcaagggaaagaggctgattagtatccacagaacaggtcatcctattcacttgactattaaaataccctttggccgaagtcaccttttggtgagcattcttgtgggctacaaatatcttcatattttttgctcaaagagatctatccatatatctcttccccaaatttcttgtcaccaattttctaattatgtaccttccaagttcctgaccatccagccaaaccattgactatagttcttcaatcagtatataatcacatgtctggacatttttccttttaagcaaagtgcacaaccaagtgcactgcctgaaattctgcccactgggagaatatcccttcaacactgcctttcagagatgtcccagagagatgttatagtgctacagctgtccactcttgggtagtgcctgtatatcacacagaaccatctgtaaaccatagccaagtcttcacttcctctgtcaactgactgtggggaactccccatggagccatgggtgcagctggaagaagagaaggcagtagcaggaatgaggaccatggatcacttgatgtgacttctttgtgtcttcagggcttgcttgggcccaattacatatataccacttccacttgatgatagagtgttgctgtgcatgcccaattttatgatttgatgggtcagataatacccagttcatgataggcagctcaggttgcgtagtaacttgttgactcctggtcaagtattcagtttccactaaagcccagtagcaggcccagagctgtctctcaaaagaagaatcattacctgcagatgatggcatagctttgctctaaaatcctgaaggcttaaactgcaattcacctatgggagcttgccaaaggatctaaacagcatccctgtctgccattgacacctcaagtaccattggatctgctggatcatatggcctaagtggcagagcagcttacgtagtctcctggatctgttgcagagccttttcctgttctgggacctactcaaaactagtagttttttttgagtcagttggtaaatgggccagaataacatgcttaaataagaaatgcattgcctccaaaatccacataggcccgctagccattgtgccttttttttttttggttagaggccaggtgcaacaacttagccttctccttggaagggctatttcaacatgcccacaccatagacccctagaaatttaactgaggtagatagatcacacctaaactttaattggatttatatcccaccctgtaacaygtaaatgattaccaatcaaatctaaagcggttgctactttttgctcactaggtccaatcagcataatgtcatcaacgtaatgaaccagtatgatgtcttgtggaaggggaaggtgatcaagatccctgtgtgcttgacattgtctaaattatgacatataactggagagttaatataaccctgaggtaggaaaatgaaggtgtattgctggccttgccagctgaaagaaaactgcttctggtgggccttattgacagagatggagaagggggcatctgccagatgatagctacataccaggtaccaaggggtgtgttactttgctcaagcagtgaaactaaatctagtacagcagctgcaattgtagtcaccacttggttaagcttaccataatccactgttattctccaagctccatctgtcttctgcatagaccaaataggagtgttgaatgggaatgtgatgggaatcgccacccctgcatctttcaagtccttaacggtagcactaatctctgcagtccctccaggaatgcagtattgctttttatttactattttttgaggtggaagcaattctaggaactgcttctccttggccctcttcatcatagcccccagtccacaagtcaaggaaccaatgtggagattctgccagtggctaagtatgtcattccaattatttcttctggaactgggaaataactacagratggattctgacacctattgtgagatgaacttgagctaaaacttccattgatcacctgacctatataagcccctcctctgaatgagaggctacagtgacattttgggtttcctggaatcagtgtcagttcaaatctagtgttcagtagtcccccaaaggtctgattayatgttttaccctggtgcacagttaccctgctaaaattctgtaggtcctttcggagaaagctgggagaaagattcacagtataaattttcatttgagggcttctgggtctgtaaactggctcaagtctgaaaattgattgaggggctctgactctctaattttatgattcaatttaaactttggttcatttgacctggaacttttctgtttatacagatcaagtaaaaatttaataggctttctatctatttcacttctaggaacaccatgattaactagcccacgccacagatctgtgtgagtcagactattctaattgctgctttgactctgccacccaacacagtaactacgcccacctcgcctttggcagtggaatgctgccacttggcctcaccactctggatccaattactcccattgcatttagattttccaattaagtggctgtggttcccactataaggtctggcctacaaagagtaatcacagagttcttcaagaatactggggcttcctttagtaatttatttcttaaagtattgataaaagtgtgtcttctagatcttctcagtgttggggaatatatcataaattataaatccactctttctaatctccctaagcctgtgaatcccttcctctacattaaacctagggagagccgacatttccaatttgcttacaatgggccatcttttgattgtgtttcagccaaccaatcaaccacattattagagccttaactcccaagctgtaatattaaatgcagaatctctgcttagtgggcccacatcaataaatttgacctgatccaacattatgttccttccttcattatcccacacccttaatatcaattcccagacatgtttcctagatttctgcttgtataaattagaaaggttaggtagttcttttggaatatagcatgcctcctcatgggccacactttgtacttcccctttaagggcctgctagggtcttgagtctagttatttgtctagaagaaaagaggagtgttggaggtagctcttgtggagaatcagcagtgtcttgcatggcagctgcctcagaggaggccattcctcaggcaatgcagggctaatcccttcagatggaggtaaatgactcagaccaatgtgaatgaggagatggctcctactggaggtggggatgctgttgacactgggagtagggggtcatttctgctggtattagggatgccacttttgctgggattagggagaccaactactctgggggtgggacctaagctctactgagggtggggagacttctttcactgccaaaatagataatcacagtttagggactcagtgtccccagcttctttagagtcttcccacatacccccatcccaacttgcaagatcccattttttcacagtgtcctcactttacagtatataccttgtgaggctgagagtttcacttgtgttgtaattcagccaattacaggatgagatcctacatttgattttcagcaattttagccctgcactgcaggagataatgctgtccctcagggcacacctataagctcttaggtcatttatgtagcacttgaggtgggaatttgaatcccttagctcatttttttttttgtaaactactttttccagtgattcagtgtcatattccttagttttccaaaagtgttcaaagctaatatatacagagttactaagctccttgcatcttaraagtgtttgattaggaatatccatattttgtatatatctacagtttgtgccacgaactgtttgcctctttactactggaaaaggaatcattatcatctttaaactgtgtcagattagaaagccaatttcagaaactgcagaatgattttttttttaaaaaaccctcacttttgaaaatctgtttctccagagccaatctcaataccaaaatctgtattagccaacgttctccagagaaacagaaccaatatgtactatgtggtggtggtgtgtgtgtgtgtgtgtgtgtgtgtatgtgtgtgtgtgtagtcatcccttggtatctgtggggtattggtttcaggaccctctagtggataccaaaatctgaagatgctcaagtcctttatgtgaaattatgtagaatctgcatataacccacataatcctcccatatactttaagtcatctctagattactgactatctaatattgtattgcttagggaataatgatgtgacaaaagtctgtatatgttcagtacagatgcaaccatccatttttttctgaatatttttggtttgcaattggttgaatctacagatttggaacccacagatacagagggctgactagagaaccaataaaagccagtggtataattcagttttaagtacagaggcctaagaaccaaagaaccgatgatgtaactcccagtctaagtccaaaggcctgagaactagggtggttggttggggtggtggctgatgttagtcagtcctagagtctgaaggcctgagaacaaggagctgtccaagggcaggagaagatggatgtcccagctaaagaaagagataatttgtcctgattctgcctttttgttttatgtgggccctcaatggaatggataatgcccacccacataggtgagtgtgatcttctttacctmgtctaccaattcagatgctaatctcttctggaaacaccctcagagatacacccataaataatgtgttgccagctatctgggcgtctcttaccccagttaagttgacatataaagttaagaggtcatctgcttacctgtgccatttcccagttgatgaagcttgccacagtttatccaagaatacacggagtgggaaaggtagaatttagtttgcccaggtaatgttctcgcagtgatttccctctgggcctcccaccaacgctgtctcttgtgatgaaactggggagaactgtagggaggaagataatttctgcctctcaaaactcacaggctgatggaaggagatcccataaagcatttattgtagaaaaggaagaagtggcagaggaaaatgctggagaaaagaagatagaagaacaaagcaattgccaagcccaggtgtaaggtgaccaggtctgcctgggatgatggcagcttgaatggtgaggaaagacaaaatgtgagaagaacatgtaagaagatttgaccatgtttgtatagagactatcttccttggttcatccttaaatgaaatgaaaatcctgtagcaccatttctagcatttggtaagtactcaagaaacgtgagcttttactgaccatagactgaacatataggctactaatgagaaaattcctatacttgaagaagcctaacttgctaggccaattttatatttttgctgggctgccatagggttagaattaaaggcacattaaaatatgtattaaaaggccaatagtggtggctcatgcctgtagtcctagcactttaggagggtgagacaggtggaacacttgaggagtttaagaccagtctgggcaacatggtgaaaccctgtctctacaaaaaatacaaaaattagcctggcatagtggtgcatgcctatagtcccagctatttggaggtgagatgattgcttgagcctggaagtcgaggctacagtgagctatgatcatgccactgcactccagcctaggcaacagagtgagaccctgtcccccccaaaaaattgtattaaagatacattataatgtgaatgtgtctgtagtatacattaagtctttatgtctgtaaagacatgccacattctttctttttctctctcagcatatgtacacacatacatacacacttaaatctctgtgtgtgtacgtgtgtgtacatatgtacacaaatggcacattagctttatctagaaatggatacatatgcattaagctactgtaaagtttatgcacacttaaaggcacattaattctatccaggcatatttctctataatgtactgtatatctgtatgtatactaatacattattctatcatccatcataaatttctggcccccccacaggaaatgaccttgtattttatgatcaatgcaaggacaaaagattttgcatccttaaattatattcaatacatactctgtgaataaaaatgccataacttaaaatattgcccttggtatttgcatagtgcctttcattactgttgaacaaaaactaatctatgcattcattctgtggagataagttgtataaatgtgataagtgagatattttcttccttagtccttaaaatgatagtgtaaggaaatggaattcttttgcctggagatgagattacccaagggtataatatttccagaatggatactatgaagttgtaggawgttgctgtatctcattttcagtgaggccacaagagaaaattgttgtagcaagaagttgtggtttaggctttaaaatgcctttgctgtgaggttaacatagaaggaatgggccattaaagaagtttgtatattcttccttttttcgatgtttcaataaagtaaccagttctttgaggttaagtcagtctgttcgacagcctattctaagaagaaatggcgccttcctacccacagtgggtgagtctagggaagtagttttatatcaccacaaccctgatacacctttctttcccccacaacatgtgctgattggaccagggatgggaattgtaatgacgggaaaccaattagaaaactggtcagagacaccatgtagcctgacattaaagaatgaactgcacctatcctgtttactttttcagtaaattactctagagaaaatgtattttaacaatgggagctgaagttgaagggaagccatgaaatagaggggagttgtctctagccatttgcttagaaaagtagcagggacacacacacacacacacacaaaataaaaacaataagacataagacctacttactatttgataacacaacagggtgactatagtcaataatttaattgtacatttataaataactaaaagagtataactgattgtttgtaacacaatggataaatagttgaggggatgggtactccattttccacgatgtgattattacgcattgcatgcccgtatcaaagtatctcatgcaccccataaatatatgcattatataccccataaacctaatatgtacccacaaaaattaaaaataaaaatgaaaaaagtagcaggtaatattaacaagcagaggaaattatgactagaaagcggaggttggatagacgcaggagagagaaaaatgagcaagaatgctcatgtgactaatgagagacctgctttaattcgtgtcttcccagacctcatgccatgcaccctattcccattttttcttaaagaacttgagagtctgtatcagttagatgatttgggctgcaagaaataaaaatagtcatctgaaagcagtgtaaactagggacatttattatctcacataacatgaagtgtggagaccagcacggttttaggctgtctcagtgatgtcatcagggatacagttccgttctatctttcctatgtgctgtactcatcattttggctgactttggtgcattcttgtgaaattgagttgcttctcagctttctccacggagggcttacattcagctcattcagctttcttgggtctgcaagtcagttctacttgtctgtatgcttcctactttgtaaaattttcttggtcttctctcccctcctattttcctcattattacaaatttatgccttaaaggaaataatactattattttagtggtgttttgagaggaaccagtggtaaatacatgtatttaatcatttaatctgatctgccaactttattgtgaagtcccttgcgtctctcttttaagatgaaagacatttacttgagaagttttctcactagacttcccctcccatatcattggccaagatggagctatatgctgtatgcagaagacagagtcataagccaatcactggcaaggggaatgaggtcactttggcttggacaaattgccattcacttttggcaatgagaaggagcaccttcctttgagcacatagctgtatggaggatgaacaactagagaatgatcttcaaaatactgaacaatggatggagcatggaccaaccagtcaaaatgggcatgctacccaaatagagcaaagaaaaccctataaatacccaaatgaaatctggttcaaccaacaaggaagaagatggaaacaaaagtcttggtttctagcacctaaataacaattgcagaaaataaagtacacaactgcttcagaggaaggaccaaatcacctcataaggaccattccagcctgtaaatttttacgcagaagagaattgttccatttaatgaatattttattaaaggagtctacaacctgaactgagtatcactgcagggagccagagtacatgtaaattacagggttgtgggcactttccaattctggcacaacctttatgtaaaaggttaccctagtcctttaagagtgaacttttagagaaaggttctacctcaatggtatttgcaactaattggctttatcttacttgccagctcttgattgatgaagctggctgaagggttggattgaatagaactcggaggttgagttggaatcagctggaaagagcactatgttcatttggcagtgtgtgtgtgtgtgtgtgtgtgtgtgtgtgtgtgtgtgtgtgtttattggcatggggaatggcagcacttgggccatgtattttctctcttctttcaggtcagttttgtatgggctgagactccatggagtcacctaagctggaggcttccaaattacaaactgtacctaagacaaggagacgacctttcttagtgggtgacattcttagtctaggaagaggagcattcctgtggaagagttctcagggatttgggtaacatcagagtcagaaggaaaaggaagttttgttgagtttcatatttgagaagaaagctagaaggcagaagtccaagggtgtgtcagttattttgaaaagtaaaacatgaagaagagaagtataaaatatttccaaagctctgggtttaatgacaccaagtttgctagttttgtttcctggtggtaattagcagtcaaacaacatgtgtgctttgggtcatcaaatattattgtgggtagggagagcagccagtcttgagcaacatgatttcaagggattgagtgagtgatgaaaattattgcaggataggaaagcaagttggatttctggtaactacagtaaagaggaaaagagaatgtgaagaatagactgacagggaagctctaggttgagcgacagaaaggcctgtgtggaggtttccaaatatagtgccttatactactcaaagcccttcctattgtcttgtataattctcttactactctttggattgggtacacttgatatttttagttctgtttttctgaataagttaattttcagagaaggtaaagtaacccaaaagtacacagctagatggaagctgatctaggaccagaaatgagttctttcaacttatagatcagggcctttcctactatcctgcaaggccactgagatctaaaacagaactgtctgatctgcaggatatctagaagtatattaggcacaggtgggggtgtatgggtggggaagacagtattccaagtagaggaaatagcacttgcaagaccctggggaatgagagagaatggtggttcctaagaacacagagcagacccgtagagcaagagcaggaaaagcaatatggacactggtgtaagatgaggctaaacatgtagcaggggccagattctgaagcctttgagggctagcattttacttatttagctaaatctcacactcaccagcagtttcctttctaaataggatcaacatgcatttctttggacctttgctgacaccaaatggtaccagtctttgagcctctcaagtgaggtgggaggtggggaaaggaggacataaaattagcataagtacataaacctagttgcacaccagtcttagtatgagtaaataacatgttctgcattttcatgtgctactactttccaaatgaatatagatgttatgatgaataaaactcaaattcatttcaatgtactcctgaattcctgggagcttttagctgttatgcatataacccttctgcctcttgccttatcggtctgtgacaacaaatacagttacaactccttttgctctacaaattattgtggcttgaaagttgaccccactcaaagtatcatccagctatttctgggtatttccatggggatggaatagatcccttgggctcttcctacctgagtttctccacctcttctcytcttctctgagtttcatgctattgtccatgctctgttctccttgtggttcactgcttttctgtgcctatctttgttcattcccacctcccatgaacccatcactacctttctttattcccgccactcctgaaccccttactatgtttgttcatttccattggtcatgtcagcactgctactgttgggctcaaaggctgagatagtttgttttctacatggaatggaactgtgacagaatctcctgagggttgagggtggctctgtcacttccctgagactggcctcttctccagccatcatctctgcacttctacacccacagctgcagctgatgtaagaggaccagcatatatgcttgtggaaagcccagacttgctcttactacactcttctagcctccccagttgtacaagggctgcttactcccaatgatgaaatttctctgagggtttgatacctaggatttcagtacaaatggcccaacagaaatagaggaattcctttcttcctctagtccggggatcagcaaactaactcaggggccaaatccacttgtttttataaataaaatttcactgaaacccagcaacacctattttatttatatattgtttatgactgctattatactacactggcagagttgaggttatgacagagatggtatgacctacaaagtcaaaaatatttactatctggaattttacagaaaaagattctcagttctttatctcatccataaaatcattcaaggaattgttttaaaatgaaaagtgggtgatatgatcagatttatacttttcaaaggtcactccagttgtagtgacaagagtggactcagggtgggaaaataaaactgtagacagagaccagataagaagctgttccagtaattcagagaagaggtgatggtggcctgaaccgaaggaacaacagtgaaaatgcagagaggtgatggatttgagaactattgaggaggtagaaatgataaaacgtgataatggatcaggtgcttcatgcctcttctctgacactcagccgccaggctctaggtactagaagtctgatcatggatttgcttctttgtttctgtggtctcctgattcctgtctgggtcttcttctaaccccactggagcattagagttctattttcctacttttgcctgattgctagggctctgctgcctcttgactatcctctgtgaggcaattaggggaattcagtattaggatccatgtatcttgtctttgtccaccaatagaagatactgctaacttggacttgcattgccttctgatattataggcagaaacctctgtgagaggttctgtgatttctctgtcaggctgaactttctgctagcagttgtgtattccaggaaatgaatatagctctaaatccaaattctcacagtttgcttggttcttttacagtacttgagatgtgctgggccaattccaaaggtaaagaagagtaggtgggtatcctggggcttcattatattaaaagtgctaattctttgatttttattcacttatctcaactgattaataatttttgatggaatgagaaaagataactctgttttagtcttccctctagggttctgtctttgtttattctatatccctatatgctgataacttcctagtttctgtcctagaatctagcatatatccagcttccactgaattcctccacctggatgttaccaaaacactcaaggttcaatctgtctaaaacctgaaacctttatcttattgctccttttccttttcttcttcccatatcctttgtgctaatgaatggccccaccaatcaatcctgtcacacaagcaaaagatgtggaagtcatcttggagttataaattcttcctatttccttactctacaatctatcaggattctgtctcttaaatacattttaaaaatccttatctcttctacattcttgctgccttagtttagtctttttatgtctcataatgactagtcatttcctggcttgtctctctgcctcttgtcctgttctgatctaatccttcaaggacaggaacaaaatgaccatcattttagtagcctcagaactgaggatgagatgggaacacagaaggtccttgttgaatatgcaccaatctaaataaagaggaaaatcaggatcacatgtgtcttttccttttgatactcctgatctaagattttctcttgtcggtatcttccttctggttcctagaaaattcctcctatgctatggaagacctcaaatgaggtttctaccaagactttgagaagatttgaagcttttttaaaataaaaagtttagctttttcacaggcactgttatggctcactggggaggtgggaaggccttctgctggggtgagaatacaagtcaggctcctaaattttcataacggaatgtcagccttgccacctgacagtctaaaacatatgcccaaagcatatggatctcttttcaatcaacacaacgtcttcacttcctctaaagagctcaatcttggactgactgatattcagccctatccaagaagctcagctaaaaagagtgatatttgagagatatttggagctaatcattcagtctctaagtttggactacaagttaaaaattcgtttggaccacagctctaattccattagaaatgtcatcagtgaataacatttaagtaatgtgctttctgatttttttccctttttttttttgagacggagtctcgcactgtcacccagactggagtgcagtggcgcaatctcggctcactgcaacctcctcctcctaggttcaagtgattctcctgcctcagcgtcccgagtagctgggactataggtgtgcaccaccagggccagctaatttttgtatttttagtagagatggggtttcacaatattggccaggatggtctcaatctcttgacctcgtgatccgcctgcctgggcttcccaaagtgctgggattacaggcgtgagccactggtgcccggcctgtgctttctgattttgtgcaggattgataaaaagatgcctactactgaagaatcacccccaaagtatttttccattatcttaatgtgtctttgagaaaaaaaaaacttctaaagaagtagcatgcttcttatattgggtaatgagaactactatagttctgttcaagacaaagtttcaacatctgagctatccctcttctttggataatagtaactatagataaaataacaaaagagaaaatttaaaatacaataacactttaaggaacaaactaaatatgtctttgactagaaaagaacagaaatgcaaagcagtagggctggagatgagtgtctgctgggctgtagcactgtaggcaggcagagatgattaggagttcagcactcacaaggtgacaggatctaaaagtgccaagcaggtggcaaccagacattggatcattgtttgaaatcagggtctgaggtggagtaccactscataaaaggaagcttaaaaaaaacaaaaacaaaaaactgctgtctaatactaccagaatatcaagaaaggaagtaaaratgaagctacagttttgaagccagagcttctgtgaagctgccttctggctcagtgacgagtgataatgtcacaattatcccaatgaggcaggaacactgatataacaatataagatgtatttctaatttgggatcctaacagggttggctgagggccattgaaaacccaccagaaagggaggaaagagatggaggaagaaaagcctaaataattgacaaagcttccgcctacccaagacaaacctgaaaatctaaattccataattaatgaagaaaaaaatgctaaaaatagctgtgaagataaattattgacatcaattccttctcagatgaagtgaaaataattatacaatctgaaaaatgctttataataagacatttatgatctttcacagataagataaaaaggaaaaacattcataatgaagactaagaaaatataaaacaaaaccatgcaaaaatgatatgataacaggcagatctaaaaatagcttattaaaaattagagaaataacatggcataaacttttgaaaaggcaaaagcaaagagagaattagtaaatcaaaaaaatagacctgagacattatgaaaaagcagttcagagaaagggaaggaggattgaggaggtgaaaggtatagcagaagctccagaagaagagagaaaagagtgaagtagcaacagttgaagagactttggctatgcatttttcagtgttgaagacacaagtctcagatgacaaatgtaatccaggttctaagaaggatgaatgaaaataaatgcatacttagatacatcttagtaaacttgaagataaggagaaaatattataaagttttagttatgcaagatgaataagttctagagatcaggtgtacaacattgtgcctgtagttaacagtactgtgttttgtacataaacatttgttgagagagtagatctcatgctatgttcttaccacaataaaacacaaagcaaaacaaaaaactatttgaaggaaaaatcagattcttaaagaatggccttggccgggcgcggtggctcatgcctgttatcccagcactttgggagcccaaggcgggcggatcacctgagatcgggcgttcgagaccagcctgaccaacatggagaaaccctgtctctactaaaaatacaaaataaaaatacaaaattagccgggcatggtggcacatgcctgtaattccatctactagggaggctgaggcaggagaattgcttgaacctgrgaggaggaggttgtggcgagctgagatggtgccattgcactccagcctgggcaacaagaatgaaacaccgtctcaaaaaaaaaaaaaaaaaaaaaaaaaaagcatggccactagcagacagttgacttccaattagcaactgtccaatagagcaatatctacaaattgctgagggaaagccactgtcaatctagaattatatgcctggcaaaaccacctatgtgtaaaaggttacatcaggccaggtacctaaacataacaaggctttcccgggaaggaaacatcggttctcacaacatcatttccttggatgcttactgagttaacataaatatggaaggccaggcacggtggctcatgtctgtaatccgagcactgtgggaggccgaggcaggtggatcactagaggtcaggagttcgagaccagcctggccaacattgcgaaaccctatctctactaaaaatataaaaatgtgctgggcatggtggcaggcatctatacccagctactcaggagaatcccttgaacctgggaggcagaggttgcagtgagccgagatcacaccattgtactccaacctgggtgacaagagtgaaactacgtctcaagaaaaaaaacccaaaaagataaatatggaatactgcatgctaagagctaatgatctgtcttgtttactctgaaattcctgattagagagagcatatctggactgagattattctatgtgggcatacaagttttgggcctatatgacaggaacaatatataagagaggtgggaaactaaggcagtagcttctctgtgctaagtgaaaccatatatgtgttgaagtcatccccattttctgtacacmtgctgtgtaggtaaggggagataaaggaagctgtgcatacatatacttttaggacctctaagtagtaataaggctgtttttcttgacttctatgcttctataaatctgaataatttaatgatagattaaatcctattgtgttacatgaatttgattccagtcttaacttgtgatcactgctagtaaaataaaacattttttcacatacaaaaattaggagacttttccactcacaaactattatggaatgaactataaaggatgtactttagcaagaagaaaattgaactcaaggaggaagactgagatgcaagaaacaaaaccaagtagagaaacttaaaaattaagtggataactaatggttatctacccaaaggaaaataagtaattatacgaaaaaagatacttgcacacacatgtttatagcagcacagttcacaattgcaaaaatgtaagccaacccaaatgcccaccaatcaatgagtagataaagaaactgtgagatatatatatctagatatatctatatttatatctagtatctagatatatctatatttatatctagtatctagatatatctatatttatatctagtatctagatatatctatatctagtatctagatatatctatatctatatctagtatctagatatatctatatctatatctagtatctagatatatctatatctatatctagtatctagatatatctatatatctagtatctagatatatctatatttatatctagtatctagatatatctatatttacatctagtatctagatatatctatatttacatctagtatctagatatatctatatttacatctagtatctagatatatctatatatctagtatctagatatatctatatttatatctagtatctagatatttctatatttatatctagtatctagatatatctatatttatatctagtatctagatatatctatatttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatayctatatctagatatagatatatatatggatatatatgtggtaactgtgatatatacatacatatatatataaaatggaatactactcagcccaaaaaggaatgaattaatggcatctgcagcaacctggatgggactggagaccattattggagtaactcaggaatggagaggcaaacatcatatgttctcactcataagtggcagctaagctatgagaatgcaaaggcataagaattgacacaataaaatttggggacctggggaaagggtgagaagggtctgagggataaacgagtacaaattgggttcagtgtatactactctggtgatgggtgcaccaaaatctcacaaatcaccactaaagaacttgctcatgtaaccaaacaccatctgttccccaataacctatggaaatgaaaaaattttttaaaaagttgaatggaaactcaaaaaaaattaagtggataaggttttttttttttcaattaaaaagtgaaacaaattgctaaaccacaataatagaagataaggtgagtcttcactggatacttaatgtgttaacatctttgtcctatttgagaggaagatagagatactatgctgaatgactttatactctccaaaaaaaaacactgaaaaaaggatacagttttaaaattataaagtatatatttttaaaacttatttaaatacatattttatcattttaaaacttaagaataaccattaaaatgagagtaatattctccatagcttctgaattcacagagcaaaaaggagtatagaaaattttatcagtaccccaggaggtagaaaaggaggaaaaaaagaagcaaaaagaaaggaggagaattagataaccaatgagttttcgtttttcctatggctggcaggaagaccagataaaaaatattttccaagtatttcatcctatattcctaatatgattattttcacttttcataagatagtttcatttcttttgccttcattttggatatctatatagtcaagtttaaaaaaagccacaagaaaatcacatggggggttagggcttcaacatatgaattttgggggatataattcagtccataactaccctgaacccctgtcctgcagtaatgccctgccctctctggtggagcctgtgtgtgaaaccctgacttccatctctgccctgcattaacaaggaaacaaaactggtaaattaaacttcatcaaaattacagtattttgctctgtaaaatacctgctacaaagatgaaaaaacaagctgcagactgagagaaaatacttgcaaattacttacctaataaaggacttatatccagaatatataaaggactctctaaattcagtagtaagaaaacaaacaatgcaattagaatatggtcaaaatcttaaacagacacttttctaaagatgacatactggtggcaaatcagtatacgaaaaaatagcctctaggaaaatgcgaattaaagctatatgtgctaccacacctattagaataaccaaaataaaaattactgatagtaccaagtgctgatgaggaatgttaaatggcatagccaatttggaaaatagtttggcagtttcctataaacatacacacaccataggacccagcaatctctttcatcagtgtttatcttagaaaaatgaaaagttatgttcacacaaaaacctgtacatgaatgtttatagcagctttatactgtaccggtcaacactggaaacaacccaaatgtcctacaactgatgaatacaaaaacaaactgtgggccatctatactatagaatactgctcaaaaattaaatggaattaactggttcatgtaacatcttggatggatctcaaaagagttatgcatagtgaaagaggccagtctcaaaaggttgcatattgtatgattccatttatataatattattgatgtggcaaaatcataatgctgcatagatctatgattgccaggagttaggattggggstaggatatgatcattaaggtgtaactcaagggagtttctttgtggtgataaaacagttctgtatactgactggtgatggttacaccaatcatagaacgatatacacatgcacatacccccaaaagaagtccacacaaaatctggtgaaatccaaataatgtattgtactgttgtgatacacattattattgtattgtatgtaacaatgtcagtttcttacttttgacaacgttctatggttatgcaagatattatcattaggaaaggctgaatgaggggtacatgaaaattctctgtactatatatggaattacttttgcatctaaaactatttcaaagtaagagttataattttaaaaaatcagttgtaagaaattttaaaaaatgttctagcctcaagcctgtctgacttcaaagccagtgtgattaaaccactacaccacatggtaaagatcccttagaaaaatgcctatgtcagcaggcacaaataagggacactcctagctattcaaaattatttttgtctccttaaaccctaaaataaaaaagcacaaaacaagaaatggctaactgagataactataacatttgaggtgggatgattttaatagaccttatataccattttaactcttttaggttaaatcccacttcgttgttcagtgatctcaaaatgtgttatgaattctttttggtagattttcacatcagtatttcaaatcaccttactctagatgtttttctcttgggtgttctttttgttaatatttttaacttcacaaagctcttttctatcattttagtcagttaattgaaagcaaagcttaaaggaaaccaacatgtttaaaataaactttttagggttggagactacatgctttttgttatttttcttgctctgatatctcattagtgttattacattcctgaaatacctaaaatggttaaaagcatgaaaagcacaagtattgaaagaccttaggagactgcattttgaagccctcaaaaatgtgaaccgggaaatacataaaacaactttgtttgttggggttaaggtcatgggaaatacatctgtttgcatttgtggagtatactgtcgtagaaaactacgccgcatgaagcaatggagcaaaaagcacagcagcaatatgcggttacatcatctgctaagcatgtatattacaaattacttgaaagcaataatcatgatattctggatcccaccaaaatgttatgatttaaacatccacaacaaaggctgtgcccagaagcctttgttctgagcagggtttatttgaagaaaatggaatgtgattgtaataagaagcctgggctggctgtgtctctccaactcattaggctgcatgaggtggtagggtgaagggagatgggctggggagaggctggtgagttccacacaacaccctggggcttcacaagggaagaggaatgacaggtgcagaggagatatatgaagttctccatcagatagctcctgcagagttggagtcctagccttcagggcagaactctcaggaggtgcactctatcatagtcaaaaattccagtgatacattgttcatgagaaaaatcagacaaggcaattacaggaaagagcaggaagccacctccgtcttccaatcagattttcaatatttaaccatcacttcctaagtacagttgggctctctgaattatgcagcatccacaagactgtcggagaagatttgttcctaataatggatttttgcatcacaaatgaatagagttctttgtctttatattcatctctcttctctgtggttacttcttcctaatttgcgtttttacctgtcactttgcctataagaaatgtgaaaaatatgaagaatcctcttttattatcatggcctatgagtgcccaaactgtttgaccctatatgaattaaatacacttttttggatattttgttctccctgtatgtagggtttcaaatgggtgcaaataatatacagttaaatctaaatgtgctctttccaccagaagaataaagtctgttaccagctgaagatgagaaagtggaaataggcatagctgagataaattwaaaaaaaatgggagccttgggcatttttcataacagccctggagttagtggttggctgggaggagggactgtcctgtgtgtggctttgaagttatgtggaagtcattcacatttagcacattattctcaggctatgggggtaagggtgatgctcatatctcgtagagagagaatgttcacttactgaaagcctgcctggactttgtccttttccaggcaccatttaactrttaggagttctagatcrtacttggcattaaggatgtcataacaaactccactttctaaggtttctgatccttaaatataatcaagagaagtaatggtttattttcatctgcatgcattctcatgcctttgttgagactatgccagggaaaagcaagaacatccatttaatgggaagtgtcatatcttcctccgacccaccctcccttcctttcttcattccttccttcagcagaggttttcaagtgcttgccatgtgccagataggcactgtgctaggctctggggaaatcacaactaacgacatgcagcctgtgtttcagggatgattttacattccagtatggaatacagaaaagtgaacaggcaattgcaactcagtgtaataagtagaatacatctwctgattataattataacaataatagggrtgtatttcttaggtcattctctcaactatcccttgagctaggtagtaattttattcctgttttactgaaaaagcttgaggcttggtcaattttgcaagttcataaacttagcaagtgtaaagctggaatttgaatcctggcctgtggaatttgaatcctgtttgtgcagtcctagaactcaagcacttaactttgacactaattggttgctatgggaaaacatggtggtgggaatgtacatctggcatggtcttggaagtcccagagggtggttacagaaggcttcttagaggaagttacaactaatctgaggattgaagagagaataatagtgaaaagaataaggcatgaagaataagctatatttaggttggaaacctggccattcctacctcttagcttgggtaaaatgtttaacttctcagcctcaactgccttatctatttaaaaaaatgaggctaatattatccctatttcagagttgttagaatgaaatgagatagcatagcatatgtgaaagttttagcataaggcttggcattaggaagacacccagtaaatgtttattttctacacttttccaagcaataatagcgttctgcattttaccgtgtgtaccatggaatgtgtgatctgccttaacccaaaagccatgggataattcagatagtttaaaatgagagtttagattatttattctaatttatattagtactaaccctaatattgccttggttattttgggtatttcacttatctacttgcctaacaactcattcagctattactgggtgtattttagaataaacattcctggaggaaaaagatgtttggctatttctcagaaataacggagcttgaaaggagcatttatcaaaacaactaaaaaaaaatctctgtgactggttgctggattaaaggaagaagacatgaatctacaacataataaattactaattgtttctcaagttcatggccatttgtaacatttaaaaataattatgtacattatgatagaattactttcagatgtaagaaacccctcttctccacaccatttaattaaacattaggtactgttgaaacaaatggatggaattggtttaggataaatggttgtaccactgttactgcaagatgaatactcataagcaagattcataatctttctcattaaatctcttttcctcttatgtgtcatatctcagttcatatctcagttaatattatcactatcctctaaattactcaggctaaaaactttgacttatttttgtcttctctttatatcaaaccagctgttaaatgtggtaggcagaattctaagatggtccccaagattcctgcaacctggkttaacactttctatataatttcttccctttaagcgtaggtgggacctatgaatatgatgatgtcactytagcgattaggttacattatatggcaaaggcaaagggatttcacagatggaattaaggtccctagtcacttgattttgacttaatcaaagkggattatcctaggtgggcctgacctaatcagatgagccctttaaaacagggatttagccttcctgagtccagacatttggagtagcagatgtactcttgctggttctgaagaaataaactgtaatgtgatcagaagaaagagcatgcggtgagaatatgagagtgacctctaggagctaagaggtggtttccagccagtaagtaccaagaaaaatggggaagtcagtcatataactacaaaaaaaaatgaattctgccaacaacccaattaagcttggaagcagattcttccctagtcaaaccttcagataggaatgtaacccaactgaaacctttactgcagccttgtgagacctgagcagacacctagctaagccacacctgaactcaacccacaaactgtgagatagcaaatgtatgttgctttaactgactacacttgcattagcttgctatgcagcatagaaaactaacacattaagttctcttcattctccccttccagtgtctttatctatccccttttctctattactatggccctcatttatgtcttcatgtctctcacctgaactaataactttctaactagtcttgtcattttcaatttttcacttctccaggaaatccactgcccctatatccactgtattctgtcttatagaatgtagttttgattatatctccccctttaaaaattctcattgctcccagttttctccactgtcaagggagtatagctttgtcatttgggctacgagtttttgatttagagagctatggatttgaatttaaattccaacacttaactaactttatgaacatgggcagtgaataaacatctttaagcctcagtttgtaaagcagagattataattttcccttccttatagggttattgtgagaattaaatgagataatgcatgtaaagattatgttacatagtatgtgctcaataaatcatagctattattgtggttattatgtaattaaattcaaactcttattctggtactcaaagttactaatgatcctcaatagctttttcagccacatctcgtacatctttatgcaaatcttgtggatcagccatgacaacctatcaaaaaacttgaagtccttggttgcatattatgcaatactttttttggtctattttcttccctcaaattagagtccctcccaaccctccactctacacttatcaaaattttgttactcttttgaggcctcccctctaactagggctagctttcagctagcacctgtaagtattcctttactgagtacttacaacccaagtgtgttctgctttgttggaggcccattctgatttgtggtgccatataacttgttggtttttctatcaaccctacctacaaccttccttttcttttatcttttgactcagaatttatctttgtgttcctgcagcagttttcttgcccctatgcttagtatgtcaaactatgttttgaactccaacctgctcacatagttgggtacctccccatataaaaaagggatcattttttatattcccagttcgcttggcacataataagtactcaaaaccttgttggatgattaagaattagtttcactgacctccttgtcagtcctaagaatgatggagcaaatttttgtaatggataataactactaatggttgactggctttagaaacatcttatttggcttaaataattaaatattctacataagaatgcatcaaagtaaactatgtgtgctttataaagcacaataaaatccatgaagaatctagatggccaatttatttaaataaacatatctctatctttatatatgcttctttgacggaataatttcagatcttcattgttccaacaaatctttttattccaaacaattgcatttattatcctgcaaaaagtcttgagataccacctagtgtagaggtctggagacctgaatccatgtaaagtaggaactgtgtcttccctttctctctgttaacatacgcctgttgatacatacactctgcctggcttcttcttccatagccagttgaggaccattcttgctggaaaatgtagacctcaaatagaaattatgcagccttgccttcttttcatctggtaattatgcatagatgttcccaagaagtatttgaatgctgaggaaatcattttgtcttgagaaatataatcttttactttctttttctctccccgtctccctccctccctccctgtccccctcctttctcactctctttccttttgaggcagggtctcactctgtcacgcaggctggagtgcagtggtgcgatctcagcttactgcagccttggcctcttgggctcamagcgatccttccacctcagcctccatagtagctgcaactacaggcacacaccaccaagcccagctaatttttatgttatttatagagacagagttttgccatgttacccatgctggtctcgaactcctggactccggtaatacacctgcctcagcctcccaaagtacaggtgtgagccactgtgcccggctcactgtacaggattacaggtgtgagccactgtgcccggccaacctcatttctttctgagcaatagctttttaaaactttattcttagaagataataatagcaatgatatccttttgtgttattagttgtatcctcctttatttcactttatatttattttaaatcggagctaggcagactagtttctttcatgaatttcttacttctttcttagaattttagagtccatgaaatactgtaaataakgtgtgtgtgtgtgtgtgtgtgtgtgtgtgtgtgtgtgtgtctttaaaaatgttcactttttgttaaactcagtgctaggtattttatgtgcattttcttagttaatattcccaacaaacctacatggtatatactattacttccttcatttttccaagtgaaaacaacaagcttaggttaagtgattttcctaggcactttcctttgctttacaaaggaaaactctgagacttaaagaggttaaatatcttgctcaatgtcacacaactggtaagtctcgcacctgggattcaaacttatatgtttcttgagtctatagtctgagcttttaccctctgtgctatagctccttcctttcctttgaagttcttgacatctgctttcttaacatcttcagcacatgccagcctctgccctatattttctttcttattacaaattccaagatgacatggtaaccattcagttcttccttgtaagacagaaattggtccaaaaatagcagtctctttgctgtatctgctatcatttcagagatgatattgtcagtaaggtaagtaaaacagtttttaactactttactttgagctgcaaagacttctagtaaatgttgtgagagtttcccatgaacatatagcttacctctgtgccagttttgtcatagaagcagtccattatatttagtacatgaatgtccccaagactgtgcaggaaatcagatccacacatattgaatcgtagacttaggcattataatggaggactctgtttccagaagaataaagaatccttaattataccacaacttttagaaaagacaaaagttgacaggacatagtggttgacatctgtaatccaagcactttgggaggctgagatgagaggattggttaagcccagaagttcgagaccagcctgatcaatggtaagaccctatctctacaaaaaaaagcaaatgggcatggaggtgcattcctgtagtctcagctacttgggaggctgaggtgggaggattgcttgagcctgggaggttgaagctgcagtgagctatgattgcaccactgcactccagcctggatgacagagtgaaagaaaagataaaataaaagttgatgatgttctactttttaattcaatttctttaatattagtttgttcctttataaccaagcatcagtttggcgtcttgaccccaatgacctcagttgatggcaaaggctctgctatttttgttttcagacaggatttcactctgtcacttatgctggagtgcagtggtatgatcacagctcactgcagscttgacctcctgggttcaagtgatcctcctacctcaccttccagggtaactgggactacaggcatgtgccaccaccccaggctaatttttaattttttgcagaaacagggtctcactatgttgcccaggctgggatgggctacttttgacatacctaatgacctcaatcttggttttaattgtaataagtttaggaaaatatattctttattagtagcattaatatgttcacccttttattccacactcatattttagaaaataactacagagatayaatagatactcataattgcatatacactgtattaaggtcaaaggtggctacattgttaaaactaagctgttttggccaaccaatggccaatttcacccaatgatagcttgaaacatttttcaaaagttcatggatagcttaatacttaggtggtgggttcacaggtgcagtaaaccaccatggcacaagtttacctgtgtaacaaacccacacatcctgcgcatgtatcctggaacttaaattaaaaattttaaaaagttcatggatgaatgtccaaattcaagtattaaagtaaatttaggagtataaatatgtcattatgaaaactcagggctgccagtatattttaaaaatgaattaattatctgtaatttttatttgattgaataggctgtagcattcttctataatgattaactctgtttctctctcactttgtcttaacccaaatggtcttcactatgctcctggtgacaagtttaagaattcccattaagattatatcttatgtatcactgggctttcccccttccttttatatttaatccattcatttccagaagaaattctctttagttgtcatattcttcactggaattataccaaatattaataataactcatttattattgttagcatcaatggtagagttaccatataatttcttacctacatcagaaaatgtgtgagagtgaaagggaacactattaattgttactttcttatattaaaatatcaaattcacccttgttatctgtcttagggtctttatttgcaacaaacataaatccactgaaattaatttaagtaaatgaagaatttattggaagggaatggggatggcttattaaaccctaggataagaaatgaagctgagacttttgaggatctgaacccaccacatggaaagccaagagcttgacgtgttgctctgcttttgaggggtcatagattactaacttagtgattaagtccatgccttttttaggagccataagtaatgaaccattctcagaatgaatagatcaaggatgccatgaggtgtctttccattaccattatatacctatttattgctgtcgtagttcatttttcacgttttcacaaacacccgtaatttgccacgtaagcatgctgccatgtacataatagaagatgagtaaacatttgttgaatgaataagtattataactcacttttagaatgctgtcacattccttcttttacatgaagatgtgacagtgacatttgttcccccattgactgattatgcacatcagtattgccctgggcaggattgatgtgactgatctgacactttatctttgtgttccttgcagactttaattttccacctaacacatgaaaatcttagaagatcaaataacactagtccaggataattatcttcaaaaaccatttgattggttttctttgaaagtcaggcttactgacttgaaaaaaaattttttttaagtaattgagcagtttgaattaattaaaagtctgaattaacaaaatctgccagaatagacttcatttaatttttttttgtagaaattacaaaagtgccaggaatttaattctctgagtgacatccttgtggtgagattaggtcaataaaaagctggagaaaacagccagaagtttcttcgcacaattgttctataccagaccctccctggctcctgtctggggtttttccctccccttattgttcctcatcagaattggtccctgggaccctggtctttggatctgctttcctcccagcgtcttagcaagtcatttctgattcccacccaaactcttctgctcccattaccaacaattccaactggatttctagcatctatctttaaatatctcttgacatccctttgtgaaaacattaattgttgcctctactgcatgatttagctccgcctcccacaccacagactaagactgattaccaattatgcactgctggtaaagatttggttcctaattgtgaggatacattgtttttgtttgttcgtttgtttgtttgttttttgttgttgtggatgttgttgagatggagtctcgctctattgcccaggctggagtgcagcgacacaatctcggctcactgcaacctctgcctcccgggttcaagcgattatcctgcctcagcctcccaagtagctgggactacaggcgcacgccgcaacacctggctartttttgtatttttagtagagatgaggttttgccatgttggccaggctgggcttgaactcccgatctcaggttatctgcccgcctctgcctcccaaagtgctgagattacaggcgtcagccactgcacccggcctcattgttcatcgttaatatatttccaagcatggatctttgtatctgctctaatgaagagatacaactcgtttattattgttagcatcaaaagtagagttaccatataatttcttacctacatcagaaaatatgtaagagtgaaagggaacactattaataattactctggaataacaggtgcacatcaggattgccctgggcaaactgagactattgtcaccctaatcattactgattatctggcttctctaggaaaatattttgtttctgtattgagattcatttatttttcttcatgtgtttaaatctctttttgagtttgctaatttctggaaataagcagttcagtaagtagattagagatcagtcttattgaaatgctctttagtcctttttgtccgacatctcagcgaggctgcggtgtctgctgctgctgtccgagcttcacaatgccacccaaggatgacaagaagaaggatgctggaaagtcggccaagaaagacaaagacccagttaacaaatccgggggcaaggccaaaaagaagaagtggtccaaaggcaaagttcgggacaagctcaataacttagtcttgtttgacaaagctacctatgacaaactctgtaaggaagttcccaattataaacttataaccccagctgtggtctctgagagactgaagattcgaggctccctggccagggcagcccttcaggagctccttagtaaaggacttatcaaactggtttcaaagcacagagctaaagtaatttacaccagaaataccaagggcggagatgctgcagctgctggtgaagatgcatgaataggtccaaccaactgtacatttggaaaaataaaactttattaaaaaaaaaaaaggaaagaaatgctctttaaaagcgaacaaacgccatgccaaaaccttagactttcaaaactaaggaacatttgacattttacaaatacttgacatggacacttttcttttaaaagtaaggaattgattaccttgtcagaagaagttacctacttttttctttattcacaaataagtactagtttatgtacatcaggatggcattaagtctttaggtttttttttttttagaagcccctgtgacgtagaccagtatggaccataattcaaagttctgtaatagaaacatgcatccaaaattgactaagtagttttgcctcttttatgtagcaatttctaaatttttaagttttggataattctttatatatacattatatacatatatatttatagaatatctgaattgataattacctcacaaaccatctaatttggtggttttcccccttggctgcatatctgaatatttggagagctttaaaaaaatactgtcttttctatctccagaaattctaatttaagtggtctgggatggaacccaggcatagacgttaaaaaaaatgcctcaggtgattctcatgagcagtcagggctgaggcgtctctgatttaattcaaccctggtgtttcacatctgagaaaattgaggcccctcttacttagctgttactgtgggttaacaatctaaatatctctgtgaatctctagatgtttttaaaagggctctgcaaatgtgacatcaccttctttatttagaactgatcataatttttatggcttccaacagatgtcttggtttcttgaattatcctttcacgtcatggggcttctaaggcacttgctgccaaaggagccggaaggtatgcctctttttctgttctccaggtagtagagcatattttagctttttatttcttgccagtattcttgcttcactttcttcatttatcttttgtgcactaaagtttgtcttctaacactttagattatgtggattacatgcctgaagatgtcaaacttcaaaaatgcttctcttttgcctttatatttgaatgatagtttagctcagggatcagcaaattatggcccaagggccaaatgcaataagctgcctgtctttataaagttttattagaacacaaccatgccctttgatttatatgttgtccacagctgctttcaggcacaacagcagaattgagtagctgtgacagagattgtacgagctgaaaatatttaccatctggtcctttactttaaaagttttctaactgattagctaattaaactctctggactgcaagaaatttgtaagcattgcgcctctatcttctaaaggtaaataaagctgtagagataccagaggtcaacttgattcccacctacacttccattacctacattaatgacttggtctttttgcatgattaaagggttttttcctttatctctgaaatctcataacttttaggctaatcttagtgtcactcattcttcatcagtttttcttatcacactgtacatttgattcttttttgttatttttgaatgttgttttgaacacctataatccaaggatgccagttatctacattttcatttaactttgatgggcttgtatagttctatctttttgcatatatattcctattgcttacttttttagccccgtattctgtgtatcttatagtattttcagtaatgcctattcatcttttccctggctcttgtatctctgctttaagattgttaaaaattcttaaaatatatgacaatatgcttgatcataattttgtctgcctggtgacaacatttttttttttaaaaaaacaaatgttccttcttcatctgccatttgttttttctgtttccttcctcctttttttcttgcaatatctttacatagtttgtatactggtttctttttaatcactgtttatctttcaatgagataagttctttctgactatttgcaggagataggacagggttatgttttgagctgtaaagaattttctatggttcatagttgtggcataaactactaattgtatctttcaacactcatttytcctttcttctaaaacaatagaaaccaggttctattcattgtcactgtgctcagctatagccctaaaattctcaactttccttgcagggggttatagccatgtgactgatcttcgtccaagaatatgtaaagaaaaagtgttgagttggcttttaggtaagtaccttaaatgtgagagggaaatggagccttcttcctcatctctgcagcctagaatatggatttaatgaccagagctccagaagccatctaaaaccatgaggcgtgcttgaagatggaagccatgtacggagggtaacagagcagaaagttaggrgcctggcttcctgatgacaccatgaagccactatacaaatcttattcctcgaaattttaaaacaaaaaatagcttttttgagatataayttatatatacagttcaccccttgaaagtgtacaatccaatggtttttagtttgttcacagagttgtgcaaccatcaccacaatcaattttagaacatttgaaattcttttaaatgagagaaaaataatcatgttaaagttttttgggtttttttgatacgtagttgaacttcatcttaactgatatggtaataaagctttttataacacagagttgtgttagtgtgagtacgtgggtatgcaagagaatcgctttgcctttattttttcactgcttaccaaaagtgccagcttggagttcaggatcttcctctatcctgcctcatctcaccaataacttgcttcctgttgaaatgtcatgtctgtgcggttctgctttcagtcccagcttccctacttctctaaggtgccaaacaagcaccaaagaagtttcccctctaagcctgcatgttccagcaccattgtttagacaaggaattggtggttgctgtcccacttcttaggagagcacatgctctgcagggttgtctgggctctgcattttccggtgggtcctggctttgtcttcctcatgggccaatttaatgggctcttcccactgggctcttcccagtagactctacattaggcagccccttcctcatagcatgcttcagatttacagtcatttcctagttttctcaaggatggaacttgcattctgttttccttcttctgcttgttgcagtgtgactttggagaagagaaaggagacagatgtttttactccaccattttaaaaccagaagtctccttgcttaattttaaaataactcttttttatttatttagcagaggatatatggtcaccaatcagtggtaactactattaacttttgggagaatatttttccaaattttctctctgtcaatctctctctctctctctctctctctctctctggctctatctatctatattaacctatttaatttctggaaaacatgatatagaattattaaatagtctacaactttgtttttaattggcctttggcatctcagtgtatgaatataccgtgagttattaaccagtcccctagtttgggccacaggccacagggttgaagagcattacctcaactctagtggtgaggttgacatatgagctctaggctctcatatgaactctaggcacaaaaggccacagactttcaaggactgggatacctgctctgctgggggttcccaacatcataagacccaatggccctctctacttcccattgaagtcttttaaaaaatacttttaaaattttaaaccaattttagacttatgaaatagtaaaagtagtacagaattccttatattccttaccccatgttccttaaagttaacatcttacataagcctaataaaatgatcaggaacggggtattaacattggtacaatactggcaactaaacagaagaccttatttgaatttcatcaatgtttccattaatgcctgttttctgtgctaggatgctaacagtgatcccagattgcatttatttatttctccttagtttctttcagtctataagtctataacagttcctcagtctttccttttttttttttttgkgacattcacacttttaataagtaccagtcagttaatttgtagaatgtcattcaatttggaatgttttctcatgattggattgaggctgtgtgtttttggcaagagcactacaaaaatacacctatatctttctcaaggkatcattatccaggagtaatgatcttgatatgtcttattgctggaggactttatcttgatcagttgttttaagtcggtgtctgatcagttaggccaaattaatgttttttagccacacagtggcctatcgagacactatctcccatatttacttaggttagttacccatccatttcagtgtggttatgttattcatttgtgtatgattaggttcatttgttagtgtttctactcggttctgggttctcctttccttgcatcctggttgattttaagtttttgtttattttgaggatatgtgaagggtttgtgaaactgtggttctaagagtcagagctatacaaaaatagtacttggagaagtgtgactccctcctcatccctaaaactctgtttccattcacctcttttcttctctttttccacttgcttccttaggtaaccacactactaagcttctatttatccttcttttagatcttttgcacaaaagagcagacaccttggtattttctatcttcttcttatgtcctagagatactctttcgggccttgcctttttcacttaacagtatgtcctggaaatcatgccatgcctgttcagagaccttcttcattctttttttaccactgcatagtatttcatggtgtggatgtatcatagtttattcaaccactttactatgtatgggcatttgggtcgcttccagtattgtacagctacaaacaaagctgcaatgaataaccttgcatatatgtattaatgcgtagttgaaagtatatctttggggtagattcctagaagtgggattgctgttgaaaggtaaaaatgtatgtagttttgttaggtattgccaaatttatttccagaagggttgtaccatttgtataattggtacataaaacccataaaaatgactttttcctcacagcatcaccaacagaatgtgtcgtcaagtttttaaactttaaccagtctggtgagaaatgatacttactgtgttttaatttgtatttctctaattatgaatgaatttcagcattttcccatatatctgaaggccatttttaatgtccagtttttgtgaattgcccattcatgtcttttcccattttttatattcttaattttaattttttttttttgagacagaatttctctattgcccacgctggaatgccctggtgtgatcatggctcgtggcagcctccaactcctgggttcaagtgatcattttgcctcggcttcyccagtagctggaactatagggacataccaccatgctctattattattattattttggtagtgatgggggtctcactattttgcccaggctggtcctgaattcctgggctcaagtgatcctccttccttggcctcccaaagtgctgggattataggtatgacccaccacgcctgtcctcctatttttttaaattgagttttcagtcttttgtgtctcagttattaagagttcttcatatgttaaaactattagccctttgtctgtggtatatgctgtaaatcttttctctcagttttatcagtcgcttttgactttctttgtggtgcttttgttatataaaatattttttattttcaagtagtaaaatttataaattttgttttttattgcctctgattttttttattttttattgccttgggattttgagtcatccttagaaaacttttccctacactgagattaaaaatgagtttactcatagtttcttctagtacttttacagttttatttttaaatatttagatccctaatttatttgaagtttattaatatggatgatgtgagagatggatctaattttgtctttctccaaatgactacccaggaccatttgtttaagagtgtccatctttactccagtgatttgagcttataaatgagaacatgatattttgttttctgttcctgcattaattctcttggaataatggcctccagccgcatccatgttgctgcaaaggacgtgatttcattccttttatgactgtatagtattctatggtatatatgtactatattttctttatctagttcagtgtggatggacacctagtttgattccatgtctttgcttttgtgaatagtgctgcgatgaacacacaagtgtatatgtctttttggtggaacaaccyattttcttttggatatatacctagtaatggcattgctgagttgattggtggatctgttttaagttttttgaaaaatctcggccaggcaaagtggctgacgcctgtaatcccagcactttgggacactgaaggtaggcggatcacttgaggtcaggagttccagaccagaccagcctggtcaacatggcaaaatcccatctctacaaaaatacaaaaattagctgggtgtggtggcacatgtctgtaatcccagctactcaggaggctgaggcaggagaatcacttgaacccgggaggcggaggttgcagtgagccaagaccatgctactgcactccaccctgggcaaaagagtgagattccatatttaaaaaaaaatatcaaaactgctttccacagtggctgaactaatttacattctcatcaacagtgtataagcattcccttttctccacagccctgccagcatttgttttttgactttttaatgattgccattttgactgctatgacatggtatctcattgtggttttratttgcattatctctgatgattactgatgtggagcattttcccgtttatttgttggccacttatatgtcttctttttagaagtgtccatgtcttttgcccactttttcatgagttttttttttcttgttgagttttttaggtcccttatagattctggatattaggcatttgttggatgcatagtttgtcgtattttctcccattatgtaggttatctctgtactctgttgatagtttcttttgctttgcagaagctctttagtttaattaggtcctacttgtcaacttttgtttttgttgcaattgcttttgaggacttagtcataaattctttcccaacactgatgtccagaatggtgttttctaggttttctcctaggattcttagagtttgaggtcttacatttaaatctttaattcattttaatttttgtaaatggtaaaaggtagcagrctggtttcattcttctgcatatggctagctagctataccaggaccatttattgaacaggaagtcctttctccattgcttatttttgttgattttgttgaagatcagatggctgtaggtgtgcagctttatttctgggttctctattctgtttcattggtctatgtgtctgtttttgtaccagtacaatgctgctttggttaccgtagccttatagtcaggtaatgtacctttgaagtcaggtaatgtgatgcctctggctttattcttttttgcttaggattgctttggctatttgggctcttttctggttccacgtgaattttagaatagtttttttctaatactgtgaaaaatgacattggtagtttgataggaataagtgctgaatctgcagatggctttgagctgtatggccgttttaacaatattaattcttccaatccatgaggttggaatgtttttccatttgtttgtgtaatctttgatttctttcagcagtgagaaaactgacatctttatactgttcacttacctaaaccaagaacattttatttgattttattttagtttttctggagtaatttacaattttttgtggagtcttttggttgatctagaactaggaaaagactgtcctaggccataagtggtcaggaaagaaaaaatacactagaaaatgtatcaaagatctggtaaatatgcttacattgtctcaaagttcttcacaaccactctgtgaagcaggcattgttagctacattttacaaatggttacaatgagccttaagtattaaataaatagaaagtggtcaatagtgaaggcaggatataaatttatgtgcctgtatgtcaccactccatatattatttgcaagagcatgccaggtaatggaacatctagggaaggaagcattgataataaagtttaaaatcttcagaatgaggctagaatggtggttagcttagatccagtattagaacccagtgttgagccttgtatttagttctgcacacttcacttttagagggacatggctaggcttggatagcaacaagatttcaccctcttgttaacactacttgattgatcagagctagagagctgtgctgaaattgattacaagacttcatctgggcatattagtaaagtacatagggatcaatatgcaatgttttccatgagtatgaagatagggaaatggggtgtgtcagctatctgtcagtcaaccttgggctatacaacaagtccaaagggaagtgacaaagatggggtgggaactttataagcatgccatggaatggaaggtttgaaatccaggattgggatggaagaagttttgctagtttttttgttgttgttgttgttgttgttgtttttaacgttcgaaaaaaaagtcatgtcaactttttatgtgtgattcctgtggttagaacaatgatactgtgtagagtgccaactcaggttccatagaaggaagaactcttctaataatcagagttgcctaaatatgggggaaaatggcctggcagcgatcatgcacttgctgacttttcagtgtgacatagacattgagagttcaggctttgggatcataagatcatgggttacttgtgttgaatatattacagaagtcaaatccctccattatatatactcctaaccctctagagcatgatgtgggacttattttacatttatttgtgtgatcctttgcttaaaatacatctttctcagcacatgagtactctaatgatggcagtgactgttttgctcatagtacctggcacagaataaatgctcaataaatgtttgctgaatgaatgaatgaatgaatgtaggtttgtcactctcagttgttccctcctgggagctactatcaagcttgtgcttgagtcacttgctttgatgtgccaaaatatgttaaccaatargggccccaagagacacagaagtcacagaatggtgacactcaggctttgtgtccccgatgccagtttcactcatggatcaagggaggratgaggcaggggaggagggatgttcagaagataagtgagggaggggtggtaatctcccgatagttgttctttcagactttgcacttcccttttagaaacctcatcatacttctattagttgttcaatattgtcttttctatcagatcctccctgttcaatttctaatttttctgttatgcagtatgccccatgagggtagggaccatgttttccttaattatttccgtaacccgagcacctagaacagtgcctggtgtatagtaagtactcaataaatttttgtgagatgaataaatacataaatgaaatgtggtctagaatctgtgtgcccaataaagtagtgtatgagatattaggacatgcaatacacagtctctgttttcaagttgcttgtggcctaggtagatacttagtaatatgcagacaaaactctaatacacaaagaaaaaaggcactgaagcagaaattaagtttgaatctttgcctgcagtgatttgcctgtgaataggatttcagtgaccaataaaaattaccctgctcctttatggtgagttgtcataaagtatatgtgcccctgccttttcttgtatcttctagtagcaaaagaacacaaggctgcagcttaaaagtccagaatgtagtctcttcagtttccctcaactgtgacargttagtggggagcaataattcaaaaggatctttctagaggtaatcttgcaaaattcttagaaaaatctaaattgcaaagtgaatgtacaagggggtaatkgtgcaagcatcttcagcccaagatgcttcaaaaatactgagtcatcaccaaggccagaaaaatagaccttatcttatataaccacacactgaacttaaaatatgtaaagggaaattaaaaattttttgcatattacacaaaacaagtccctgagaagccagagaatgatatcttggctaaaggagtatttgatgttagttgaactgtaaatttttaggaatttaatattgattacagttatatgcaaagaggacatgaggaatgtgatgggctgccatcagccaggagagactgttgtacttggaaccataagaaacatgtgtgagtggtcagggtgctgaaagaataggactgaaatgggctgtcaagaatgcatgaatgattaatgtgtaagtgcagtgatgtggattggaatatattgcaaatttgattgagtgggaaaagtgggaggggagacttagtgcctctaaatgtatgtgggattgttttaatatcatgcattaatagatactagccagatccattaagaggttgtcaccaagactcatcaatttttcttaccttatatttcttgtattcactcttcatttcctctgccttttctctagtttggaccacacatttcatgtcttggctatttcaatagttttccagttaatcaacatgactagtattccccaaattgggttaacaacatctaaaaccaccaggtcagtatttctaaaacaacacttttctatcttaatccttcattgtccttctccccaaccccccaatattacccagaatagtgggtttcaaactgtgtcctacgatcatacatagaatgctccagaaagagagattatgtttgtttttactcaacgaatatctttctatcacttagyacaatgtggaggcagaaatattcaatgaatatttgttgaatgagtgaacgaggtggctcattggttgctgggaaatggaattagagaaagacaagaaattggattctggggctcctacttcctatcaaatcagcagctccattattatctgcttattatgtaggtgttttgagtaagttttgtctgaaaaagagtcctgttgctctaagtatttgaaagccaattaactaaaaatattttaactcgtacacctaacatacaaatcctaaattaatctttcaaaggaacctgctagtactccccaaaatacagagaatataatgtggtttgttgttgttgttgttgttgcttctgctgttttttttttgttaaatgtttttttgtccagcaatcctctccaaaaccccatgggtctatggggctgccatatttgttagtatatgatcccattcctgagaaataggttttgacccaggcctggcctgttataatgtcttgacatccaggcctgaatttgtttgtgggtagatacctgaccccagctgggccatttgttatcctttcctgggattttaaacagtttttatcagaaaccaagcaataacaatctgatcatttctgtggctaacgtttttcccccggtggctaacattaagagaaactcttcatgatcagatttcccagtgtttggagaagcaaactagagtggaagagtcagaagcaaagatccagaaagatggagatatgagagacagagagagcatcctactggtatttgagttcatttccaaggctgtcgaaggttgggttttactgaaacagtccctgtgatagaatttgtggtgtaggatatttattagggaccagcacttatgggaaggaggaagagaaagcaagattgggaagaggaagaaactgaactcaatgcaagtctgacaactccacagagaattattgagcataataagtccattgagcataaatggcccattgaaattgtgctgcatgagctgagatgttctggcctttatacttccacagtgattagtcactggatatgggctacccagggaagggcaagctcttggacaaggcaactctcagcakctgaggcaaaccctgaagtagatgatagatgaaggctgtctactgaccacatggccagcatctgggaaaacatattgttctgtgaaagggtatctgagcggcacttctccatgtccaccatgtaggcccacctttaccctgccttcaacatgtttgatcttcaacttcttttaatgatgtgagatattccaatatgcttccaatacatttcctttttttttgttttttcgcattctttttttattatgattatacttaagttctgggatacatgtgcagaatgtgcaggtttgttacatagctatacatgtgccatggaggtttgctgcacccatcaacccatcatctatattaggtatttctcctaatgttatccctcccctagccccccacccccctcataggccatagtgtgtgatgttccccttcctgtgcccgtgtgttctcattgttcaactcccacttatgagtgagagcatgtggtgtctggttttctgttcctgtgttagtttgctgagaatgatggtttccagcttcatccatgtccctacaaaggacatgaactcatccttttttatggctgcatagtattgcatggtgtatatgcgccacattttctttatccaatctatcattgatgggcatttggattggttccaagtctttgctattgtgaacagtgctgtwataaacatacgtgtgcatgtgtctttatagtagaatgatttataatcctttgggtatgtacccagtaatgagattgctgggtcaaatggtatttctggttctagatgcttgaggaatygccacactgtcttccacaatggttgaactaatttacactcccaccaacagtgtaaaagcattcctatttctgtacttcctctccagcatccgttgtttcctaaatttttaatgatcacccttctaactggtgtgagatggtatctcattgtggttttgatttgcatttttctaatgaccagtgatgatgagctttttttcatgtttgttggccgcataaatgtcttcttttgagaagtgtctgttcatatccttcaccgactttttgatggggttgtttgtttttttcttgtaaatttgtttatgytccttatagattctgtatattagcccttcatcatatggatagtttgcaaaaattttctcccattctgtaggttgcctgttcactctgatgatagtttcttttgttgtgccraagctctttagtttaattagatctcatttgtcaattttgrcttttgttgccgttgcttttggtgttttagtcatgaagtctttgcctatgcctatgtcctggatggtatacatttccattttttaaaaatcaaggtcaagttagattgttgtcacttgctatgaacatcctgactgatatccttcagccagccagattgccctccagaatactcttctatccttttggttttgaaatacgtgtgtgtgtgtgtgtgtgtgtgtgtgtgtgtgtgtgtgtgtgttattctctactgctaaggtctgaatgttggtgccttctccaaattcatatgttggaactggaaaaccagtgtgatagtattaagaggtgcagccttggccaggtgcagtggctcaagcctgtaatcccagcactttgagaggctgaggcaggtggatcacgaggtcaggagtttgagaccagcttgaccaacatggtgaaaccccatctctactaaaaatacaaaaattagcgggacatggtggtgggcgcctgtaatcccagcttcttaggaggctgaggcaggagaattgcttgaagccagaaggcggaggttgcagtgagctgagatcatgccactgcactccagcctgggcaacaagagcgagactccacctcaggaaaaaaaaaaaaaaaggtggggggaggtggagcctttgggaagtgaataaataaatcatgcagtttccaccctcatggatgagattagcactcttataaaacagccttcaatggactcccttgttccttctgccacatgaggacacaggtagaaggcgtagttcatgaagcagacgttgaatctgctgcaccatgaacttggacttcccaggctccagaactgtgagaaataaatttctgttgtttataaactgcccagtctaaggtgttttgttacagcatcctgaatggactaggacatctatacagtcattcgtgcgacaaatacttccagtgtacccaccatggatcaggcaagaatctaaaccctccctttcctaaagcttcagcccactgcctttcttcgcacatgactccttatgaagtctgctctcctttgaatgacaatagcactcacattcctcatcacctctaccattcgtccagcactactttgtcttccactggatggctggcctctggcagaactgttttttgtgacactgttttatgaaataatgggtctcaratgaaggatggggtgagaaaaattccatgggactttgtcccaacctctaaggatgttgttcactacattgcagtgttctttctacaagaccctcaggagatatttcttttctatctcaatatcaataccacatgtgcttctgaataactgcttggtttttatctcactaccttgtgaactgtgcaactggctaaatttctcttttcacattggctgctggataactcaagccaaacttgcacacccttagcaaatgtgtaacatactatgtcagatgccagtaactgttrcctccaggtcattgagactgaggacgtgattgtttgtttaagtgtgttgatatggtttggctgtgtccccaccaaaatctcaccttgagttgtaataatcctcacatgtcaagcatggagccgggggggataactgaatcatgggggcactttcccccatactgttctcatggtagtaagtaagtctcagaagatctgacggttttatagaggggcattcccctgcacaagctcttttgcctgctgccatgtaagatgtccctttgctctctgactttgtcttctaccatgattgtctggcctccccagccatgtagaactgtgagtccattaaacctctttcctttataagttacccagttttggttatgtctttattagcagcatgagaacagaccaacacatggggtttcttaaaaatttaacctgggccaggcacagtggctcacgcctgtaatcccaggactttgggaggccgaggtgggtggatcacgaggtcaggagatcragaccatcctggccaacatggtgaacccccatctctactaaaactacaaaaaaattagccaggcatggagacatatgactgtagtcccagctattctggaggctgaggcaggagaattgcttgaacccaggagctggaggttgctgtgagccaagattgcaccactgcactccagcctgggcgacagagtgagactccgtctcaaaaagaaaataaataaataaataaaataaattaacctgaatgcattgaggttgggcatagagtcttggttgcctcaaacatactcaccccctgttgtaaacatcacttgtcacttcatatatgtatgcacacgctggcccccttgaagttctttgattttattattcttcctctatagcttgcattaaaaaaatttttaagaataatatttttaatttaacccaccgtattcaaaatgttatcatatcaacttgcaatcaatgcagaaaaaaagtattaatgagatatttttcatttttttgtactaaacctttagagtccaatctgttttttattgttgtaaaacatatataacataaaattgaccttttaaccatttttaagtatacagtttactgaaattaagtacattcgcattgttgtgcaaccatcaccactatctaccagcagaactttttcatctttccaagagaaaactccataccattaaacaataactcctcatactcccctctccccagcccatggcaaccaccattctattttctgtctctatgaatttgacttctccaaatacctcatgtaagaggaattgtacaccatttgtccttttgcgtctagcttattttactcagcataatgtcctcaagattcgtcagcgttgtggcatgtgtaagaacctccttccttttaaggctgaataatatttgatttatatatattccatattccacgttttgtttatctattcatctacggtttccatttttatattagccaattttatgttgttgcccttgttttctctgtaaactgcctttaattattttatgagcagtgtgcagcttaaatacattcatagttttcatcttcaataagacaataagctccttaaaggtagtgtccaacacatgttttgcacaaaggggatgtttgacacgtgtgttcattggcacaagtaacactctgttctaacctataggtgaggtgaatgcagtggggagtcaggggatgcctgcaccttggcttggggtgatgtagaacacagaacatttgtgtccctgtgtccaagcctttggtaatcttatctatctgttctatgctcctgcatttacttttcttccccaatatctttttaatgatcattttagtaacagtactgtcaacatatattacactgaaaatgctgaaaggagtccctttggraggaggcacacaggctgaaaaattgctcttcttattttcctctccttgctattccagcctcaactgctcttcttggtggagacaaccactatgggaccagagtagattaaaatataaggctgctttaatggtaaaaagtttcccagtattcaaattcagtgaaaaatgcccttaagctttaaaatatagagatataattcagtgatttttggggaaaacctttaaacagcaatctaaaaagaaaagtttggaaagaacctataatcagagcctggttgtcccaggaggtaaggttatatgggcatggtggcttcttctatggtataactaaagaacatgaaagtccttctgaacttacacccagcagaccaggagaattttcccttgtgtagtgacacttgattggcattcatgccaaagggctcttgtgaaatggttgcctgagcagagtgaggtggcgctatagtagcacatcaacactgattccccatgtgctccctgcactgtcagtccctaacaggcaggcataaagcctctgctggagccactgcagggatgggagctcaagaccactcatgcctaccctcacctgagtagcccactgtggtttgggacagccttgttgttagaaaaatctttgttttattgagaccaaaactttctctataaacatcacctttggcttaaaatttgccttaatcacatctaatcttttttttttttttttttttttaaagacagggtcttgcttcattgcccaagcaagcaagagtgcagtggtgcaatcatagctcactgcagcctcaaacacctgggctcaagtgatcctcccacctcagcctcccaagtagctggaactacagccatgggctaccatgcttcctggctaatttttaaattttttgtagagatgggaggtctcactgtgttgcccaggctggtcttgaactcctggccccaagtgatcctcccacctcagcctcccagttccataaaaaggagaactcaccaggagttgctgcacagttcatgttcacaggatgcacgttctttcctattcagcactaagaaagccattggctttaccactgaggtgaggcctgtgaacgagttagggtacagcccaatatatggcttccttttattttcttgttttaaaatggccatctgtagagtcttctggaagccaccatatgtctcctgtgttcttgacaacaaccatgaaaggtggggtaggctggctcctgttctgcagatggtgagatggcacatggggagatggtgttgtacagtgggaaatgcaggctgaagccaaacagacctgggttgaatgcaaggtccaccaagcatctgggtccacactccctgtctggccttggcctagtcatttaaactctccgagcccaggttcctcatctattaagtgggggaaaataatagtagctacagaacagggttgtaataacaatgaatgtataaagttgtacagccctaagcttaaagcttggcttgtgttattgttgttaataaactattctccacccactccctttcatttgagtaaatctgcagcccaagctttactcaaaagaaaatattttgcattatgggaaaaggggaatttttaaaaaatcccttctctatgatacctggagtctgttttatgaacctagaaactaaatattcttatcaacttggcaggtaaatgaaaacaaaattatgtcacaccaaactgaaaaggcgaatgcatctttttgcatctgactttaaaagctgtcaggtctaagccacctagatttcattctaatgaggattcagggccagcttgtgaatcgtgagtcatgtgcaggctctgaacccaacagttggtaagctgggcttcaacaaagaacttaattaaggagaaccaccctcttcccaccccccacttattaccaccctcaatccccacccacaaaccacaaagggatatgcaccttgcactaggtttttgaccttattatgcacagtgtaacatttattacttcactcagcactgctggatgaaaacagtcctctttcaatttacaaaaacgcactttacaggaaatgtaggagaaaggccagagtacagattaatgaatgctatcaaatacatccacctgaaagtgtcaccaattttgctgtgacacagttcctggaattgcctcagagatttaaacttgtggatacaccagtattgtatccccaaagactttgaaagaagtgcaaaaattatgtactgttcataatgcatcgtcatgcttatttgcatgtgtgtctggtctgttctattcctaggccctccatgaactttgccccacctgcctctcccatctctttctgtccctctctgcttcagccaacctggccttcttgttcactgaaccagcaaagctagccttgcctcaggatatttgcacttgctgttacttctgcttagaatatcctttgcttggctggctctttccaccatacaggtctcagccaaaataccacctccttagagaagcattttctcatcactactatgaagtagcagccctcagcttttctctagaacatacttttttttttttttttgccttcattgtacagtcttcccttggtatctgtaagagatttgtcccagtacccctggaggatactaaaatcytaggatgctcaagtcctttatgtaaaatagcatagtatttgcatataacatacacacatcctcctgtatacttgacatcatctctagattacttataatacctaatacaatgcttacacatcatttcatttgcttgaattaaacatagcacttggcatgtgrcaaattcaagttttgctttttggaactttgtggaacttttttttcccgaacatttttgacccgcaggcagttgaatccatgaatgcagaacccacgaatgtggagggccaagtgtatttaccactatgtctcagtgattttagttaatggaggtgacaacatggagaggtcaatgccattggaacaagacttattacttacatttcccaagagaaggggatatacgacaccacgcagggccacagagaaagcaccaggttttggtaggaggcagaagccagaaaggggagagtctaggccacggtctttatcagagattccatgggaaagtcaagacagggcagaataaatactttaggactggctagttttgataatttctgtgggctttgggctataaaggtggtctctaattgcctcatacgtggttccaggataatttagggcagggaaaatattagcttggtgtgtgagrgttagataaagggggtagttggggatatagactctggataggttggttggcatgtgaaaggaatgcctttcataagagctcaatcctgagcttttaactatctctaagaattggctagtgttgcaggaaaagtctctttccagacaacaagatttttcaggtgtcaaaatgtcataagatatacaaaataaaaaaatatgattaatacaaactatatgaaataatctcatttatttttgtctgtctactttaacagaaggtaagccccatgaaggtagggaccgtgtccttattgttcatgaccatatggccagcacaaagtaggtgttcaataaatatttgttgcatgaataaggaaatacgagctcctagagtctgggactgtgtggtcttcacagttgtatctccctgttccaactccatccttattctttctctagcacagtgcagaatacatagtaactgtcatttaaaaagggttgttgaattaatttgaactgagaagggtaatataccattttaatttgtgtagtttaaaatagttttagcaaatgtattcatttgtcacagataaagtggatggcacaaaaaatcatacattttagtaagaagaaataagatcaaacagattcaaaacatatgctccttttaatcagggattagcaatagcatattcaaatatcaaggacaacacatcatggattatagtgacccgatctctgcataaaatagatatttaaattcacctttaaaaacaggagcacagccagacagggttgtatacagctgtagtccaagcttcttgagaggctgaggtgggaggattgcttgagcccaggagtttgagtcttgcctgggcaacacagcaagactctgcctctaaaataataaaaataaataagtaaataggaatgtaatataccaagatgttaaaagcattaatctctagacagcaggagaagtatctttttagttttccacattttccttattttttacaatgaatgtacatgacttttaaaataagaaaaaaaatcattcaaaagaaattagcactttggttatattttattctgacttcctcattagagtatgccagcagattaatagaactaacaaaggagcctaaattctgcaacatttttttctagctccttttttatttatttatgcctcagaagcaatgtgaattctcaaattatcctttattaaatctaatcagagttttgatggactccaacaaacgagagcacagcatgttagttaccatgtcatgcaagaacagaaaataacctggtagattctccatgtcccgctaccaatgtcagccctgccaacgatccttactgacgttcccaaaactgacattcccctttcattgatgtcactgaatcaggaagccgaaaagctgttgcaaaatgactgtttctattgcaaaggtttaaaactttagagattgaaaggttaaagttaaaaatatgtattttaatttgaacaacagatggccttggagtgactacaaggctgaattaactctcaagtctctatggctgtttgtggaaagaaaaaataaaaaagacaaccaaaacccttaaaaagcccacactggaacacacagctcaagtgctggtgacatcagcagaatctctctgttgaattagagtcccgaatttggcttcagagccatctgttagcctccagatagaataatcttctatgaaattatactgcatagtttcactaatgaacatttccaattgtcagggcctcagtctcatagctgtcccacctcttggagcctccatggctccctragcccctgtgatacacggagggatcctacttgctaaagttcacaatggatctgtcctttgaaaagatgtgtcttatcttagattgagttctatgaaaacagtctttgagatggagagctgcatgcagaaggtttattagaaagtgctcttgggaaatacagctataaggaaatgaggaaggctgcattgtgcaaagggaaaagctgacctacaaggcagttctaactcaggccttgctgtcctgtggcgagctctgttgctgggaagggccgtcagagttgtcccagattgaatcacagaatcttgggtctttgcatcttcatatcagctgtcattggatatcrgctgctccctgagaaaatatttagtaaatgattgctttattattattactattgtttgctctagactgaatgtttgtgtcccctcaaaattaatatgtcgaaacctaacccccaaggtgatggtattaggaggtggagctgtggggaactggttaggtcatgaacatagggccctcatgatggaattagtgcccttataaggtgctaataactctggtcaccctttcaccatgtgagaacacagcaaggtggcactgttgatgagccagaaggcaggccctcaccagacaccaccaaatctgccttgatcttggacagcccggcytccagagctgtgtgaaataaatttctgttgcttataaggtacccagtttataatattttgttatgagggtcaaatgggctaagatattattaatcccaaagtgagtggatccttctgctcaacaccaggcaccagttggggagctttggggccatttgtatgggtgatgaggaaggataaagggctgagtagaacacaagtcagatgtgcagtgctggaattaacagaaaggcaatgtcaccctggcatgcctatgcacatgtacggaatatcaaaatgtggggagaaggcagccaccctacccagcagcgatgaagtcctagagtctactggcttgggcatcttgctgctctaaccagaaagctccgcgtctgggctgctgccagagtgggtataagtagtccctttttaggcagaacattatctagattggattacatgcttgtaaactgatcagtgcatcttcatatgctgtcaagcatctgagttcaaacaattgaactattttaataagattagcaacttggccctttcctatagtttttctctctacaggattccattcagaatcctctggagaagagtgtcttagggaagtagtaggatttcaggatgccctgcatctgccttcctgaggcagatacagctaaaaaagaccttcatgtccactagaaccacctgtacaccccaaaatgtgccagagaaatgtgcccaaagtcaagggagtggtattgtggacaggaggtttaataggattaatatgtattcttggttggtaaaccttgcaatgagtgtgcttataactcacccatggattgagagccaatctctgcctccaaaggctagagtgtaaaaaatggccagatggccaataatgaggcagaatttcataataatataatgattaagggtttgaaataaaggttatggaattgcacagatctgcttttcaaatttcagttcctccacttactaattttgaaaacttgatgaagtgatttaacatctctaaatcttactagtttcctcctctttaaagtgggataacaatgcctacttgtggcaaatggacctaagccagtttgctcattcacaaatactagatccttcgaggattatgattgggttctttttrgtagatggtaggtagatggtagatgttataatcgttgcaggtagaaggctttcagtttcctcctcaaaatttctctaccaggtgctacttgctacatgaaagcaagtctcaggccagattctcaaattcttccagataggtaggcacaaaaacagtcatctaactcattctgtaagtgtgacaaaatcccagctctctctgtaattctctattggttaataggacaatttttagaggtagaattcaacttaaatttctagtagattctaggtaacaccagcctctcttcagaatcctaaatctagggattcttttttgaagcaattgggctattttagtaaagggggtgtgtctgtatgatacttatagacagtgcagtgcctggaacacttttatttatttcaccaatgagaaatgatttctaacatttttatgctaatgaataaamctttggtgttgaccagaaatcatgatagctaaagaataaagtagttctgtgggaactctttctggaatactgtattctaatatagtctcacaaaagctagtcatttttggagagtgttttcctgattagaattctttgaatattaattgaccaccctaaggtggttttaattagggcaattaactagggtaattaactactttaagatgtggattaaaatacgtatgcaaacactctctcacagacaaactactgtctatgctgatrtattttaaagttaaagaccacatagaatgtctcatagaattaaatgacataatcaagtggtaactgacagcctgccctgatttatgggaatgaatgatacttctttggtggccaccagaaatacattgacggtgggggagtttttgcaaggrattggaattcttgagtcaacagctaaggggtgggtgtagagagctttagatgttaatgttaatgtgatattgatagatatcactagagggtaaactccataaggacaggaacatttcccctttatttccctgctgtatttcartgtttagaacagtacctggtatattgtagttgctcaatagatagttgttgaatgaaggaatgaataaattttaaaaatctgatctgattcttttgaggatgttcaggagttagtgcagtgctaggcatagagtaaatgcctaatgaatgtttactaattagtatgaatgaatgaatgaatgaataagcaattgartgaacaagtaaaagaatttcctaaaggatattgtcaaactagatcaatataatgctgcacagaaatttaatttatgctgtgtttatagcaactctagcgatgatattttagataagatggcctgagcatagtggcattataaccaaatgaatgtctctatctgaagaatacaggttaagagacccatattgaactgaagaaagggctctatagtagtcrttggaaggctcccttctaagctcatcagagtctccatgtagagattgccattttccacgttgtatattttgctttttatgaacagctcttaattttaattttcaaatctatcaacctttccctttttggtttgcacattttataccttgtttaagaaattctcttctagatcaaggttaaaaatatatacttctttattttttattaaagttttgaaaactttgtctctctcrgaggtcatcaaaccatcaagaattgatattttgcatatagtataaggtaggaaaatacaatttcattttcccttatatggttggtcattatttaaatataattttatttagtccaataactacattttatcatttccatctaaatcttgactagaggcttttttgggaagtggaaagggcaggttgtacaagtcatgttaattttatcctcccaacttgtgtaaatgggagcctgtgcttagggatttggtgagaggagagatccttcctcccatactccctcctttccagctccaactgtctcaagtctgagacaggccatgactttcttctcattgcaagttcattaatcatctaaggaggatgtcaacctttgggttgtgggaaactttattctagaatctctgctttaccttctcattctgctttattccctcacatctcatgtctgccccaataaaaccaaggctttttgctaccaggagtaaggaattttagtactagattatttctccttattgttgattctggcctcaagggctttgggaattccctttaatctcctgaaagctcattcatgcattaatttttttttaatttaattcaaatttgtagatgttctgaaccatgaggaagtctgcaaaaacctagtctttcacgttttcacgttgctgaaatagaagtctatggtatcttttttgtttatttatttattttttgttttgggggttggtttgtttatttcatcagtgcctttggagactaatgttttttacactcacatctttgatccatacagacttaattttgatatagtaaagggtatggtagggaatcctgctttattttttcaaagtcatccagtaaacacaaaacaacactatttattgaataattcacagaatggaagttttagaatgtaaatactcaatatgtgatagggaaaagaacactaatacaaagtataaaatcttccaaagcaaggccaacccctattattactgtcttaccagtctgcactggatgtggtcagcttcttgaatcaccagggctgtccatgctagagatacttccatctcttttagctcaaaatatttacagaaatacatatactgttgggaatataatggaggatatataatcaactttttcatgttcattgttttgttactatacatagtagatgagtttcagaaaagttgtattacattaaaatcatatttttagttcccctggcaagtgttctctttaaagggattttactttgaattatttttgaaaatcatcttaaagggtaaataatgactccctaatttttctatgatgcaaataagagtttttatttactaagtttctcaatgcaagatatacttgcataatgcagattcttttctaatacaggagaaaaaaatgaggaggctaaattttaaaagcaaatcaatgtgtattttaaaaaatgcgattgttggaatacagacttaaagacatttcttaaggatcatttacatgaatccaatttgcttgcctctatatgagaggcaacattttgggtgattttttttttcaaaatctaatttttaagctttgtagggtaggtgccaaatggtattttaaaaacacacatttaaaaaaggaagaacgtgcagttttgcctggagtacagatggagcctgtgtcaattgaaggcattttgcctaaggacacagagaaaatcacttcttcataaagaccataaactccactcatgtttctgttcattttaatttgtagaaagtgggaagaaatcaaataggggggcatacaggttcatttgtttaaataatctcatcactcaaattttatatcagttatgctctaaaaattatttgacccccaaatcagtaacgtaatttttatatgaaaaaatatggtcatttctggttatttcttgttgcttctcttactgatttttttttctgtcatgtactgtgtattgtgtagatagggcccaattctattccatctccatacctcatacatatcttttatatctcctcactttggtcccctgcagcataccttatattagtaatttaaaaaatgatgatagtaacccttattccctgtgccaggcattgtgctcaggactgtacaggtaacttttcatttaagctgcaaaacagaaatgaggaaccacagagtatttgagagacaagaggcagagccagtatctgagcatgcgctttggcttttaaaaccccttccctttaccactctgccgatattctttataaagacataaatgtgaaactgctggtaagaagataatataaatcttcattgattgacatggaaatgtgtctattataaattgctatgtaaaaaactcagattgtaatacagggtaggcatcaggatcccattcttttaaaaataaatttgcatatgtacaaaaatggctggaaagatagattcctaaatgttaatagcaattcccagtggtttaaaatattcttctttaaatttttggatttcacttttcagggagcgtttttcagtcatggttctttattgcaagcaacaactctgggggaaaaaaaaagcagcagcacatggccagacgtgagatctttggttttaataccatgtgctgctgtatcatttatagatgataatctttttcattttatttcttccttctacttttgattattaagccaattctcatattatcaaatatttgggacaaagttaatcctgcctggcaataatttctcatcggttttctatttttaaagattaactcattttaatctgttctccctgtgtcattaatattgtagtggcatcaagctacagcacaaactgacctgtatgaaaaagggaaatgtattgagttataactggagcacagaggttgagtcagagattctcagtgtcatcagggtattgaaacaacttctctgtgattcctttccctctactctccccgctttgataggctcattcgcattctgcttcctcatccttgtataaaaagctgcagctattacagtctccacatccttaccttcctctcttcagctggagaaagaccatcgcccctgataggtcctgggaaaccatgaagaaacttctttcctagagaaacctcagcaaatgtctgtttcttatttgcccaaatagggtcacctgtaaattcctgaaccaatttctaaatatctaactactaaataccaaattcattactcaatactaattaccatgaagctgagttgggtgggtaggtctccaaagggaaatttggctgctgttagtaggggaagaggaaaatgaaggctgggaagccactcattctcactggcttttatatccaccccccagtacccccaccctcccaactgccactcttaactcttccttacttcatttttgtgacagttttattccacctacctactgaattattttcctcattaaggttttatgaccactttaagaatctaacataacttgcttttggccacaacatcaaacccaaactctcatatccatttaaatttttccctccccaaccattcaccaccacttgatctattatcctaaaacagctctcactttgccccttctttactgaaagttgtctgagtcctggctgcataacaggtgatgttcattcaccctatcctgtcatttgaaaattttgacaatctggcctcatctacaatttaactttttctcttgtccttccccttactatttctagaaaacaccatattctttcttacctccacaactttgaaaacactgtctctttccatctggaaatctttcttttcatagatttggataactaagtaacattctataccatatatttctgcatacttatgtctttttctgtgaattataactgttcataaaaacacaaactagcaatatttatatgaaggcatgtttcattcattagtttatacactgatcgtggtctataaggttctgcatgagcagatgtccacctacctcccagtcttgtgtcacattctcctttttcttgcttgctatgccttaccacacaacaaatgcctaatgctgtttcctgttttagaaattccatacacatatcctccacccaaaatgctctttctccacttcttcacctgaataaactctactcctcttttaggtgtctccttgaatgtcatttctttagaaagacctctgactctcaaaagctttggtcctcctgttatgtgcttttatgggaccctttacttttcctttgtaatatttatttcagttgtaattaattatccattctattatctcttgaatgcttattactcttaacatactctaaacacctaacacgataattagtactggtggatgctccattctttttttgaataaataatggtggatactttttctccacagcagtgctttttttcattaatcttcactggctaacaggtgctgcataatctaacattgcttttatttttggataaagcattgcattcaaatcatttcattagatttagaagtcttcctggaaatagacgtgaactaccaactctagagctttggaggtgactttacttccagctcttctgctgtcttctcctcccgtccttgatcatctcacttgcctaacaagtgagtcattcacataacatttaagaagaaactcccatttgctactttgtgtcctgtttgatgtcttcttttccttaaggacaagacacaggataaaagataagtattacacgaacatgtcttcatcatgcctggccttttccaatcagtattccaaatatatacatgcatataatgcactctgttcatttcaaatgagatctaattaaatgctattttataccaaatatcaaaaatccaattagctattcaagtagactccagaattttttctgtttggccattcttactgaatatttcaagatttattgagtcaaaattttatactatttaaactgaggctacagagtttcagaatgagttttagagaaactaattccaggtgtattcttactgatcctatgatatctttctgtgagaaatataggacaaatacttctcttctgacttcaaaaaatgaagaaatagggattatgtcaatagcccacttctctttggagcaatgaaaatgttctaaatcttggctgttcaatatggtagcactagcgacatgtgattattgaacacttgaaatgtgattagtgcactgagaacctgaattttaaatttaatttaattaacttaaggttacatagtcgcatgtagctaatgattagtgtatatcacagcacasctttatatgctcaaagtgatggataaatgggcttctggatttgtaaaagaagagagtcaagaagggactgttagccaagcgcagtggctcatgcttgtaattccagcacattgggaggctgaggtggaagaattgcttgaggccaagagtttgagaccagcctggacaacatagtgagattccatcgctacaagaaaaaaaaaagattgattgttaattctggttctctcctcatttctcattcaggtgaggggacaattcacaagcagacacttgtttctaataggatgtcctgactatgtgagacattccatgccctaaaactacacatcacctcatcggaaacactgaaagacagacttctgccaaaataatttgctaagcttgtttaaacagacaggctgggtttcttctctctcataagactcagatatagaaatgtttaaagggttccgaatcataccaataatatgagcacgtattatggctgagtgtttgtggaaatattgcacatccacccaactcatcacctgttaagtcacatctttgtttaattttcaaaaatgaaatgattcatagtcatttcattcatgggaattggtgccagtttatttctgggagttcaattgccagcttctggaattgagacacaaatatcttaatataaacaggctatatgcaggagctttcaatcttctttccccttggaaaagcaccagtaatttcatatttggtctaataaatcagtttccggaagaatgtttgctgacgtcattttttatatccctcatggattttatatggaaaaacagcctggtcatgttcaaagcaatagattagttctggtagtgtctttcggcctgtgggagccctcattcctctgcaatcacggtttgggagtggttctatatcctgatacaagagaaatgcttttgtgaaaggcagmtttggaggtatgttgagcagagaagctggaaactgatctccttaaaacattgatttcatcatgtctgtgtttaagttgtggctgcagtttgctattttcggagacaaggccaatgtcagcctgtattcaaagctctctgtagtaaagcaatttatacttactaggtgaaccacactgcaaaggcccttctacctcacatttaaaattttatctatgtgaattttgatgaagattaacagtaaaggaaggcttgaagccaaagagatgagaagattccaccaaaaaaaaaaaaaaaaaaaaaagcaacatgcagcataaacatacttaaaaagaagagaggttttctgtctggagcccacactgctgtgattgtatgtttaggagaacagggtgattttcattcatcctgtagctgttttccatgctccaattctagtaattcataatacacctattaagcacctactgtgtgcatagaactgggctcagtggtacaagagaatctgttttcagcctcattggctattttaagccatgcattttaaatgaatctttatttaaaacaatttcaaacacaggaagattgagagactaatacaatgatcctttatgtagtcatcacccagctttaacaattagcaagcattcatcatgtttgcatcacttattcttttctgttgtagttattgttgctaaatatttttaagcaaatcccacatttgatgtgacttcccaacacatttgtgcatatctctaaaaaatattagcattttctcccataactacagtgccatgatcacacccaagaaaattgagaatatttccctgtaccctccaataaccagtccatattcaaattttcctacttattaaaaaaatgcctttttaaaaattagttcgttcaaatcaggaactaaacaaggcctaacattacattacattaacatagccattaccataactgtaaacattacattaatccaatccaaattttcttttatatataatatacttttatataaaaatatttttattatatttatagaataaacacacacaaacacacatatatttgacatgttgaagaaatttggtcagttgtcctgcagtccctgcactccaaaattctaaatttttctgtttacttctttgtggcatcatttatcttaatcctttatccctccattttcttttctcatttttttttcttttctgagatagagtcttgctctgttgcccaggctggagtgcaatggcgtgatctcagctcactgcagcctccacctcccaggctcaagtgattctcatgtctcagyctcccaagtagctgggattacaggcatgagccaccatgcccagctaatttttatatttttagtagagacagggtttcaccatgttggctaggctgctcttgaactcctggcccaagtgatcagcctggcttggcctcccaaagttctgggattatagacatgagtcactactcctggaccctccattttcaataaacttgaaagtttatgttcaatttttcttttggcaagcatgcagtacttcaaaagyggtgctatgtgctgcacattgtatcacatcaggaggcacacaatgttgttcataccactctctaagcatcctccatcttcccctacgaagtttaagagaaccttggggaaatcatttaaccttgcagakcctcagctttctcatagagacaatggggataatagtagtacacccttgcaaagtttagtgtaaagattacactatgtaatctttgtaaagaccataacatggtgcatagtacactgaaaaatataagagaccttaacttattatgaataaggcatgcaaagtagttagtacagtacactggtctaggagagtgttaataatgttagctattattgcctttataaattattttggctgaacaggccaggtaaatttcattgagtagacagtatttgaaggatgaaatgaaaaggcatagaccgcaacacactaagcctcagagaaacctctctgataagtttctttgtaggactagattataaacttcaagatggcaggaatgtattaattatttatccataatatgtagttcaatgcatggccctcaataatatatgagtaaaaaatcctacacaaactcaactttagactggctggtgtcttattgtgaagtcccctgcccccatccctatgatacccacataacatccccttattcccagctctggacacttgcctctgccatttccactgcttagaagacctaggcccagccaggcacagtggctcatgcctgtagtcccagcactttgggaggccaaggagggcagatcacctgatgtcaggagttcaagagcaccctggccaacgtggtgaaaccccatctctactaaaaatacgaaaattagccaggcgtagttgcgggcgcctgtaatcccagctacttgggaggcgaggcaggagaatcacttgaacccgggaggcagaggttgcagtgagccaagattgtgccattgcactccagcctgggcagcaagagtgaaactgtctcaaaaaaaaaaagaaaaaaaaaaaaaaaagacctaagccctctgattctaccaatgtaagttggaccagttcttccatgtctttctcttacctgtgtcctttgggaggacttttctgagactgttccaccctatatcccactttttcttttctcaatacctacatcatactctttgttcacaaagtttgatgcttatactttacagatttgtaggttgtcttgctttctaataactccctacacttccatcttatttcctctaaataaattgtaaactctttaatgggtgatgtgttagtcagtttttgctttgttacaaagagatatctgaagctgtgtgctttatgaaggaaagaggtttaattggctcacggttctgcagactgtacatgaagcatggtgccrgtttctgcttctggaaagggcttcaggaagcttacagtcatgatgagggggaaggggagccaacatgtcacatggtgagagggagtaagagagaggagggggaggttccacacccttttaagtaaccagatcttgtgtaaactaacagaacgagaactcactcatcaccaaggggatgacactaagccattcatgaaggatccactcccctcatccaatacctttcactaggccccacctctaacactggggattacatttcaatgtgaggtttagaggagacaaacatcccaaccatatcagctgagttggtgttttctgcctttccatcttctattctcctcttacccaatactcattcccaaccgaaacacctggcacaggagtagacacagtagaacttcatataagtactacctgctaatttagcatctccttattacacctttttcaatgtacttgggaactcaaggacatggtcatcaatacactgcctggatgagagtggcatatccctactaccactgcattatgattgtctgcttatgtgcctgtgtccctatcaaactgatagagtcctggaaacagagattatggatttttacttctgttgccctaggaacttgcacagggattggcacatmacagataatcaatcaatgatgaatttaagaaattgtgggccaaccaatttgatgaaattcacttttgcctaaaaaaaaaatttgactgactatttagactagttcagtcaacaaagtaagatgtttcaaccatttacacatatgggcccagccctcatgagaatatgaaacatatttttaggagtcagataaaattagaactaaaattgaaatggaagaaaaatattaaagacggccattgactactaatggctttattgttctactcaggagcatcatggagctttcaaggttttaaacttaaagaaaaactcttaacagtagaatttaaagcaggagagagagctagcttgaggcctcttggtactgcttaattcacactcaagagatatctctcttctctcttctggaagctatactattgttcctccttccccacccagcgaccaaaaaacaaagcagcttcaagtcctggaaagtacagaagaaaaatcttctctgctcatgttgtaggtgtgtttcttccactacttggggtggaattcatcaaccaggttggggcatgtccaggctgtgttccacacatcttctcctgaatcctcagcccaagcagaaatcagacacctccatgctgtcctttaagagaaaagctggcatttcagtgttttaaacattggcatattctggttcaatggcccagctagatgtaaggaaggtgtgttacccaatttttttcatgctttgaaccaaaaagatgttcttccttatgttttactccacctgaccattgcctggcttgaagaaaaaaagagaacacttttcaggagctgagaaaattggcattgatttaacataatttagttaaaagttagttctcccctgccatgagccacagctgattatttagagaattattaccattcattgttcattgagttttatctttctaaattttcactgattagcatgatttgttactaggaaaaatattatgattttaattgcattttggcatcttaaaagaatgtttcacactgcttaacatctgcagtcaacagatgtttaaacacaactccctcaatgactaaaatttggcaaaatgtataatagttggaacagcttaaaattctaaatatacttctaggaacatgatacaggcagatgaaatactacttgtgtgtgttttatattaaatattaaaatattacatataccatccctctcggagatgacaggtttcagggaaaaaaacaacagccaagagatgtttcaaccctaccataccagakatattctatctataagcagggctatgtcttatggtcactgtcaactgcagtggggacccttttttaagtgctatttattgtggttaactctagaggctggcagaggcaaagctgtgagacagacacgtttgtcccttttgcttccccttttggcatccttcttttctctgactcagatcctcaggagctttcatgaagatatattctaagattaatatgtcagacttgagtttaagttaattggtcagccttcagttaattggggcaaagattcattcatatcagagtgtgtgtgtgtgcgtgtgtgtgtgtgtgtgtgtgtgtgcacgtgtgtgagtgtggtgtctgtctgctgtctgtttctcaaggcaggggttcagagaggagagaggatgacccaattagcatttcatcaactatttgaccaaccatttaagccgttatgtttagcatggcttaaagaaatccagagaaaaatcatgaatttcatttcgatcacaacttttaacagtctgctcctatgggcactttatgacagttgatgactcggggcttagcagagagttgcttcctgtccccttgttgaactcatccccaatgaaaacgccatttctacatcaagaatcctagaggctgtagcagcaagaatgagaaatccacattttctgtccctggatggttaagttcacagtcacaggaactgtgcagatataaagactttcaatcaatgtatctctgcctaagcttatgaggtcattctgttctctgttactgatttaagtcagtaaattttgagtacagccgattacttaatatattatgggtgggtctactccaatcaattgaaggccttaggagcaaagactaaggtttcctgaagaaaaaagaaattggcctcaaaactgcagcatagaaaccctactagaatttccagcctggcctgacctgcagattgtggactcaacactgactgaaacatcaactcatctgaattttcagaccaccagcttgccctacagattttggactggctggyccccacaactgaataagccaattccctaaaatctcctctctctctcctctccctctcgactagtacacatgtgtatatgtaacatctggattcagagaaagtgactatagccaggaggaagtagaatcatggagagataaataggactaggctatgagaagtgcaatgcaggtggtccatcaggaaggggaagcagcttgtacaaagaccaggagatgggggtctgtgcttttgagggggagaatggagggagagagcctgagagtctgagtctggagactgtgttagagagcagtgagtactaagactggatggattggtaggacccaagaactgatgtgtagaaaagagcctcttcttttttttccacgcagggggcttagaattattgcattttttaaacactgagtcatcttttctgtagtactctacaacagagtccacttcagactgtgcagctgtccccagctatcaccatatcctctgtctttcatatctatcctaaaaggcatttgctcttcctaaaagggatgccctccaaagaaattttaaaagaatcttatcaaggggccctggagaagaaagggatgtgagggtcaagtcacaactttgaggggaaatagaaagagggctcctttctgagaaagaagaatttcaaagagtccaagagaaccaaaaattcaggacccaggagggtaagcattcctgtttttgcaagcttcacagaccatttgagtgagtgggtttttcaggtgacatttaaatgaacaaataatatccatgtctcagggtcagaaatggtactttgcaactgattctgtccctcttgagaggcttctgcaagactgagagggtgggatgacttaatgaacattaaaaacaatgttattaggctggatatggtggcacatgcctgtaattctagcactttgggaggctgaggtgggcaggcccaggagttcaagaccagtctgggcaacatggtgagaccctgtatctaataaaaatacaaaaatttagccaggcatggtggcacacacctggagtcccagctactcaggagactgaggtgggaagatcacctgagctcaggaagtcgaggctgcagtgagccaagattgcactactgcactctagcctacatggataggagtgagacctgtttgaaaaacaaaaaacaatcaaaaacaaaaaaaaacaacccacacaatgttatttttaaaatactgaggggagagaagttggggaaaaaaagggaaaacctaaaactctccataatcctaccatcagaaaattacactaatgtgataagtgactttctcccctctgaatctccaattccattacttgtagtaaatatgaatcttattccacaaactcagacatgcaaaaaaaaaataccactttactttttacataaaattaattctaagcctatagcaactctctttatcatattaggtaattaggaatttggtctcagatattattgtcaccctcagggatggacaagggtctcagggttttgtgtagcaccaaaccctaataagatctcttcagccattgaacttactctacaatattaactgctgaggtgtccatggtctcagactacaaggtgtcttccggttctggcttctctgctgccgcttttcaaatcaggagaatctttggtgaggctttggaattcccagctccctagcccagcctccctagggtcttcctcctcatcagagtgctccagaattcagactaggattccattcacactccaaacaccttcccttctctctccagttcctccaggacaccaagcataatctcctcaatgggtttaggttttacaaaattcagtaccagaatcggaagtgtcttgcagacaactttggcttctggccctatgacaaacatctcccttgtggcaggaggccacaaaaagccctgaccatctgcttacaagggaggaggggaagaaacactgggaggacaaacacaagttaatattccaaaaattataccactacaaactgttgaccgttttctaagtctctttccagaatrttcttgtgcttataaagcaaaaatctctctacacataagcttttcttttttaagcaaaaaggggattgtactatatatatgcagttacagcttgctttttttttcacatagtatagtgtggacactatactatgtgaaataataaggacacttcctagagtgtccttattttatttgtgacattgggtactgctccactgatgggtactcaggtggtttctattgttttgctctttcacacagtgctgtattgtgcacgtacttgtacgtctctgtgttctttttctatcatcactttctagaagtgaactgactaggttgaccaagtggctagtgaatcaatacagaagtttatttgcaaacaggagcatagttatctgtttctctgcactgcgagccctggccaactctggtgggttggttagcatatgctggttttagagaaagagcctgaaaatgcatttctcaagatcgtagtcttcatgcatttgataaagttggtggagttggtgcaaagattattctaaaagtctctctaattagccttggtgaataggactctcattattagtgtataggaaacaataatctgggctttacaactaactagctaagagaccctggacaaaccatgtccacctcgaggtctcaggtagatcatgtaaaatggagatgggacacagataatctcctaaagacttcctgaagtgatatcatacatattgttatacatactctgcattcctaaacatacactgtcctgggcaggtaacaagtatctgtctgtggattgatgacagactttgggctatattgactttgctatgcctcttcagtttcctactttatatttttggaacggtataatacatttgtgttagcttgtgttcctccaaaagctgacccagggacaagggttcaagtttaagaggtttatatttggaaagtgcaggaaagatcaggaagggaggtggctgatataaggtatgttatcaagccagctgtcaccgggcttaatcccaaagggcaatgctgagaaacagcgttaaaacccatgcttcagagttatctgcctttagatcaagggtgctcgggtgtttatacatgaaatcccatcagcacaccgtaatgtgctaatgtgctaattaccagcacatctagcctgccatgcaaaggctgaacagcctgccttggtttaaggaaaagccttcaggtcaagagtgcaaaaagagttttctggaacacagctaagggatgcgggcatggccacagtgtctactgtgtaactctcacagttcccctcacaccagtgttgctttactcttttgtgtctttgctcatgttgtattcactcctttccctttctgatcaatttcaaatcctcagacttcctatgtttgtgtcctgcctctgctacttcctagctgagtgactttgggcatgttacttaagctctctgtgcctcagtttcctcatctggaaataggcatagtgataattctcatctcattaaacagttgttaggatcaaatggtaatggtggaaagcacttatggcagtgcctaccacttaataagtcttcagtaaatgtcatcatatttattatccttcaatagctacttcaagtggtagtgccttgaagaaagcatccctgagacttcaggcagggttaagggctcaggccccttcttaacacattatgatgacactttccatatgcaagtttatcttctcctatggacagtgagtccaggaaggcgtcactgtggcttactcaggtctgcgtcctctgcaattcttgcaggacctaacctgccattctgttaatgagtaatagacagagactttgctttcattcactcataaataaacctttgctttaagattgaccctgagtaaaacgtaaatttcatcaaactgtagtaacaatacactttctttatcctaacacatacattgccaacactgctcccttaaaamacacacacacacacacacacacacacacacacacgcacacacaaaaccactgcttagtatttctgaaatcaggttgtcagtctaaatactgagatttgtttttcattttatctgcctttctttcacaaagtaggctattattaaataaatgctagactctagtattaaaattgacaaatgtatggtttagacctcaaagtgaaggataacttggaaatagttctcggttgctcttcaagaagaaaacaggttacctggggtgcctcgccatgtggtggatctcacactcccgtcattctgctaacacaatcccaggagctgattctgttgcgtactcgcagggtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaaaagaaaaacaagagcaaatccagatttgaatccagtctacttgagttaacagctggatgaatttgggcaaacaatttggacaagcgagttctctgcatttaacttttcatcatgaaatacacataatattcctgggctgttgtgaggaattattaagataagaagataatgacagcaatggtctactgaatacttaatatttgcaggcacagtaccaagggttttcccatacttggtcttattttctaaaattagcctacaaggtaagtaccatagattcttattttatagctgcaaattgagtttcagtgtgattaagtaacttgtgccatgtctcgctaaagaatatatataaatcatcacacatagaatacagtaggtgtttaacacatgtgagttttctcctttcactctgcttgcaatgctagccatagaagattttaaaattgtctgatttttgaagaaaaaacccttggaagagcactccctctctgctggactagagtttaactatcatcatgttctttgtgaatttgatagccttttaatccaccgargccatgaccttcttgtaatgtgttgacttcctctaccgccagtgtttctctcgagggacctccatctgcatttgtttgtggctgtccctctcagtgacatttcctcctttacctgattctcaagataatttgtttttcatttgagcttcagcagcctgagagatgatgtcaaaatcaatcaatcctcctacaagctttgtaaatacaatcccttggctttgcagaaagggtatctctattgcccagttcttcctggagcagtggggccacccaaaggagaatcaggaggttagaacacatcctagaacatgaaatctcatgcatgaggggatgtcagcctcatagcatctgagtcctagtgtgggaagatgggagctgaggaggtgtcatcccctgggacttctgggagctgcaggtggaaccttagagcccttggtccaatgtggataataaggagccctgttagagagccatagaaaccatccctgagtcatgtcttcctttctccttcaatatgaccttctctgggagtcttcttgyggggaggcagcaatgccttggaaagtttgagctggtttctgatgagaggttgaggcagggatctcatggttatctccttcctcaaaatggagccagaagatgcaagccagctgtcatggactgattgaagcctgttatggatttgccttttaatgtgtttgttaaaaatttgaatcaggtgcaacatttaaaatgggagacttcacatgaaactccagatttctggcttcccttgaaaaatcacacctgataatcctgggctagcatttctatgggcaagagtaggctggatctagggaagcctcttcaggtggggcaggtgcagtcctgtgtgccccagtccccacctgaccccatgctcccttaggttacctgtcttgttccctgggcatttgagttttgaaagaaggaacgggaaggaaaataacaatagagttacaagacttacaacctaacacagttaataacaggaaaagtaaaaggcgcttcaggtaactatttcctttacatatcacgcaaaacatccagttttgcagaaagataaattggagaccagagaagtgaattaagctgcttaaagtgttggtaaatggtacaaccaaaatttgaggtttggtctctttgactccaagtcatgtgaccacaaaatcccactttgctacagtggcctcccccagaatctgcttccctttgattaacaggatgccctcacgcttctgcatatccagggcacctgatgccctgtcagatatcaaagagttaatgttataccagtcatcattcttgataccaagaaaattcaagaggagtcttgtttttctctgatgctggctggcatcctctctgctccctgagtctctaatgagaatgtgtacagtggtattcaaatagggtaggagaaacttctttgtgtatcactgaggtcaccatttgcattaagggaaaagaggttcgatgactctcagttcggcaattcagcagccatctgtacttcacatcactggcctgaattttcagcctcattaaattctttcaggtcgtctggtcccaatctttgtggttacccaagtgtatatttatgtctcwtgagttattgccatttctaacctgtgcttaactgctcccacctcccactacccttaattgatcttgcagtacttctggtattttttttaaagtcttccctttcccaattatttccaagagcccacaggggttactgcatgtgtatcagacactgtgtcctctgggtttctacatggcttctaccttgttctgtcaaagctccctgtgatctatttttgctgggtaccaccatctcccactggacaccgccgccaagaggtgtttaaggtcatttggggttgcatgcactggtgggtagaatgaatgtttctttctcatggtctgtgtttcacatggctaccaaactgctggtagtgccatgtcttagggagcttagcttggttggtttttgtcacaacatccctctgcctccatacatacctttgcattgctccacaggattcagaggagatgccgtggggaactgggctgagagatataatactgagctagggtttgctccttccctttgatgactaaggctttatttttgcaccaagactatctgcctagtaccctcttcccttaggctgagttttctcccaggtggctctttactcccctgtgcaacccttgctatcttgcctgtattgggcatgactgggtctaagtgatggatatgtcttggtggctcgcagtcaaattggaacccctgaaatctgtttttttgttttctgtttttttgttttgttttttttttgttttgacaaggtctcactctctcacctactccagagtgaagtggcacactcttggctcactgcagcctcaatctcctgggcccaagtgatcctcccaccttagcttcctgagtagctggcactacagacacatgccaccatgtgtggctcattttgtgtatattttgtagaggtggggttttgccatgttgcccaggctggtcttgaactctgggctcaagcgatccacctgccttggcctcagaaagtgctgagattacagacaggggccaccatacctggccggaacccctgaaatcttaggtggcagtattttatataattttgtgtccttaaagcccaaatcacctgaaatagttttatcatacagcctcaacccagacacagattggcttaagtgttcctctaagtgcttgggtatgcagcttcattgtcttctttcctaaagaaacaagcctgtaactcaaagattttgaaatttggattcttgcttgatgtaagctgagtagcacggttataaggctacagacaccactgcaataggtgggactccttgagccagcttaagccacaaggaggaaatggaagtggaacccaaggaaaggattatggctaggtcttgggaagaagggattgaggcagtgaacttcctcttgttcctgccttcctctgtatctttatgcagactgtctacctttgactcccagttcacaaggtggcatatgaccatcccattcttttcaggtttacatataatagttccagaaatatgcaagacttttctagtcccaatttaaaattcccaagaggaagaacctgattgtttctgtttaggtcagtgttcatctctgattcaatcaactgtgttccattcaccaagtctgtgtctaaggatcaaagatagaccagagaggttacagtgagctgacagccacatacacatccattctacttgaccatttttttttttcccattttctcacatttacttgtacctttctggaaasgcactgagtagaggggcaatactcaagataagcaatgaaagttaaccataatgttttctttcttttcttttyttttttctgtgacagggtctcactctgtcacccaggctggagtgcagtagtgtgatctcagctcactgcaacctctgcttcctgggttcaagtgattcttatgcctcagcctcctgagcatctgggattacaggcgcacacgaccacaccagctaatttctgtatttttaatagaaacggggttttgccatgttggccaggctggtctcgaactgttagcctcaagtgatccccccacatcagcttcccaaagtgctgggattacaagcatgagccactgcactcaaccctaacaaagaatcctagtagctaatgtttactaggcatttcgtatgtaacagatactgtattgagtgcatcacaggaattatctcacctattacatacaagaagatcttatcattgattattattattttcatgtgcgtccctgtgaagagaccaccaaacaggctttgtgtgagcaataaagcttttaatcacctgggtgcaggtgggctgagtccgaaaagagagtcagcaaagggagataggggtggggccatttataggatttgggtaggtaagggaaaattacagtcaaaggggggttgttctctggcgggcaggagtggggctcgcaatgtgctcagtgggggtgctttttgagccaggatgagccaggaaaaggactttcacaaggtaatgtcatcacttaaggcaaggaccggccatttacacttcttttgtggtggaatgtcatcagttaaggtggggcagggcatattcacttcttttgtgattcttcagttacttcaggccatctgggcgtatatgtgcaagtcacaggggatgtgatggctgggcttgggctcagaggcctgacattcctgccttcttctattaataagaaaaataaaacaaaatagtattgaagtgttggggcggcaaaaatttttggggggtggtttggagagagaatgggtgatgtttctcagggctacttcaagcaggattaggggcagcgtgggaacctagagtgggagagattaagctgaagggaggtcttgtggtaaggggtgatattgtggggatgttagaagaaacatttgttgtatagaatgattggtgatggcctagatacggttttggatgaattgagaaactaaatggaataacagaaggagaaaaacaggtataaaaggtctragaattgggacgactcaggatatctgattagagagtgcctaaggagatacagcatagtcctgccagcaaagattatttatttacttcaagagttaacagtggcagtttggggatagcaccaggagatatcagctgtgatggcttggaaaaacagtgtaaacyggcagtgtaaacaagagcagggtatgagtagttgagaacggtgaataggagtatgactagacagaagatagtagggatgacaagatttttggggcacagtctaagttggtctggtgtctggaatgagacyggggcctaataaaaaggagcatctatacaggagcttaaatgggctgtaccctgtagcattccgaggacaggcctgaattctgagaagggaaagtggtaaaagtattgtccagtcctttttaagttggtggctgagcttggtgaggtgtgtttttaaaagacctttagtccattctacttttcttgaagacggaggaccgtaagggatataaaggtttcactgaatactaagagcctgaaaaactgcttggctgattttactaataaaggctcgtctgttatcagactgtatagaggtgggaaggctaaactgaggaattatgtctgacagaacggaagaaatgactgcagtggccttctcagaccctgtaggaaaggcctctacctatccagtgaaagaatctacctagactaagaggtattttagttatctgactcaggccatgttgagtaaagctaatttgccagtcctgggtggggcaaatcctcgagcttgatgtgtagggaagggagggggcctgaataatccctgaggagtagtagaatagcagatggaacactgagaagttatttcctcgaggatagatttccacgatggaaaggaaatgagaggttctaagaggcgggctagtggcttgtactatagtataacctgcctttgctggtgtgtggcgattaggcctggtggaactgccgtcaataaatcaagcgtgatcagggtgaggaacaggaaagaaggaaatttggggaaatggggtgaatgtcaggtggatcagagagatagtcatgggggtcaggtgtggtatcaggaataatgtgggaggccggattgaagtctgggccgggaacaacggtaattgtgggagactcaacaaagagtgagtacagctgaaggagccggggagcagaaagtatatgcgtcaggtatggggaagaaaatagattttggaagttatgagaactgtagagagtgagttgagcatagcttgtgattttgagggcctctaaaagtattaaagcagcggcagccgctgcacrcagacatgagggctaggctaaaacagtaaggtcaagttgtttggacagaaaggctacagggtgtggtcctggctcttgtgtaagaattctgaccatgctagccatgcctaggaaggaaaggagttgttgttttgtagaagstgcttgggtttgagagatcagtcggacacgattggcagggagagcacgtgtgtttttatgagaattatgccgagataggtaacagatgaggaagaaatttgggcttgattgaagtaatgggggctgtctgtgaagctttgcagcagtacagcctaggtaatttgctgagcttgatgggtgtcagggtcagtccaagtgaaagcgaagagaggctgggattaagggtgcaaaggaatagtaaagaaagcatgtttgagatctaggacagaataatgggttrtagagacaggtattgaggataggagagtatatgggtttggcatcacagggtggataggcaaaacaatttggttgataaggcrcagatcctgaactaacttgtaaggcttgtctggttttaggacaggtaaaatgggggaattgtaaggagagtttataggctttaaaaggccatgctatagcaggcgagtgataacaggctttaatctttttaaagcgtgctgccggatgggatattggcgttgagtggggtaagggtgattaggttttaatgagatggtaaggggtgcatgatcggtcgccaaggagggagtagaggtatcttatacttgtgggttaaggtggggggatacaagaggaggacgcaaaggaggctttggattgggaagaagggtggcaatgagatatagctgtagtccagggatagtcagggaagcagataatttagttaaagtgtctcagyctaataagggaactgggcaggtggggataactaaaaaggagtgcttaaaagagtattttctaagttggcaccagagttggggagttttaagaggtttagaggcctggccgtcaatacccacaacagttatggaggcaagggaaacaggcccttgaaaagaaggtaatgtggagtgggtagcctccgtattgattaagaaggggacaggcttgccttccactgtgagagttacccgaagctctgcgtctgtgatggtctagggggcttccgaggccatcrggcagtgtcagtcttcagctgcgaagccgagaagatctgggaaggagtcagtcagagagccttgggccagagttccagggcctctgggagtggctgccaggtgagttgaacagtcygattttcagtggggtcccacacagatgggacacggcttaggaggaatcctgggctgcaggcattccttggcctggtggtcagatttctggcacttgtggcaagctcctgggggaggaggttctggaggaacgcctggccgctgagtttcaggcatttggaagttcttgtgtgctggagatgtggctggggtttgtctcacagtggaggcaaggaattgcaacttttttctattattgtacaccttgaaggtgaggttaattaaatcctgttgtggggtttgagggccggaatttaatttttggagttttatttaatgtcaggagcagattgacattattttgagaataagacggccttttgaccttttagggtctagggctgtaaagtgtctcagggttgctgccaaacaagtcatgaactgagctggattattatatttgatgaaaaagagcctaaacgctatctgatttgggataaagaaaaaggagcattaaccttgactatgcctttagctccagccacctttttaagagtaaattgccgggcaggagggggaaggctactcacggaacgaaactgtaagctggaccaggtgtgaggagaggaggtgataaaaagattatagggtggaggagcagaggctgaggaagaattgggacctagctcggcctggcgaggagcagcctggggaggaagggagaggtcagatgggtctgtagaaaaggaagattagaaagactcagcgacgcttggtgttgggactgaggggacaggcgggagggaaagaaggaagatttgggaygagttgcactgggcacagagactgggaagggactgatgtgtaaaagaatgcctggatgtcaggcacctcagaccatttgcctattttatgacaagaattatttagatcttgyaggatggaaaaagtcaaagtgccattttctggctatttggaactgctgttgagtttgtattggggtcaggcggcattgcagaagaaaataaggcatttaggttttatgtcaggtgtgagttgaagaggttttaagtttttgagaacacaggccaagggagtagaaggaggaatggagggtggaaggttgcctatagtgaaggaagcaagcctagagaagagagtagagaaacagagggaagaggtttgggggttcttaccttccagaaaagtgggaaaaggggttggggcacagagataaggggttggggcacggaaataagggatggggcacagaaataagggatggggcatggaaataagggatgaggcgtggaaataaggggtaggggcacagaaataaggggtyggggcacagaaataagggattggggtgcagagatacgaggttggggtacttgcccctcctctagaaaagtgggacttgccactaagagtgaaggagaaggggttgaagggtacttgcccctcccccagaaaagcgggacttgccgctaagggtgaaggagaaggggttgaggggtacttgcccctcccccagaaaagcagagaaggggtagagacaaggagagaaggggttggggtacttgcccctttcccagaaaagcgggacctgccgctaagggtgaaggaccaaggcaggcatccctgcatggtctgacacctttgaaacgtgggtgaataatcaggcgtccctgcaatgattaaacaccaagggaaggctgccttcccagtccgtgaccggtgctggagttttggatccacagataaaacgtgtctcctttgtctctcccagaaaatgaaaggaattgaaattaagagaagggagagattgaagagtggaaaggagaaagtggttgagggacagtgagagaggttggagaagagagtaagaagaggccgcttacctgatttaaaattggtgagatgttcgttgggctggtcggtctgaggacctgaggtmgyaggtggatctttctcacggagcaaagaacaggaggacaggggattgatctcccaagggaggacccccgatccgagtcacggcaccaaatttcatgtgtgtccgtgtgaagagaccaccaaacaggctttgtgtgagcaataaagcttttaatcacctgggtgcaggtgggctgagtcygaaaagagagtcagcaaagggagataggggtggggcmatttataggatttgggtaggtaagggaaaattacagtcaaaggggggttgttctctggcaggcaggagtgggggtcgcaaggtgctcagtgggggtgctttttgagccaggatgagccaggaaaaggactttcacaaggtaatgtcatcacttaaggcaaggactggccatttacacttcttttgtggtggaatgtcatcagttaaggtggggcagggcatattcacttcttttgtgattcttcagttacttcaggccatctgggcgtatatgtgcaagtcacaggggatgtgatggcttggcttgggctcagaggcctggcaattattagcctcatttcacatgaggacaccagggttagggggcgggctggaccaagatctatgtggagagcagagttcaacccaaaatgcatgctttttatcactatatttagagatagacacacctggtttcaatccttgaggttgccactagctatgtgatttttgaataatcattctgaatcttagtttccacatctgtaaatgaagataaaaatacctttccaattaaaaatgattttaaactaggcaacttaggcaaattattcttttccttcatgtacctgggctttcccgcctcatctaagcacacttkttctttctaatgctccctgactgtaaccaaaacctccagagcccttcatccatcctctgattgccatgaattgccaacatcagataaatagtttaaaaagtggcaagaaagtaggatttcragtcagaagacttggatttgaatcttgcttcagctttgtattaattgttatcattctgaatcatagtttccccatctgaaaaataagatgtggagttgttattattggtggtggtctgttctaagcattaaatgaagaaatgcatgtcaaaccttctgaaaactcagacaccaaacacttggaaaggagtctgttacagtctcaccaatgcaccacaatgtagcagtctctccttgtgaggtatcacccaagaccaagagaattaaggagtatggacccaaagggtgaggtcggagtgaaagtttaataagtgaatgaagaaagctctctgttgcagaarggggacctggaagaggattgctgtttttcacagttgaatgcaaaggcttttataggaaactgatgagggctgggcattttgtttgcataaggcatgtttttctggtagctccaccccatcctcctaaggtgcatgtgggcccttagcttgagttacccatattgctttgttgcccttattatgcatgtgtcaggggatgaaattttccactgctggcatgtctgggcaagtcacctgtgtagcctttcttatctgtgcagctgtgggcatgtcttaggcaagtmccccagtgyaagttcccttatctgtgcctgcaggctgttcttttgtttctaaaaattcaatccagggcccatcctaactgcctgcctgaccggtttctttctttttcctctctcaattcttattaaggcagaaaaattctagaatgactttttgtcctatagccttgttcccagaatgctttggaaatgtaacagccaatttatcaagacaggggaattgcaatagagaaagagtacttaatgcagagcaaagagaaaaaagataaagttcttttaaatatatatagcttggatattcatgtttaattaagcaaattttaaccatagagctcttttgtttaaagaaaatctcttttaaatctcttattaccagactctagtcaggacagccaatatttctggcctttgaattctaccccaggtaaccgcccacatgaaattagtaagttttaattaaggttataacttaaccatggatacaaaaggtgttttaaagagatggtaagcagctttttttttttaaaaacaagatttagaatatccccaaaggtagtacagtgaaaggaaaattcaagacaggaaatcagaagctatctatggggtgaaaaaaaaaaaacctcaataaatggcaaagttccacaaataacaaaccagaaaggaatcattctgtaagccaagaattgaacctgggccaccattgtcaagagataaaaaccttagctactgagctacacagcattgagcagtttctactgctctcccccgaagaagtctacagcagctgatctgaagcttgcaaaggcttttaagtgctcaagataattcttagggctgtgatatgaacccccaaattcctgtcctctggatggtggagaccaggatgaagtacctctacatggtcacaaagttaagctcttaaagacacaaaacaagacagaaatttcatctggtattggtttcagggacccacaacaaagtttataactgaccagcctgccgggttggcttgaaaagcaggattacaggggtcctaaactcatgttctatcctgtgacacccttctctccattacggaaggacaaattcttagtacaaagtgcaccagatttgccacagcctaagactagtctcacaaatccttttttactattcatcaaacctttgcagagacacacagtgacatttattgcttaccaytgcccccctccaacacacacacacacacamtcacacagacacacaatgcagagagacagagagaaagagagagagagaggccagacacttttctggtaagaattcttgccctttgtgccagcatatcaggtttctgggtcccctttctctgcagcttctagaagaatggagcagcatttgatggccctgttcaccgtgccatagacgtgaggggaccaagccccattacaaaagaaaatgatccttttctgttttatggaaccataggcaaaagcttctcaatgttgcaagatgctgcctgatgggctacatggggaaccaaattaacattttccattccagtggaagcaaaatacacataacgctacagacattggtcaccttgttcagcacccaacatcgacctggcaagactcgaactttttcccgttggtccctgttgtctttgatctacacaaagtggggaatggtgacctccatctgggaattcaatgggtgatctctgggcaagatgaagagcagtcacaaacccgatccagggctgttaaacttctttcaggactcactgaatgtgaccagatagataaggagagttctctgagttaggcctgctagacttccatcagcaattccttcagagatctcctccacatatacaaatacacacatatagacaagacagacagaaggctttccaaatcaagattcctaaccaagaattccagagtatctcttccaaactatcctcctattctctgtttgagaaatctccctgaaatcttcttgattgaggagaagtctcccgaaccaagactctttttactagttaggcagagccaaccgagaccccccaggagccaaaccaagacagacaccccatgttgtagctacagacacctcacaatggagctacagaactagttgcgaaaaggaaggagacattggcagcacctaggatactcaccaacccagacaccctacaatggggctatagacagacaccctgtgatagggctacagttatgggacgtctccccaggactrtttctctattaaatccatgcccattgggtcgggagtgccctgtcagtagagagagtaccagagtcaactcccagtccaagtgaactaggtggctgcttgggctggcccctggatccattgctggagggggctactgaaccacgggcaggtagccacaagggcaatcctggatgagcctcgaaatttgtaaccacccaatggattcaccttgcccactgcttagacagagctgatttattaagacaggggaattgcaatagagaaagagtaattcagccagagccagctgtgcaggagactggagttttattattactcaaatcagtctccccaaaaactcggggatcagagttttcaaggataatttggtgggtagggggccagtgaatcaggagtgctgattggttggctcagggatgaaataacagggagtcaaagctcttctcttatgctgagtcagttcctgggtggagaccacagaactggttggcaggtccaggtggggccgtccagttggtagaaatacagaaacctgaaaagacatctcaaaaggctgatgttacctttaagagtaactggggaagttgcaaatcttatgacctccggaataatggctggtaatatctagaattccagcccctctcattctaacttggtggctggtggcctttccttcattttataagaacagtttagttttggggaagggctattatttaaactataaactaaattccttcccaaggttagttcagcctacgcccaggaatggacaaggacagtttagaggttggaagcaagatggagttggttatgtctgatatctttcactgtcataatttccttagttatcattttgcaaaagcggtttcgggaaggccattgtttgcacagtattttcatactcttaatttgtagctgcatatgtttgcatgtcttactttttaagtggcaggagttttgagtctagggtgtgtctttcaagtttctttacagaacttagaaataatggatgtttaataaacgctagatgtacagataacattcaagctttctatgcatctgtctttcatgtttttgttgggatgtttttcaacagtctggagacctcttaacaatggagtgaaaggctttgaaaaatctctaaaagcctgtataaatgcaaaagtattttaaatttacaggaggtgctgttactactaatactgtgcaaatttatgagtagttgtggaaataataactctatgagcaaaaatgcttctatttctgttttgttctttgcattgtgcaaatatagcctatataaatcaaatttctacatttctgcatcctgtgtgccttaagacatatgttgagatatcaaaagaagaaaaaaacatataacaacctggaatcacaaaaggctgaagcttaaagatcattatgttcagccctgccattgtacagacgaggagactacgtctaacggacacaaaatgactggcctaaggtcacacagcaaaatagtaatcttttttctgtcattattcgttctctgaaatatgtgggtgtgtttagtattgttgacatttccttggaaaaagaacaatttttaaaatgaaatcttttctttccagggctagagcaatgtatcttaggctcacttaaggaagctgtagagatgagcccaaggagggaaaccagaagagccccccaggctcaccagttgtttgttggctccctacaaacatgtcattcaagtggctaatcttacaacagcacaaattcatctaaccaggtgagtttcttcgagtcacttcaaataattatttcttgagcatctacttcatgccaatggtgtgctagattctataagaaaataaatgtgaattactcacagataaaaataaataacaatcaggctgcgtacagtggctcatgcctgtaatcccagcactttgagaggccgagtggggtgtatcactggaggtcgggagttcaagaccagcttgaccaacatggtgaaaccccatcgctactgaaaatgcaaaaattaagtgggcatggtggcacacacttgcaatcccagctactcaggaggctaaggcatgagaaacgcttgaatccgggaggcagaggttgcaatgagccaagatcgcaccattgcactccagcctgggcaacagagtgagactccatctcaataaatgaataaataaataacaatcaagagaatagaatcaatatagcccagtggacaagaccatggattatggagccagactagctacttactagcagaatgattaattttgagcaagacccttaagctctttgggagtcaggttcttcatgtataaagtgtggcttacttaatagtttctgtgaagttgtgaatttaacaaatatcaacctccttgccaaagctaactaatttgctaatcactgattttgcaaagcgtgttgtggagatgtggctggacaggtttgccatcagagtcgatataccgttgtattaaaaacaagataaaaaagctgccaagttctttcgtgagtggttggttagtctgaaatctttgcaagatgctgatgctcaagctgttgacctactcattgcctactttaacaactgtcagagaaacatgatgtggggtaaggaggtgctttttaaaaatcattcatagacttctgtaaaatgcaagataaagttattttaacagtggaaaaaaaacaaatatcaggtgctttcagggtccaacatataataagtgctatagttaacagttattttacatttattatctccctgggtctcaccctaagcctatgaagtaggtagcattcaccttttatagaggagtaaactgaagttaagaggtcaagtagcctgcttaggtcaccctgcaaccagcaacagagccaaaagtcaagcccaggtctgtctgacagccaggcctggcctcataaacactgttctgtgtgctgtcctcagacacaaaccttgctctccagaaagtcatattctagaagccttattgcagggctgaaaacactaagtgccactagagagatagaaataatgtggatggggatttcacaacagggcctgtgggaaattgtttccagcttagaaaatcagagggagttttaaggaagaaatggaatttgagtcttgaatgatttatttgtgcagaagcaggagtgagaaaggacaaacaaaaaaccagggatgagaggggtgaggtatagtttggaaacaggcaatagatggttcaataaaagtggaccctgggatatrtgcaggagagcagggaaaggtgaggcctgcaaccctccctaggtgaagtcagatcacaaggggcctcaagtaccaagctaaagagtgtgcatctaaaattgaaggtccttaaatagctttttaaaagacaaatggggggcgaaaagaccaaatgggaaaaaggaaaaaataagacctaagactttgagacatggtgattatttgtcagtaagaattggcggaatatgggcttattaacctagttagttctcttctgaaaaagccacataggttttacagaaaaaaaagttgattttgcaaacaacatacttgttcatttgaagagttgaagcattttttctgaaatgtgatataatttttatatttaagttaaaatgcaattataggtatttttccttgattggataaaatagatccagaatttaaattttatttgtgaattgttcccctccttccctccccctctcccttccttccgtccgcttgcatttgtgtttggttcactcctctctcttagacaaaaggtattttctcatttcttaatcccaatttctccttcatgttttgagtgctgttttatgtttcaatttcatatttattgtaatatgaaccctcagccactaggacatccaacatccctagaatggcagagttgaaatgaacagtagagatgatctattctaacattcatcttacagctgagacaatgaaggctcagagaaagaacatgactttttcaaaaacacagagtgagttcaaggcagaagtgggacttggacttgttttctggctcctttctagtgctcatttcagtgcatcatctgagcacatgtgtaggcagggctctgggcctttaccttcttgagaatggtttagggagtctcaatagacttctcatgtactgctgcaggacttagaatctatgaagtatttagagctggagggaaccttaagatcctcaaattctgcatcgtcctggctatggtctaaatggtccctccaaaattcatgtgttgaaaagaattccccgtgcaacagtgttgggaggtggggcctttttgggagatgtttaggtaaacagattaatgccactataaaagggcttgatgagagtttggcccattttcactctcccatcccttcttcgatgtgagaacacagtgtcctcccatctgaaaaatgcagcatcaaggtgccatcttgtaaacagagagcagccctcaccagacagctgaacctgctggtgccatgatcttggacctcccagcctccagaacagtcagaaataaatttccattctttataaattacccagtctcagcaattctgttaaaacaatacaaatgggtgaagaaactccttttgcagaggagaagaccaaagctgaaagaagtgaggggagacctgcttagcttatgtggctagagacgtacagagcaaggtcagggatttcaatctgctgactcgaggcccatgttttcactctgtacatgctcatccttattttcaaagtctccagttcaaaaattcatctctttgcagtcacatatactgaagggaattctgcttcacaatgcctggaggagcttcaagtggaatgtgtccaaaccaggaggaaacaattcccttggttctcctctggatgtcagtgcaggttggtgtgcagtgaaggtaggggtgtggaaagctggccaattccactttacaagttctttattctctcatacccgggaagtaccacagctactgaattcttggtgaaaccagaacctaaaacagtaaaagtggagttgggaacctggggaagcaatactcaaccaagccaaaactaagattgcatatttacatagaatggctgtagccatgttgttcttcacactcacaaagtgaacacacagctcaaggctcagtggccagactatgtggtgggggtgggatgtggcaagatgtgcatgcatgtgaaagaacagtgtaaactctaaaacatctacaacagggaaaagcaaaaagaaatccgtatttctccctctgattatcttggtctctctcttctgtcatggattagacccagagaagaatactagtccaaatctccagcaactgttcatcatttttaacctttcctgcctggtaaaataacctgggagctttgaaaataatattgatgcctgagcttcactcccagagattctgatttacctgatgcaggatggggtctacaattcataatttttttaaaactccccagatgcctaatgtgcaactagggtggagaattactcaattaaactatcaagttgctttccctgactgctgggatcccttccttggctgctgcaaacaatgttgtagccacttagggctaaatacacttataatgtggccttacactgcattcattcaatttaatagacacttgttgactgctttccggtacatggctaggtgaactgcagtgggtacacaggtgaatgaaaatgtccacygctctagaagagtttatacaaataactgcagcttagtaagggagcaattattttacccaagaaaatgctaaaggcttcatgcaattgaacctttaacatatagaaacattttttatattcatagaaaattcatttgttaagagaaacctgcctaatcgaaaatttgctttgataagtctaccatggtatacaaacaagccgtggactagtgcctaggtttgaaaagtgaaagcttctctgcataatagagtgagagcaggtgatcagcactaaatgctgtgtagggaaatggtcaaaaggacacttaatgacttttagagatgggatctcaatctgtcacccaggctggagtgtaatggcatgatcttagctcactgcagcctcaaactcgtgggctcaagtgaccctctcgcttcagcctcctgagtaactgggactacaggcacatgccaccacacccagctatatatatatatttttaatttttttgtagagacagggtctcgctatgttgcccaggctgttctcaaacttcaggtctcaagcaatcattttgcttcagcctgccaacgtgttgagattacaggcctgagcctccatgcccagccataaggccatttttaataagaactgttaaaaataaaatgtcaattatggaatgtaaacttcattttcacatttattaagaagtcttccataaaatacacattgctcattattcagtgagagtgaattgtgtatgaaaaattcgaagaagtgctaaatcccaccttgagatggcagaagaaaaccagagggtatacatggggcaactgcctgatgtgtgggtttgctagattttacaattaaaattgcaggacacccagtgaaatttgaatttaaattaatacaaatcattttttactataaatatgttccatagagtatttgcacacacttatattaaacaattattcatttggtttgatgttttttctggcagccctattatgggttatggttgggtagggattttataatcagagagggagacagggaatggacaaagatgcagaggaggtagagtgtaaggtacatttagggaatagggagaagtagggttggagtgcactgtcaagtgtgttggaagttgtctggacattaaagtaggaaaataaagctacatcctataaggccataatgccaatatcaccaatttgttactctgtcagcaatggatagccctttgatatattaaagggagggaaatcatatgctctattcatccattcatctatccatccatccatccatccatccacattaatgtatctgtatcaatatggcacacttgaaaagcatatgtcctctgaatttatattctagttctgctatatgctcactgagtgatcttctgcaaattactgcctctctcagcctcagttacctgaaaaataggcawaattagatctacatcttacatctctcatcaggtttatcacagtgacatacaattgccaagcaggcaagtccaccttgaatgcctttttgactcgtttgagggttccaatactgtgtgtgccaacttagaccattatttcccagaaacattcctcttagtctatcgatttcattcccttgcaatgcactggcctttacacctgcatagtcaacagtgaktaaagacagcatttctgtctctcctgccacatcggtacatttgtgtataggtaggtgttgctatttgtgtaacgtattacgaagtgttttcatgttcattattgtcattgaaccttcagagagatcattctgctatcatgggaggatgttggaagtgggttgggktagagagattgggggtagagagatgggttggaaggctgctgtgatagcccaggcgagatgcaatgaagacctgaaccagagtagtggaaaggtgagctgaaagtgaaaggaatggatgaaaacaaacggcacagaaataaaaacaaagggaagttctgacaccygcgttttggtctccttgacattgcttccatttcctctagggacatgtcctggataagggtgaaactggatgctccttggcagtttcagatgtcaccacccctaactttccattggataaaagaaggcccaaaatagcctctggtcccataggctagtgattactgggactcagattcctgtcctgaaaacacggggaagaagccaggcatttgcccacttaccctctcaccagctgacccagggcattagcaccctggtgcctgctgacgcagagcatctgccaaattcgattagccccgtggcctggctaagctgggcatgtcctgcactgcttctaaaacaagccctccaggaaggggctgcgagactcggagatgttttttcctactgtcaagcaggaatcactgcttggcagtttgaggtagggatggggaggagataaaaatattagaagatgcagaagataaaaccaaatactaatctaacagtcacttctgaaaacagagaaaacactccaaacagtcaacatggattgtttttttttctctttgcttcaacttagtaaagccctttggagtccagcagaatgagccaagcagtgtgaaatgtgtggaaacatgttgttggctcagagcaggttgcttggaggcgggacaggtgacgacctgcctgtgagaagcccatagagctctcttctcctcaccactgggtcagttgatcctcatctgtagatgagagatcctcatctgtagactcagccctcctgcagccattagtgcctctcctgtttctaatcacagggaatctaaagaaatttaaggascctcgttcaggagctcagtgttagattgagctttctggtgggtccattctgactctgaatgttgattttactatctaaaatcattattcttgtttctatggctagggtcctacttgtattcaatttcctatagaactagcgtcctgtcttgttaattcccagtcattagaatcccacacccaagtttgggaccaggttagggctctgagtcccatgggcagaaatctctgatacctctgactcctgtttacctagaggaagaagaatctggagcagcagttctaccctggctggtcaacaaaaccactggaaagatctttaagaaatacagatgccgggcgcggtggctcacgcctgtaatcccagcactttgggaggccgaggtgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaagaaatacagatgcctgggccccacccccagagattctgatttacctcgtctgggtatagatatattttttaaattccctatgtgattcaaatgtacaggtcaggattgagagccaccagtctggtggttaaaattcgagaccttgggattatatagatgtggcttcaaatctgactatatcatttattaactgtatgaccttgggcaagttatttaggctactgtgttgtcagttttcttgtctctcaaattacatctatctcatgattattttagatagcatggaaagcatttagcatggcatctggtacaaaatagggatgtaacagtattgcctattgccaaacacttgtccttgtgttcaaccaattgctagggtaatcttaccctttacttgatttacatatgattctttgcatatggatcgtctgtctgaaacccatcgatagaactctttatactcattatagaacattcttcaccctttcgcatctaacttctgctgaactcaagggacacatcagtcctcagcaccttgactttactacctgatctaccccatcaccaatgggatctgttcttaagaaagtgggaaagccaagatagcaaactgagttcatcttttggttcaattcaattcagttggcagtggagcatgaccttgacatgacttgtgaggctgaggtgcagcaaagacttacaagtgatgtcagccatacatggaagaatgggggagagaaggctggcgctggtggccagggctattgcagacccagcaggcctgagtcattatcctttctcttctccaccaatcccaaacacaaaataactgtaaagtattgacctagggaggattgggcactcctgggtcttgcaagtggttccacaacactctgcctatctgcccaatcccagcaattcacaggaagctcatcagattgtccatgaggttaaaggggtgacaactgccccatatccaagtattggaaatagctgacatgaagctctagaaaccctacattcaggtttttcagcacagagtagggttgtatccacttttggaaaggcctccatgcaatgaaagactgtttgcatgttaaccttaaaagaycaatccaggactcttctgaaagctaaaaattctaagcaccactggtggtctccctttttgaaggaagccaaatcccttggacatgtaactagctattccacccccctccccacaaccacggccttttttttttttttccttctgtatgttctcaatgccctttgcacttttaaatttttcagtggtttaagagtggctccagatccaggctgccctgctactcacaagtgttgcagcctttgccaacttaattgaattctctgtgccttagtttttttcatctctaaaatgggagtactaaaactaccacctagtttatggattgttgtgcagtgagaaaatctgcataagatgccttgaacactgcctgcttatagtaagtactagtcactataattgtgcaatgggttaaatgtatgtcaaggacatggggcagaagttgaggtaggattttcctgatgtgccatgtctatttttagaaatgtgactgtggccccttgtttctttcagactatgtgagttcatccatttcaccctggcttcagtcattgccattcagctgggatagacacttaggaataatgggcttcatttggaatgtacagtctagaaaaacaccctttattgtagtatatctcttccatttgcttgagtgtatgtagtggccacagtttaactgccaagcagtattattgctagtgggtaaacaagagttatctctctgagtcttccagaaaagacaaagtgaccctggatgctaatggcacagatgagatgggatctcttccaggagtctgaataygagaaaagagtctctgaagtgtgtactagatgagcccagcttattaccagtcagcagagtgacttccaagagtttgtaaacattttctgaggctttctcatgggtctgtaactttcctaagtgctttatatgtattacctcatttaattgtcacaaaatcccatgaggtaagtgggaatatttttacctgtcctttgcaggtgaggaactgaggcacagagaagttaagtgacttgcctacagtcacacagctcttgtagcagagttgggattcagactccactctttactatattatgtgccccctgagtggtgagatgttggatcccagaggaagcagagctctgaggtcatcaggaaggaaagcagggcatgaagtgggagcagaggtggattgaacaaaaacatagatttctcagagattcaggcacaaaggactcagggccaggaataaaccaaagttggattgctgaaatgaggagtttcaaacactggcatgccagtgaggtttgtctcctaagctagccaaagctccactcagaatgacctctttaccattctgaaatatctgctgtttctctgaggaaatctgctgctgaatgtggtgttgctgtgatttgttatgagatacttttgttctcaaggccatcctctcaggaggaggaactatccagagtactcgggaggtggtggtgaaacagattgggaaccgtacatccttggtgaatttataaagccccaaagaacagagatgcaaacccatttcattcaaagagctctgttaacagtgactctacaggatgctaatccagcagtttcatgcagagtttcctgaccctgcaacttggcaaaacacaaggaatctctccttgccaggcaccatgtaatacagtaagaatgagtgacataaaacaaaggtaaatacattgcctggctttgaaagtaaggttagaccctggtagaaaatttgcatcttgaggaatatatgggcaccttccccaaggtattttctgcctgcttgtcagacagttggtaatatttttatagttgcatatgaagtagaaaccttcctttggtcacatcctccccaaccgccacactaacccaaggtgcctcctgcttttaatcttgtggcaagtaccatgatataaggacaccagctatggagggaggcaggagatgcacagtgaattatctcagaatgcttcccagcctttaagtgcttcagaaacctctttaatctctttttatggcaaataatgaagtaggaagaatgaaattgtaatattaaaactgaaatttacctccaagaccatcctcttgggagatcccccaagttcagcctcttcctctgacagttgagggcatggaggttcagataccggaaagggttggccaacctgatgattgaactaccaagatacctggctcccaaggtaggcttgttagaattcaggcttctgtattgcctaatggatgggtaatacatttggacaccctcccctccatcctagaaatagaaaaatcttctaatgcaatttgccttgtaaaatgtgcaggagtgtgcacacacacatacacatacacacrgagatgggaatagctatgttcaggtcctcatttccagaaaccagttcctacaatatagaaaagctttgccacaaagtctgaggaagccctttgtatttatagtctggtcattctagaggtgtgaacctagatttcctcagctggatgttaatagctgattaattcaggatgctgatttaatttgtgacctataaaacgctatttcacagagaatgggctgtgttggcatgtgcagagaccagctccccagatggaataatcttttccttattaatttgctgcatgttgcttctcatttctcacagtcgttccaaatgtgttacaaacgactacgtgctctgggtcctgaatccactactgctgttgctttgaaagaaaaaaaaattgttgactatgaagggcactgagctttcctggctcacatttgcatgctcactttcaaaccatcagtgcactcttctcttacaacactaagccttgctccacctgcgagcacccatcacttttgtgttgtttaggaaatgcaaacatagatagtttgatgttttcagggccaagcaaataggtagtgacatgattgggatcagatctacagtttcaaattcttgggttgtgctatcttcctattatctagaacatgtgaaaggctgtttaatccccttagtccaatgatcctcaaatttgagtgggcacagaatcacctagaggggttgttaaaactcagactgttgtactctacccccagagcttcttatttagtaagtctaggatgggaactgagagtctgcatttgtaaaaagttcccagagatgcagatgctggttgcagaacacactttgagatcattccatgagtctaactggaggagagtatgggtactgttatctccaagtaaacactgcttggtatctgttggagcaggtctctgctgggtaaggtttctattttatgtctttttcctctttccttcctgatatgcaccaaatcccagttgagcaactattttttaaatgttagggctcaatggagaatgcagcttcactaaataaatttaaatgtgtactgcagtacttgacatggattttttcaaattgtgagcacttaagccagacaaaaatatttcccctgggttcagccattctatgcagaccagcccctggtttctaaggaaccatttgaaatagagtacagtaccaaagtgcagagctgcagaagcatctttatgtcctttctaaatgtagaacatacacctcaagctcaggatttcaactaacactttttggtcatttacaggcttgagacaagtcctgtcattaactacaacattatgtgtgaggcttttttcaggacagataagcttatttttctaaaggaaaggacttttgtttttccagatataaaatagcagctcacacttaaatgcaaaggtcttgtttattgtttgtgtggtgaggtttaattggaaggcctgctttttacaattccatgctactgacattaccaagcacacaggattgttgttagaaaagcaaatgccaggctggggagctcctaatctggtggtctgtgccttgtaaataattagggtgtgggggtgaggtaaaggcctatggaaatcctacagagtgccacagaaatgggtcttctcaattatgataatgtgtaagatcacagtgctttttctgttaatatttaaacatagtcttcaagtaatttactgcaaataatcacatattaaaaagcaaggagtttgcttttttttccctacaaataattcaaatggtggccagaattgagagaatggatgatcatactcacaagattggggatagacatgcaggcagtgtgtttattagaaggaatgtccataaacatgggctggtttggagtggcttcacctactctagttgctaagtttagctattaggtggggagttcaccaaccaccagttagttcaatgtaaccaacaaaagtcagattcccaaccattacccccgcttgtcaccaaaccaagcagccaaccaacctttaaaaccacagtttaaaaacccacagctaaaaggatggcctatgttccataaaatactaattttgctggtcaacattctgaggttggatcaaatctgtgaatggctttttgcaagctaaatgcttcatcttcctaaatttatgtacacgtatattgtttcttatcccaattaacagtctttatttaacaatggcttatcaaaatatgcagccatttctactttaacttgtagaccaggcttgatgttagaacatgatggagacaagtatgttttacaataaccttaaaccttaacactattgggagtgctggctgaactgaggcaatgcctgaagccatttgttgcagttcaaaaagtgtttgacattttatccagatctagaagtcacttaaatgaatgaggaacaatttaacactgacccattctaagacttagttcagattctcatttcgaactgtcttattattcactgaattagtacagctcataaaaagatttcatagacacagctaatgaccacagaggcttatcagtatggtgaaaaacaacagatcaaagcaatgatctgagttatttcctggcatcttagtaattaaacaagtttaactgcttactcaatgaatgcagtacacattggttactcctattaactccaagtaggataatttagtagatgtctctattttgtttttttctccaacctcatcttctaatgaaaactttcagtcatgtttaccaaactcgtttaacttcaagtaatttggatgtcatgtttaatttttactttttttactcaaccatttaaaaaatattttagtcctctgactatgaaaattggtcaagcctgaagtttatcaaagttctaagtccatggctgggctgtcatgactggcagtcaagggcttctcttagagtacttttcaagttcactggacagattaggatagagtaattcatctcattcgatctgtttttccatatacacaacacaagtcaatgtttgttatgactttcctgatccttatttataagacaatacaagaggaaaccatgtgtgtatgtttagaaatagaaatgatacattgcacagatatagttcaccacgttatgggatgggttgtcagtgttcaaatggggaggctgaagagtaagaacagatgctttttttccttaatggcccyttctctgatttaaaatccttccatttatttccctaagatttagtgataactttaaacactttaactaaattacccagcggcttggcagccatcacggaggcaaatccttttagaaatcctagcaatctgttagattgtgggtactatgatataaaatctgtgtgctccacgtacaaaaattaaatcagtgctatggatacaaatacatactgcaaatggcaccacttccaaaccgaggatatgtgacctgtctccaaatattgaatttctttttttacttttttccccagtacttgactttctaaatttgggccaatttattctcattatccctaagtaaacctactttgattttttttaacagttattttatagtcaaatagagccagccagccagccgtgattcgtggatcctgatgttgctaggatacatggtttggtatctgatgaaagtatatcacttcaaaggggtaaaactttcaagtgtccgagaaaatgacactcccatcttccaccatggaagacagatccaatcctacaacttctcagaagctcacagactgcaggattggcctcccaggctttcaaataagtatcctctctggagggctgtttaattactaaaactagtcagattagtcttaaagcaaggaacacacgtatttataataaaacacgttttcatgtttgttttacagtaaagagaaaaaaacccagaacccccagattttatgtactttgaaaatatatttaaaaacattaaaaattctatatttaaaacatatattatatgttaattagtacacttaaatagaacttgtatttacaataggcttctgatgcggttaagttttaatgccaatttttttcaataacataattatataaatatactaaaatacaataaatattgttttttgttttacatggkgaataatatctttaccatagagagaacaaggccacagacatttacttacattttcaatgggaatcgccataaaaaagcaacaggcctgctgccatgcatgaaacacttctgccacaaagagaccacagcaagactttaaaaaacaaaacaaaacagaacaagaacgaacacaacagagagagattttaacaaaataaatcttaggtcaacataaaccatcaagcatgtgactgtgatgtatcttattgggtaaaagagccactgaccacacaattgctggatgtgtctcctatgaaaccacttaacagatctggcccttgcaatcctttaagtttgtgatggggggttgtttgttttaaatttgtccctcaaaaggaagctgcataaagttgacatayagcagatattccaagcattccttacatattaaaaataattacaaakataatattttcaaacaacacaaaacaaatctacactacgtaaagtcttccttctttcaaagaggtattcagatggtactgtgaaagactagctctaaatgaaagactgaacaaattgaaattctttgctgatggtatcttcattcctgggttatggtgaacatcctcttttgcttatccctcaccctactaagatgcagcaattgcttggggctttctgatacttaaggatgctggtccaagtggtgatcactaacattttcaggtgtgaaatgggctgaatgggcttagagctctagttttcactggggatccatttttccaagaaccactatttcaggctcccaacttgacttctcctaacccaaaatggcagaggtgaggcagggaccctctccatgaacagacaggatgggcagaaggttgctgtggccttcactggggagcaaaattttgtcagctctgtcctggcctcttccattgagcaaggcaccttcaagtcttggtgttctgaatgtccagacaccttcccgaagtcttgtctctggacaagatttcctatgggtccccttgatcattcggcctgagtttggggtttcttttcctgttcccttttcccttaccaaaagttctcaaaagataaaccctggtttcctcaagtctagtttcaaagcaataagtgttcaggtagcaaacatcttctatctcattgcatcaatctcatgatcacaaatgccacatttggctcccaacctgctccaggctaatccaattttatgcaaaattatccagaggtgggatggtgggcataagtcggcttgagtgtggtcctccagtcgagaacctcttgagcacagttagataatgtaggcacttaaagcacgaggtccaagcagcttgacacatgtcattccagagccacctctgaagggtccttcagaggccttcgttttggaatgtctcaaataccatgccccacctccacctagaccttgggatggccactcagaaattcctcccgcactgccggtaaatgcaatgccaactccacatagcctccatttggctgttcagtctcatgtcactggcaatgtggattcctgttctgatctaggtgtttctgggttgatacagggctctaccttttgcttacaagacattgttaagcctcaccatgagttttttttaagcttagccatgatttacccaaatgttcactcctcataaaaaataatcttcattttggggttattttttgttgttttctgttctaaaaaaaaatcactgttctccatgcttatacgagtgtcatgatgtgacacaaygtgttcacttgttcacagcagtggtaaaatatttcagaacgcgcaactgatttttcttccttaaaacaaaacaaagaggagaccagagggggagggggggaaagaatgtgttctgagcaaacataggtccttccgtcaaaagcagcttactctgaccaacgcccaaagaatgagcggggcctgggaggtgcatcacgggatgtggagtgtgagcatttttttgttcagttgccttaatttttattcactttctagtcatctgatcgatattgcaaacatcttcacaacatacaaatgtatcttttatcagccagaatatatattgtaggaattctttccccatctctactccctgtgggaactaaaaaacaaaacaaacraaygaaaaaaaaacacaaaacaaacaaaaatataccccccatcccccatcccctaagccagtaaagcaatgacaacagcaccttgacattgttttaattccaacgctatcagaagttaaaagcagtaaaacagatatagtactaacaagaacgaagatacttactgtctaaaatgtaaacggaatgttttggttcaaatttttgttgtgtgtgtgtgtgtktttttctgttttctgaaagaggacagtttattatcaattcacaattaaagcagcatgcaatktattattttttttaactttttatgttttcagttcttggcaacggcaacaaaccacaacattatcaaggaatgtaatgcagactttttaagttgtgcgcaaatgactgtttcccttctggtcatggacatgtccaataaatagattgtagaaccactgtactgtataaacttcatttatacatgcagttcataaaattatttttttcttaactgaataatttaccctgttatgtatatatacaaatagataatttttgtctcaatataatctaatctatacaacataaatccactatcttccccttttaatggtcaatgtacatacacaagaagtgtctatccttatgaatcgccagccaattctctttttgctatccatggtaagggcccgcacgtacgactgggtagttcggcactgggagttccaatgccttttgtctatgcccctgcagccttcttttgtgtaacccatgggattgcacttggtctcgtagaagtattgcttcagttggccttttgatacagggaccttttcaaggactgtgaccgtcccgcccgacatgtccactgcagtctttttgtctgcygccgttacccactcactaatactgtcacacacgctcagctcccctcggcgggcagggtcagagtggcgcvggaccvtcatggacatgtttgcagcatctaggtaatttttgtattcctccagcagaaagagaagaggaggctccaaaggcacttgactactgagcatcaccctggacgtgtacaagtctgcgtccttattgttttcttcattgggccgaactttntggtcctcatccaacagctcttctatcaygtgttcgaaagtgtcagccaatgatgtcaagcctcttgaacctgccttgggcccattcacgctctccagagtcccatgggtccgcacacctgggtaggccaagccaccttgtcctcggatgtttgcttctttcatgggggcagccttcatgcaaccaaagtatgaaataaccatagtaaggaaaaggatggtcatcactcttctcacctggtggaactgtagggagaaagcagaaacaagacagaaaactggttagggctttctttcaccgggatgccatgtggcccatctgattgtaattccaggccattctgcagggtcaaggtttttttatgtcttggtgataaactccagctgcaccagacacaaatcagtgtcagtagtgtgctgtatgtggtttaatataaaccagagacatgcagtgtttcccccaagatctagcatataaacctgagattagatggcttctaagcaagtgcaaaaattgtggcttcaagttctccttcttcccactttagcagctttgtaagtttaatttttaatgatctctgctcatgctgtcacgagaaacacaaaatcataaatgttactaagcaacaactgcaagtgtaattaatagtaatttttttcaagttagcaacatggtcctttgcaggaatgtgtgacaggaacagcagtggcctgaggggtctgatgggcctttctagctatgtgatgtctaggcatgaatagcacaataaaacagcagttggggaactataaggagcctttaaattgacttttttttycctcttcccacagagatactctattatagcaaagaagaawgataatttcattgagccatcctgttttacaggtaaggaaaccaaaggccatagaagacttgccttatgtcatgaagaaagtttatgttagaactcagggctcccaattccactgttctttattctacacctgggtggtcacaactgaaaatgttttgcttatttctaaacagaaatcattttttgacatgttcattttaatgatgtgtctatgcctggggctaatgtcatgaaaacaatgtgtctggtaaggagaaaactgaaaaagtcagcattaaaaagacatttaagtccatttcaaatgcctcccatatgcagactccactttatctcctccagttctctaaaacccttcactccttggctttttctggctaatacacacatctagctaagaaagctcaacttttctttttactagagatgtyctctbtgtgtgtgtgtgtgtgtgtktgygcgcgcgcgtgtgcgcgcgctctgagtttatcctacttttaaaaagctgagtggtgttttacacattttggaataggcagctagtgcttctttttctgcttttgaagtttcctgggaagtcccttaaaagcataccacaaaattaatctcttcctgtttgccagagggttgctctactctaaatttggctytacatctacaagcatgctctaggaagccaattaaaatggatgaacaagcaaaatgaaaacatacctatggaccaacccaaggttaccgtcaggtggtgaaggacttcagaatcacttacctgaagcattgtgtttctcagcagcaaagagtagcatccccagccctgaccctaattttattcctacttctcagttctgaggcatggacttacaaaaagacacatacatgcaatggccatcatgatatccaaataagtaggaaaaggaactgtgtttctgcccatgaagttttactgaattcaaaggcaacctacctccagtcaataggtcagaatgcagaaatggctgaaaactctggtattgaaaagcaaatgttctccacttttgtaagaaataacattttcaaccactaagagactttattaccatccctaaacacacaaaaaaatttcttttagatttactctcactttgcacgaatagcaaacatgcttagaactgcttagattgcacaatgttctcagattaggaagggaaaattggtttgaataaaatacagatgtctattccgctaacaactaaatctttgtgaatgttctgagtcctgtaccatcaaagaaatagatcgtccatgggggtttctatttctggtagattgtacttacacactgaatgaaaaagctttctcctaatattcccagtccaaataaaaacaacccaaggggcacctcttatttaggtcaataaaagtttgcaaatgtggaatactttagccatctacatcacactggtagagactttctgtgatcagctattttttaataccatatttaatcaaatctaagataccatcattgtgaaactcgacattttatatatcactaagaaagcaaaaatgcagcctgggtgaccagagtgaaactccatctcaaaaaaaaaaaaaaaagaattaatgaactatagtttaatacatatttactaagtgcccacactaactacttaaaaatggtccaaaatactgaggcatcttaagctgttggaaaattgttttgttttcaccactacagtaatgagtctttgaatgataccattttctatacttggcttctagtttactctgcctttcactgatcttatctttttattaataactttatgagaaaaataattaatgctttatatattgttctctcagttccatgagcaaatatttcagagggaaaattggcatctgagtaaatattacttggctttcattctgaagcccaaacatgggtattcctcaagctgagcatctgcatagaattaggaattaacacaatggtgacaaagtccaaccccacattgcaagccctgctctctgagtggcacttctgcaattctaactaactgtctactcacttgtaaggccttgaagttaagtgggtgcaacaccaaactcaatactttttgttggaacagtggtatctcctaccttttctaacaatggttccctgatattttgggcaacccaggcataggatagaaatcctggaatcaagtttgacaatatatttcctgcatagccttccaatccagtcagtaaagatgtcctgttaatttttcctttaaaatatttgtcctggccatccctttttatccatcccactgccaccatcttggctcagccctcaccacctcattttgtgaccacaacgtcccgatgctgtatcagacactctttctgctccattcaactctgatgaccacttcctgggtaaccaccctaatactattctcttacacaaaaactggcaatggcatttttgttctatctgctcaaatctaatgtcttctctctgatactcaactctctccaacatctgccctcacccttcttagctaactttctcaaactactcaatgcttcatcacttctgctccgatcaggacagagtccttggagtgccgtacacattactgcctcctgacttgttccattcctctgacaaactcctctctccctctcacttgctgccaaaatcttgcttatccttcatgatccagttcaagcatcaaatcatgcatgcccctttctctaattactccagcatacactgccttccttccctaaaattccacattacatcttacgtagtacttgattcccttctcacttgttttgttttgtttttttcccaagacagagtcttgctctgtcgcccaggctggagtgcaatggtgcaatctyggctcactgcaatctccacctcctgggttcaagcaattctcctgcctcagcaggaggtagctgggattacaggcgcccaccaccatgcccggctaatttttgtatttttagtagagacakggtttcaccatgttggccgagctggcctactcacttgttaattgttaaccgtatttgctcattctagtcagtcttcagctgaaaggtaagttctttgagggaatggatcatgtctgagcccccataatgcttaacagagaaaaatgtaatagcagtactcagtaaaaacttactgataggtttattaaactaagagaaaagacagtttggatataattttcgtaagaagccttttcatttggaaagatcagtgaacccattgaaattctcaggtaaatataggctgtgctaaccccaaattataaactctaaggcagtggtcccaacctttttggcagcaggaaccagttttgtggaagacaatttttccacggtctgggagtagcagggtggatggttttgggatgaaatggttccaccttagatcatcagttaaattatcataaggaattggattctcataaggagcacacaacctagatcccttgcatgtgcagttcacaacagggctcatgcttctatgagaatctaatgctgctgctgatctgaaaggagacagagctcagatggcaatgtttgctcacccgccgctcacttcctactgtgcagcctggttcctaacaggccagggactggtaacaatccatggcctgggtgttgcggatccctgctctaaggaatttgacagatagcaattatcagccatgaccaacttcttgagttcctctaatggaataaaaccttacttgaataattaaaaagcagataacactaccacrtactaactgtcctacaatttcctgtgtagctctatttctaacagatcaataagagacttgggaagtaataacaataataatagcaaaatttgtagttttcagccttttaacttcttgtttcttattctgctaagctttcaatgagtaattttatatactgtattaggaaataataaaagattaagtaagagcttccaggacaattcttcattttcaaccttcggatgactctttatcacacataagataaagaggctgtgtaatattgctaagcagattatatatttatttatacttaataaattcattgatgctgtctaattctgctttaaggcttacagccattaattcaaccacatctataaaatgctaggaaggctttcatagccccactgtcaggaaattcaatatagtacatagaactaaaaagaaaatcaatgaagtagatatcaagtttagctttaagtgtgactcacaagtcttagacatttcactgaaagaatgtccataacaacatgctcttttactcttgctgtagtcataacttacatttgtctaagagactatagaacattcacaggcgtcatctaatttgatttttacaaggagacaggatgggtattattatccccattatatagatgaggcaattatgcgtcagagaggttaggtaacctgtcaaatgccataaagctagtaggtcacctgtctcctgaaccaagcttttaccatcaggatgtgttgccagttttagaatatcagccacagagaagagagtggctgtgacaacgaaggagcttacaaaatgtggacactgcagctatgtgtgtcctggaacctaactttctaaaaggagtgccattaagatactactttgtaggtctagattaatcatgaccaagatccttcaactttaaggcttgattacttaaatggatgaaatttcagacaatgtggtctttttctaagagaaagaactgcaaaaattgtagcatgttagaactaagtttctatggccaaaggtgggaaaacaagcaacagtacagataattcaggcatacagaaaaaaaaaaaagtcttgtttgttcccagcccctttgggttttacctgtgagcgtgtaatcagagaaaacacagtttaaagatatggctgctcattttagacagtcctataaagataatggtaatgctgaagaagttattaatatttggttcctaacatatatgatacaaactattaagagttgaccttaatgaaatcttgcaaatcaatatttaaaaatttttaatttgcatccagttgactatatccatatgttagacttccttttgttcattcattcatcacacatgaagtctactttccagtcttacttacctccctccctaggagggaggtaggacatacgtaactagaatataaaggtagaaatgacccagaaaaggtacagatacaattttataaagagaaagaagttacttccagttagggaataaaggaatgcattgtcaagaaggttgcaaagggccaggtgcagtggctcacatttgtaatcccaacactttgggaggccgaggcgggaggatcactagagcccaggaattcgagatcaacctgggcaacacagtgagaccatgtctctacaaaaacttaaaaattaaaaaaattaggtgtggttgtgcacacctgtagtttcagctacttgggaggctgaggtgggaggattacttgagtctaagaagttgaggctacagtgagcgattgatcatgccactgaactccagcctgggtgacagagacactattgccctaggaaagcaactgttttgctgtaatcaatgaaggctcccgatagccagagccacccagaattcacagtcacatcgaaccttgccctcatcctctgcctccttgtcacagagcaacactgccccagtagcacacatctccagtctgtaacaaagaagtcttagcatcaagcatactcaagccacttggatagcaaatgaggtcatctgaaaatacttttaaagtttacttttttaaaaaacagttttttgtttacaggacccaaatggcagttgacattccctgtaaaagtttaacctcttcaattagaattctgttttctttagaatttcaggtgggatctgttacaattcactgaagtttagatttgacaatgttctatctactatgttattgaaaccatataatatttaccaaattcccatacatggtagacagtgacattaattaagaagataatttccaatttgttccatgaagtttcagtgacccactctgtaataaagaacttggaaagggaggttccaagatggccaaatakgaacagctccagtctacagcccccagcgtgagtgaygcagaagacgggtgatttctgcatttccaactgaggtaccgggttcatctcactggggcttgtcagacagtgggtacaacccacggagcatgagccaaagcagggtggggcatcacctcacccaggaagcacaaggggttggggaattccctttcctagccaagggaagccatgactgacggtacctggaaaatcaggacactccccaccctaatactgtgcttttccaatggtcttagcaaacggcacaccaggagattatgtcccaggcytggctcggagggtcccatgcccacggagcctggctcactgctagcacagcagtctgagatcgaactgcaaagcagcagcgaggctgggggaggggtgtccaccattgctgagacttgagtaggtaaacaaagcagccaggaagctcgaaatgggtggagcccaccgcagctcaaggaggcctgcctgcctctgtagactccacctctaggggcagggcacagctgaacaaaagacagcagaaacttctgcagacttaaatgtccctgtctgacagctttgaaaagagtaggggtcctcccagcatggaatatgatatctgagaatggacagtctgcctcttcaagtgggttcctgacccctgagtagcctaactgggaggcacctcccagtaggggccgactgacacctcatacggccaggtgcccctctgagacgaagcttccagaggaacaatcagggagcaacatttgccgttctgcaatatttgctgttctgcagcctctgctggtgatacccaagcaaacagggtctggagtggacctccagcaaactccaacagacctgcagctgagggtcctgactgttagaaggaaaactaacaaagagaaagaacatccacaccaaaaccccatctgtacgtcaccatcatcaaagaccaaaggtagataaaaccaataagatggggagaaaccagagcagagaagctgaaaattctaaaaatcagagcacgtcttctcctccaaaggaatgcagctcctcgccagcaatggaacaaagctggacagagaatgactttcacaagttgagagaagaaggcttcagatgatcagtaataacaaactcctccgagctaaaggaggatgtttgaaccttttagcaaagaagctaaaaaccttgaaaaaacattagacgaatggctaactagaaaaaacagcatagagaagaccttaaatgacctgatggagctgaaaaccatggcacgagaactatgtgacacatgcacaagcttcagtagctgattcaatcaagtggaagaaagggattgaagatcaaatgaatgaaatgaagcaagaagagaagtttagagaaaaaagagtaaaaagaaatgtacaaagcctccaagaaatatgggactatgtgaaaagaccaaatctacatctgattggtgtacctgaaagtgatggggagaatggaaccaagttggaaaacgctctgcaggatattatccaggagaacttccccaatctagtgaggcaggccagcattcaaattcaggaaatacagagaatgcygcaaagatactcctcaagaagagtaactcaaagacacataattgtcagattcaccaaagttgaaatgaaggaaaaaacattaagtgcagcgagagagaaagggcaggttacccacaaagggaagtccatcagactaacagcatctttcggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccttacaagagctcctgaaggaagcactaaacatggaaaggaacaaccagtaccagccactgcaaaaacatgccaaattgtaaagatcattgaggctaggaagaaactgcatcaactaacgagcaaaataaccagctaacatcataatgacaggatcaaattcacacataacaatattaaccttaaatgtaaatgggctaaatgctccagttaaaagacatggactggcaaattggataaagagtcaagacccatcagtgtgctgtattcagcagacccatctcatgtgcagagacgcacataggctcaaaataaagggatggaggaagatctaccaaggaaatggaaagcaaaaaaaagcaggagttgcaatcctagtctctgataaaacagactttaaaccaacaaagatcaaaagagacaaagaaggccattacataatgataaagggatcaattcaacaagaagagctaactatcctaaaaatatatgcacctaatacaggagcaccagattcacaaagcaagtccttagagacctacaaagagacttagactcccacacaataataatgggagactttatcaccccacggtcaatattagacagatcaacaagacagaaaattaacaaagatatccagaaattgaactcagctctgcaccaagcggacctaatagacatctacagaactctccactccaaatcaacagaatatacattcttctcggcaccacatcacacttattccaaaaattgactacatagttggaagtaaagcactcctcagcaaatgtaaaagaacagaaattataacaaactgcctctcagactacagtgctttcaaactagaactcaggattaagaaactcactcagaaccactcaactacatggaaactgagcaacctgctcctgagtgactactgggtacttaacgaagtgaaggcagaaataaagatgttctttgaaaccaatgagaacaaagacacaacataccagaatctctgggacacatttaaagcagtgtgtagagggaaatttatagcactaaatgcccacaagagaaagcaggaaagatctaaaattgacaccctaacatcacaatttagagaagcaagagcaaacacattcaaaagctagcagaagacaagaaataactaagatcagagtagaactgaaggagatagagacagaaaaactccttcaaaaaatcaatgaacccaggagctggttttttaaaaagatcaacaaaattgatagatcactagcaagactaataaagaagaaaagagaaaagaatcaaatagatgcaataaaaggtgataaaggggatatcaccaccaatcccacagaaatacaaactaccatcagagaacactataaacacttctatgcaaataaactagaaaacctaaaagaaatttataaattcctggacacacacaccctcccaggactaaaccaggaagaagttgaatctcttaatagaccaataacaggctctgaaattgaggcaataattaatagcctaccaaccaaaaaaatccatcaggaccagatggattcacagctgaattctaccagaggtataaggaggagctggtacyattctgaaactattctaatcaatagaaaaagagggaatcctccctaactcattttatgaggccagcatcatcctgataccacagcctgacagagacacaacaaaaaaagagaatttcaggccaatatccctgatgaagatcgatggaaaaatcctcagtaaaatactggcaaaccgaatccagcagaacatcaaaaagcttatccaccatgatcaagttggcttcatccctgggatgcaaggctggttcaacatatgcaaatcaataaatataatccatcatataaacagaatcaaagacaaaaaccatgattatctcaatagatgcagaaaaggcctttgacaaaattcaacagcctttgtgctaaaaactctaaataaactaggtattgatgggacatatctcaaaataataagagctattcacgacaaacccacagccaatgtcatactgaatgggcaaaagctggaagcattccctttgaaaactggcacaaaacaaggatgtcctctgtcaccactcctattcaacatagtattggacgttctagccagggcaatcaggcaatagaaagaaataaaggatattcaaataggaagagaggaagtcaaattgtctctgtttgcagatgacatgattgtatatttagaaaaccccatcatctcagcccaaaatctccttaagcygataagcaacttcagcaaagtctcaggatacaaaatcaatgtgcaaaaatcacaagcattcctatacaccaataacagacaaacagagagccaaatcatgagtgaactcccattcacaattgtttcaaagagaataaaatacttaggaatccaacttacaagggatgtggaagacctcttcaaggagaactacaaaccactgctcaaggaaataaaagaggacgcaaacaaatggaagaacattccattctcatgggtaggaagaatcaatatcatgaaaatggccatactacccaaggtaatttatagattcaatgccatccccatcaagctaccaatgactttctccacagaattggaaaaaaactactttaaagttcatatggaaccaaaaaagagcccgcatcgccaagacaatcctaaaccaaaagaacaaagctggaggcatcacgctacctgacttcaaactatattacaaggctacagtaaccaaaacagcatggtactggtaccaaaacagagatatagaccaatggaacagaacagagccctcagaaacaataccacacatctacaaccatctgatctttgacaaacctgacaaaaacaagaaatggggaaaggattctctatttaataaatggtgctgggaaaactggctagccatatgtagaaagctgaaactggatcccttctttacaccttatacaaaaattaattcaagatgaattaaagacttacacgttagacctaaaaccataaaaaccctagaagaaaacctaggcaataccattcaggacataggcatggacaaggacttcatgactaaaacaccaaaagcaatggcaacaaaagccaaaattgacaaatgggatctaattaaactaaagagcttctgcacagcaaaagaaactaccatcagagtgaataggaaacctacggaatgggagaaaatttttacaatctacccatctgacaaagggctaatatccagaatctaaaagaacttaaacaaatttacaagaaaaaatcaaatgaccccatcaaaaagtgggtgaaggatatgaacagacacttctcaaaagaagacatttatgtagccaaaagacacatgaaaaaatgctcatcatcactggccatcagagaaatgcaaatcaaaaccacaatgagataccatctcacaccagttagaatggcgatcattaaagtccggaaacaacaggtgctggaaaggatgtagagaaataggaacacttttacactgttgatgggactgtaaactagttcaaacattgtggaagacagtgtggcgattcctctaggatctagaactagaaataccatttgagccagccatcccattactgggtatatacccagaggattataaatcatgctactataaagacacatgcacacgtatgtttattgcggcactatttacaatagcaaatacttggagccaaccaaatgtccatcagtgagcaaggacatcattctgagcaaactatcgcaaggacagaaaaccaaacaccgcatgttctcactcataggtgggaactgaacaatgagaacacttggacacagggtggggaacatcacacactgggacctgtcatggagtaggggtaggggggagggatagcattaggagatatacctaatgtaaatgacgagttaatgggtgcagcacaccaacatggcacatgtatacatatgtaacaaacctgcaggttgtgcacatgtaccctagaacttaaagtataattaaaaaaaaaaagaacctggagaaattatcaagtaagcatcatatttaatgaatttatggtgaaatcatgtgggaaaaatttttctgtacagggatgatgactctggaaatggtggagagagagacagaaaaacaaatgtcactgtaacacaggtatttaaattgtatttaaatacacagacttttgaatttatagaaaattttcaagtatgaaattgatttcatgcaacctaaagtctcaaacttcaaataattttttgtgttaaatttataaattgtgtattaatgcaattcaaatttattcctaaaaatattttaactaaaggagaaattcctggggcctgagattagagttttaggaaatgtacatatgggataaacttacacaggctgaaattaagtgaaaccttacttctcaatgttgagatggattagccattttaacataaagtagaaacttctaagaaatgcagaatctcaacttccccaccctcattccacctaccccacccactcaatcagatcctgcatttcaataagatttatttagtgcaataacttttttacttatcaaagttgagaagcacaggactaaatgataaagagaaaagaggctgcttaggataaggaaataaaaggttgaagttaacttaagtattatgatactttcttagcgtgtcatacggttacctgtcatctttcctctttggttcaacttgttttatggggacatttatgtgggaaaatatctttgcttttgtaatttatgtgggaaaatatctttgcttttgtgtttttacttaagtaaaatctgggctccttttatgtcaactagcttttccactattgttattatgatagaaagtacaggctacttataaacatgattagttcaatgagaacttttagaatattgctgacctaaatctggacatctacacaatcattaattcttaccaaaatgctacaaggcaatataagcataattagcctccctgatccctgaacatagcctaatatcactcactcaatcagaatcatactggaaacgatatgaccaactatggcaggtagtagatgtccagtcacactagtattgctttcagccagatgtctctggtccttgtgagttcctttsgtccttaatggtgaaatagcaacagagggaaccaactcactcactcaaggcagatttcttatttctagacttgtcctgaaaccaacagatccagctctctcctaccaaataccatgaaatttaaacaaacgaaactcgcaaaataatacagcagcagcagcaacaacaacaatgaaatattaaaatagtaaatataagtatcaaacatcaaaaccccctctccaaccaaaatctctcttcttcgataaasttcccaggaggtaacccaatttctaggttggtgtccaatatttgggatcatttgattcaagactgaagtacttaaaatggcttttaaaaaaggaaaaaaggttagatttccagagaaaagtgtaacattttttaagttgaacattatgagggatttgatgggggcagctttgcaagtagaactggagactggtccactgttcaggctttttacgaaagactgcaaaggttgtttgtttccaaacaccaagaagtcaccaagttcaccagtccaaatgcaaatgactcacactaggaaccctaatagtgctgctgttaagtcatttgcaaatgggtggggctgagatgacacagaaccctattttcccaggtggcatcttaagtatggttgattctaccttcagccccacatttaaaagtacagtgtaaacacagctaagggaccgcctccttcaaattacacacaaggcacacctactaataggagatgttgtgaaagccaggtggggctttgtctttcaagtccctgcatccaagaataagcatgctgtgtacaaaaaaaaaaaaaaaagcaagggtgatgcaactgcattcattgtccctaaagggagaacatgcaataattctcagatccaaggataaagggaatccccctttaagaaaagatgttggcattatgtggggattgggaacatgccagaacaatcacacatttttacaaaagagagaaagagaaaaaaagttaagacccatttgtcttatttcagtctctttcttcagaattgacgactttaatcaacaggtcactttcagagtattgctggacaccttgactttctgccatgaaatgctatgggaattctggcagttgagagccaacaccccactagacaccagtgctgcataaccacacttttaatagaccccagagctgtggtgacagcatgcccttcccagtttttccacagacggtgctcctgaaattttccatagacagtgtattcttgtggttaattagttatctgagcaatttccattatagaaagagtatctgtacataattaaacccatcttaggaccaaactgccgggcttcaatgtcattaattcagaagggctaaaatgaaaatgagatgaataattctcacctgatgaagggaccgcactagattagatcctatcctctgaaatacatagagcattaaatttaaaaaaacaagagaggtgaaaacaggtgatggaagaaactggaaaggtaagttgcctctagagaccaaagaataacactccttttcaaactattatcaagaaatcttgggggaaagataaaattagcaagagaaggctattagctctctgttactcacctttatgaaaccattttcagggatcagtttgttaaattccactgaaacgtggaggtacacagcacagcccttcttctgggatgcacagtcatgccatacagaagcgtgtgggtagacgccaaaacatgtgtggacctgcaaccctttctgtagaaactcagcattctgagtagtaacaaggattaaccttgtgcactcatggagaaaactggtggctccacacatccagttgtccttcgggttatttttgcatcccactctataatttcttttaattacttaactgtaaagcacaggaaagtgmtcattacttgtagcttaatgcaggaggaaatataattgaatatgttctcctagccactgctctaccccagctcccagctcttctgaagtgtcacggttcatttcaacagcacgagtaaggcagtttccaggccctgtgcataatgagccatgtggaccctattcaagaaactggctgtactccagaactactataaaatataaggaaaatattaacatcttagatgacaaaagatccatatggctggccagaaaatatctgcatcatttaagccattagaatgcacctatatggaaacattcaatttggcggtactgtgaacaacaggactgtgaaaacatctgtttatctccacccgttttcactaaacactgattcctatagaagacatgcaaactcaaataccaacatatttcatctaagcataggacagggactccatttttacatagttgctataataaatacaatacagtatttgttggtgataggattttggaagatgctctggatagctggaaaaataagtaaaatgtttctctttgtattaaacttgataaaaaataatagctaacatttattaatggtgaggtaaataatttgattatccaccatttatagctgaggaaactgaggcccagagagtttcggtggattccctaagatcacatacccattatgtggtggagagggaatatgaaccagtgctggcttgctatgcctctttccatatggggtcagacatagatgtggtgtcttataatgtgagggaggtctacttggcagaaatatcctgcagaccctatatgccagtttcttatttatttaaacaaagccccatatgagcatttctgataagcagtttgtttacacactaattccacagaggttaaatataaccctaatgtttctttgttgctactctgtttccagtattgaattattaccacaaggtaccaaccatatatgcatacttaatagggtattttgtcaaaactatgcatgaaggtcatttgtttgagatgtcagaacattttcccgtgagaagatctcattgggcattgaaacagaaccacatgctcttcagaccagcaaccgcgactaccaaatactcctctgtcaactctacttgagtaagaacgctttcaattaaggcctaagtgtcaacatgcctttaaaaaaaatcgtggtgacacaaaatctttctttttagcacccaacagaatcccttcaaagcctcgtggtctgacaccctatgctacgtgacttgtgacccatccatttgtcatgttcttcgggaatgtggctaaggggctaagatgtgacttgaaaagaaaggtagaacaagatcatctcaaatttattatcaaggaatagttcagaaaacgacttcagaccacagagacagcagaacagatggtccggcatggatagagcatcagacactcacagactgtgccaacaagagccatcgagtcaaaacagccaaaggaaggagggtcatggaatgggttctctcacaccaaactgatgcccagaggccctcagcatgaataacaaaggcaaccagacccacaagccatactgagtggatacaaaacctatacctaggctgacatcccaaatgtgtgtggcaagttagatgatgatggcacaaaagacagaacaccttgcttctggccattgtcagctcttggaagagagcacacttttagaggagcagctgcaaggagcctgagaacaaaactggaaatgtctgttatgaaagccttcacaggtattattaacaaaagaaaatgtctatttgtcaatggtgtttcagctagattttggcagtccattcttatgcccaggaatgacctcttgtgtagactggatacagtcatcaatgcaactgtccaggtgcaactcttctataaaggggaagaggagtgactttcccctatacagtggccctgtcaaaattctataaaaaatattgtccatttaaattaaataaccactgtgcccggctccatttaccacacttttctatgcagtggaactgaaggggatttttttttttgctgtcctcagagaaaaataagactaagaatcaacctttctaatgagaatggtaaggagttatgtggggatgacctggaatatatgctgctcaaatggtggagatgttatctaggccgtaaatcatggcatttttatatgatcccctatttgcctaatgcaggaaaccacttggcaactttaaggaaaaagtctagcaataatgcatcatagttcaatgtttatattgtacttggacagtttaaatttatcttataaagtactaattatttaattacaaatgttgagtaagtgtaaaatcattcctcaaaaaagcatcccttgagtatgaaagttccaagcttagcaagacatccctgtgatttgggatacatctcttgaactcagtcctgaaaataatgttaatagctgagaaaagagcattgaaagccttatacacagtgtgttgtagtgaaacaattttctttttggttctaaaaaacactgttgtgctctttagatccagcatggctagttagatgaataatgaatgcatgttcaactttctgctacaggaaattctgcaagtggcaacgtgggtccattccgtgtgtgtcactagagctggcgcaagcccatggccatggtgaggcagcgtttccactggaactaatctgatacctgcaccagctcttgcaactgtgcagtgttcccactgcaaactacggatggggtaaaagactgctcacctcctatttctcatctaatctcacacactctgtttgatgaggctatggagaaacaggtcttctcatacactaaaggtgggagtacaaacaattcaagccctgtgcaggacaattaggcaatacctatcaaaattatacatgatttttcctgctgacccagcaattccacttctgggaataattgacagatataggtgcatatgtacaaaatgatggaaagctctctggtatatattagtaagtgataaaacaaggtgtaaaatagtgtatatatggctactaccttttgttttaaaaatgggggaaaatggtggagcttgcggtgagccgagatcgtgccactgcactccagcctgggcgacagagcgagactccgtctcaaaaaaaaaacagggtggggtgggggggaaataatagtacatactcatatttacctgtatctatataaaacacactatcaaggattcacaagaaactaatacaaatgatcaccttatagatggtatgtattgggggatactgaggtgagcagggtataagtggggcaagacttttcagtgtaaacttcttttaaattttattttgatttttgaataatgtaaattaactgtcaaataattaaattaaaaataaccaatttattaacaaaacatttaatctagtggctttacttttgacacaagacaatctccaaatctccaccaatcaccaaaaacagagatttacaccagttcctttgcttgtttttcctggtaatgactacaattaagaagtcctgtgggtgccatctcagttttggagatatttccctagaagaaactgattcaaggtgggacaattgggtatagagaatagtccctgggaccgggggctgaagtcctgaattctggtcctgcctaactcccactttctattaagctgaccctgtgaaacggctgatacatgaccattttttaccaacaaattagacaaattcatgggtgatcaaattcaaaaaccctgttgccttaccactgtaatatgatgaggacacgtatacacaccctgcctaactcacagcatcacaccagggattgtcaacatatgggaaagagctttgtacattgtaaaggtcaaccctacaaacagcagctgtgaaacacaacacaaccctgagggggtggccatggccaaacataggaggggaaaaggacccaktctcaaaagcatctgagatactgagatagtgcagaggaatgaaatcttccaaaagatggaatctaaacataaacagacatcaagagcgggctgacttgcagtggaagatgtggttaaatgactccacatgtggtcatctgccattgcatacactgcaaattctgtgaagcctactaagggaaattagggagatgtaactgggagcgcactgtaaagatactgataygaacacgaatgtgagatcaatgttgaatgatggacccaaaaggatggctcttagtccttgtgaacatatagttgttggagacatgtgtctgtcatacacagataggcctccaactcacctctgaaatcagatgcaaacttcaaatacttttgaaaagtctccctagaggaccttttacccccaaatgtagasactaaatgaaaaaccattctttaaaaggggttaaaaaaaacactcaaaaaacttctcctttccacatgtatagtcatctggaaaacagatctcccattaaacggatggtcaaagctgtatcacaacattaaactaagcacaaaaattcaagacttcccttcctcaccctcctaaaacgaaacattccaataggctagaaataacctcatgaggaagttcattgaaggtactcccacttggcactactatccagacactgggttaggaaactagttacttggaactcagaaaaaataagaactattttgattaggcaaggcccctgtgcaaggtgcctagttccagctgggtctcagtagtctgatgggtgtcatgcactcctggacctcctcttaatgaaacaagggaccttgactttgggccccatgttgagaagctctgaagccaaatataatggtcaaatataatgtcctctcayttctagcttcatagcagaccatgtttccatatagaaatttctctaggaggcttactatcctatgttatctcaagccgaggcctcctcttacacaagaggcttaaactgcccgtaagtaagaattaaagatatgttacattttttatgaattagtcatttattcattcagcaaaggttattaagaaggtactgagtttggatgtactttgctttaggaaaatcattttcaaggttgcttcatgcaaagtgggaataattaacttggtaactcaatagacttgctaagtgattgccccaagtttaaactgtcactgatttgcaagtatgacatgaaaaccagagacccaaggaggtgggcacattcccacctgtcaatagccctcaagagaagtgcttcagtattaccccaaatggccaactttgcatggttaatcatttagttagaggctcacaagatcaaaaacaattcttaaaaaactatttatgtgaacaaagggacaatgagctgacaccttcaaggtgcacgtcaggggcacaatacaagttcctgtttcaccagcagagctctggtcgctcagttgaagctgaaagtcagaaccagctgtgtttctgtcattccctcatatgaaaagaactcagctgtagacctttactccatgagaaaacattttttaaaaacccacaaataatttttaggtttcatttttgcctctgctttctccagarctacaaaggtcacccaaatttctgtggcgaggttatttaggagagcctttcttttggatgtcaacttgtcaaacttgcagtttagatgagtgtgatgtagtctcctaaaatttacttttgcactattttttcaaataatagatattctctgagcacaggcactgaggacatcaaaatgaatgagactgaatttctgcccttggggactgcagtgttaagggtgggttagacccaaaaaccaacaatacagtgcaatgtggtacatgctgtaactaacatgcacaaagggcattcccaaaaaagagaatgaaaagagggaggaaggtggcaaaggagaaaggcctttggcccaagtttttgttcaataaagatcatattttgtagatcaaaagattatatgatctgctaaccccttagcatgtatagctcatgaagcaagacaaagtacccatgaagagttcaacattagcgagcctctggggcaagtaagttggaaatcataacccatttatggatacctgcctagaactgatttcctattcagagtgccttcctagctgataagaacaatactgaaatctttcttttccatgagggaaaaacatgttgaatcatttagcaagtacctacagagccacctactatgtatgtgcccagcagtctactgtgtgctatcaggagtaagaaaatgtagaaatattcttgcttttaaagggtttacaatctaattgtagaaataatactaaaatacatgagaggaaagaaaagcaaacttagcttctctgggataaggactatatctcatgcaacttttaaaaagttaccatttattcaacttcctaccaccattacatacttctggtaatcaattatcttccttctccccttgggattttgaattgggaacagaatagaaataagttgccaaataagaatcaaaatacagggtcagcctcaatttcagtgcaagtggtccattgctttggttcacaggctctacagtccagaagatgaaagattaaggatttcatccatcagattaacctctcctcttttcacagaaagaacaagtaatggggataagagaagggcctagaatattcccctgaaagtgttacttattaggaagcaagttcccttgtggaaacacaaggatgggggaaagggatttccctcaacattgttctatctacacacagagaattcaagtaacttgcccaaaatcacagagctagtaagtggtgaggcttaaatcaaacttgatcatcaggtccaggaacacaggtacaggctggggctgcctcatgaagtgtctgtttaggaaatgtgtctttaaagtcaacagactgtcctgagtaggacattctagaacatttttctagacaaaaacatcrtatctacaacttccagcctagaatctgatacagcaaagacacacaataatgttttgttatataagtgcatatacaattaattaccaaattatgaggtacagaccacctaggaactcagatagggcaggtttattattatgggcaagagtctttctagaaacaggattccagctaggtcttgaagaatgagtagaattcagatgaataaacagcagaaaaaatcattaataaacacatgagactcagagaattacaacaaaacagttttagtcwtgtaaactttgctataaagtgaagcatatttaggtatgaagcatgctgattaaactttttattgtcttaatacaagtctaaaaaaagtatctttttgggggagctggaaagtactaaaaataaaaacagtggctgaaattcattaagcatttactatgccaagcactgctctaagcacttcacagacactaacacatttaatccctaccaataccctgttgagaggttgagatacagagaatttaaattactgacccaaggtcatagacctagtaagtgttaggcctggagwcaaactcgatcctcctctggctcaggaatattgttccaggcctttgctctcacctggaagtttctaattagaaaatttatttcaagtcagaataaaatcttcagcagttctctcatctcaaaatgtctgaatttctgattatttacaaggctgcaaatcccttctagccacgctctaatgcaagtacttggatagtgaaataaacgataagtctctctaaatcacaggatattcagtttatttgattttagttcagcgattcttaaactgtcccatacatccaaaccatctgtagaagtttctaaacccaacataggcccagggacccaataccaaacttacaaatcttggagactaagatctcatatgtatatatattttaaagattcaagggtaattctgatgctgaatgtgtttgagaatcactgctgtatgctgcattctattttattgtatttcttttattattattattattawaataataataatacttttaagttctggggtacatgtgcagaacgtgcaggtttgttacctaggtatacagatgccatggtggtttgctgcactcatcaacttgtcatctacattaggtatttctcctaatgctatccctcccctagcctcctacaccctgacaggccccagtgtgtgatgttctcctcccagtgtccatgtgttctcactgttcaactcccacttatgagtgagaacatgtggtgtttggttttctgttcctgtgttaccttgccaagaatgatggtttccagcttcatccatgtccctgcaaaggacatgaactcatccttttttatggctgcatagtattccatggtgtatgtgtgtcacattttctttatccagtctatcattgatgggcattcggattggttccaagtctttgctattgtgaatagtgccacaataaacatacatgtgcatgtgtctttatagtagcatgatttataatcctttgagtatatacccagtaatgggatggctgggtcaaaagatatttctggttctagatccttgaggaatcaccacactgtcttccacaatggttgaactaatttacactcccaccaacagtgtaaaagtgttcctatttctctacatcctctcctgcatctgttgtttcctgactttttaatgatcgccattctaactggcataagatggtatctcactgtggttttgatttgcatttctctaatgaccagtgatgatgagcttttcttcgtatgtttgttggcagcataaatttcttcttttgagaagcatctgttcatacccttcgcccactttttgatggggttgttttttttcttgtaaacttgtttaggttccttgtagattctggatattagccttttgtcagatggatacgttgcaaaaaatttcacccattctgtcggttgcctgttcactctgatgttagtttcttttgctgtgcagaagctctttagtttaattagatcccatttgtcaattttggcttttgttgccattgcttttggtattttagtcatgaagtctttgccatgcctatgtcctgaatggtattgcctaggttttcttctagggtttttatggttttatgttttatgtttaagtctttaatccatcttgagttaatttttgtataacgtgtaaggaaggggtccagtttcagttttctgcaaatggctagccagttttcccgacaccatttattaaatagggaatcctttctgcattgcttgtttttgtcatgtttgtcaaagatcagatggttgtagatgtgtggcgttatttctgaggcctctgttctgttccattggtctatctatctgtttatgtaccagtaccatgatgttttggttactgtagccttgtagtatagtttgaagtcaggtagcatgatgcctccagcttgttcattttgcttaggattgtcttggctatacgggctgttttttggttccatatgaaatttaaagtagttttttctaattctatgaagaaagtcaatggtagcttgatggggatagcattggatctataaattactttgggcagtatggccattttcaygatattgattcttcctatccatgagaatggaatgttcttccatttgtttgtgtccyctcttatttcattgagcagtggtttgtagttctctttaaagaggtccttcacatcccttgtaagttgtattcctaggcattttattctctttgtagcaattgtgaatgggagttcactcatgacttggctgtttgtcattattggtgtataggaatgctcgtgatttttgcacattgattttgtatcctgagactttgctgaagttgcttatcagcttaaggagattttgggctgagatgatggggttttctaaatatacaatcatgtcatctgcaaacagagacaattkgacttcctctcttcctatttgaatatgctttatttctttctattgcctgattgccctggctagaacgtccaatactatgttgaataggagtggtgacagagggcatccttgttttgtgccggttttcaaatgaatgcttccagcttttgcccattcagtatgatattggctgtgggtttctcataaatagctcttattattttgagatatgttccatcaatacctagtttattgagagtttttagcatgaagggctgttgaattttatgaaaggccttttctgcatctattgaaataatcatgtggtttttgtcattggttctctttatgtgatggattatctttattgatttgcatatgttgaaccagccttgcatcccagggatgaagccaaattatcatggtagataagctttttgatgtgctgctggattcagtttaccagttttttattgaagatttttgcatcaatgttcatcagggatattggcctacaattttctttttttgctgtgtctctgccaggtttttgtatcaggatgatgccggactcataaaatgagttagggaggattccctccttttctattgattggaatagtttcagaaggaatggtaccagctcttctttgtacttctggtagaattcagctgtgaatacgtctggtcctgggctttttttggttggtaggctgttaattactgcctcgatttcagaacttattattggtctattcaggaatttgacttcttcctttagtcttaggagggtgtatgtgtccaggaatttattcatttcttctagattttctagtttatttgcatagaggtgtttatagtgttctctgatggtagattgtatttttgtgggatcagtggtgatatcctctttatcatcttttattgcgtctatttgattcttctctcttttcttctttatcaatctggctagcattctatctattttgttaatcttttcaaaaaaccagcttctggattcactgatttttttgaagggttttttgtgtctctaatctccttcagttctgctctgatcttagttatttcttgtcttctgctagcttttgaatgtgtttgctcttgcttctctagttcctttaattgtratgttagagtgttgattttagctctttcctgctttctcctgtgggcatttattgctatgaatttcccctaaacactgttttagctgtgtcccagagattctggtatgttgtatctttattctcattggtctcaaagaatgtatttatttctgccttctttttgttatttactcagtagtcattcaggagcaggttgttcagtttccactgtagttgtatggttttgagttagtttcttaatcctgagttctaatttaattgcactttggtctgagagactgtttgttatgatttccattcttttgcatttgctgaggagtgttttacttccaattatgtggtcaattttagaataagtgtgatgtggtgctgagaagaatgtatattctgttgatatggggtggagagttctgtagatgtctattagttccactgggtccagagctgagttcaaatcctgaatatgcttgttaattttctgtctcgttgacctaatattgacattggggtgttaaagtctcacactattattgtgtgggagtcttggtctctttgtgggtctctaagaacttgctttatgaatctgggtgctcctgtattgggtgcatatatgtttaggatagttagctcttcttgttgaattgatccctttatcattatgtaatggccttctttgtctcttttgatctttgttggyttaaagtctgttttatcagagactaggattgcaacccctgctttttttttgctttccatttgcttggtagatcttcctccatccctttattttcagcctatrtgtgtctttgcatgtgagatgggtctccagaacacagcacactgatgggtcttgactctttatccaatttgccagtctgtggtcttttaattggggcatttagcccatttatatttaaggttaatattgttatgtgtgaatttgatcctgtcattatgatgttagctggttattttgcccattagttgatgcagtttcttcatagtttcaatggtctttacaatttggtatgtttctgcagtggctggtaccggtttttcctttccttatttagtacttccttcaggagctcttgtaaggcatgcctggtggtgacaaaatctctcagcatttgctcgtctgtaaaggattttatttctacttcacttctgaagcttagttggctggatatgaaattctgggttgaaaatwcttttctttaagaatgttgaatattggcccccactctcttctggcttgtaggcttgtagggtttctgctgagagatccactgttagtctgatgggcttccctttttgggtaacccgacctttctctctcgctgcccttaactttttttcctgcatttcaaccttggtgaatctgacaattacatgtcttgggtttgctcttcttgaggggtatctttgtggtgttctctgtatttcctgaatttgaatgttggcttgtcttgctagtttggggaagttctcctggataatatcctaaggagtgttttccaacttggttccattgtccccgccactttcaggtacaccaatgaaatgtaggtttggtcttttcacatagtcccacatttcttggaggctttgttccttccttttcattctttttttctctaatcttgtcttcatgctttatttcattaaattgatcttcaatctctgatatcctttcctctgctttatcgattcagttattgaagcttgtgtatgcttcacagagttctcgtgctgtgtttttcagctccattaggtcatttatgttcttctctaaactagttattctagttrgcaattcctccaaccttttttcaaggttcttagcttctttgcattgggttagagcatgctcctttagcttggaggagtctgtttttacccactttctgaagcatacttctgtcaattcatcaaactcattctccatccagttttgttcccttgctggcaaagagttgtgctcccttggaggagaagaggcattctggtttttggaattttcagcctttttgtgctggattttcctcatccttgtggatttatctatgtttgatctttgatgttggcgacctttgtacggggttttcgtgtggacatcctttttgttgatgttgatgctattcctgtttgttagttttccttctaacagtcaggcccctctgctgcaggtctgctggaatttggtggaggtccactccagaccctgtttgcctgggtrtcaccagcagaagctgcagaacagcaaagactgctgcctgttccttcctctggaaggtttgtcccagaggggcacccaccagatgccagccagagctctcctgtatgaagtgtctgtcgacccctgctgggaggtgtctcccactcaggaatcacgagggtcagggacctgcttaagaaggcagtctgtcccttagcagagctcaagtgctgtgctgggagatccactgctctcttcacagccaacaggcaaagaacatttaagtctgctgaagctgggcccacagccaccccctctcccaggtgctctgtcccatgagatgggagttttatctataagcccctgactggggctgctgcctttctttcccagatgccctgcccagagagggagaatctagagaggcaatctggctacaggggctttgctgagctgtggtaggctccacccagttcaaacttcccagtggctttgtttacattgtgagaggaaaacagcctactcaagcctcagtaatggcggatgcccctcccccgaccaagctggagcatcccaggttgacttcaggcagctgtgctggcagtgagaatttcaaaccagcagatcttaccttgccgtgctccatgggggtgggatctgctgagctagatcacttggctgcctggccttcagcccctttccgggggagtgaatggttctgtctcactggaatttcaggtgccactggggtatgagaaaaaactcctgcagctaactgggtgtctgcccaaatggccacccagttttgtacttgaaacccagggccctggtggtgtaggcacccaagggaatctcctggtctgccggctgcaaagactgtaggaaatgtgtagtatctgggccagatagcactgtccctcatggcacagtccctcagggcttcccttggctaggggagggagttcccctgaccccttgcgcttcctgagtgaggcaatgccccaccctgctttggctcaccctccatgggctgcacccactgtctaaccagtcccaatgagatgagcccggtacctcagttggaaatgcagaaatcacccaccttctgcattgatctctctgggagctgcagactgcagctgttcctatttgccatctggccagccacctaatatttctaatcattcacttagcaagagtctcaggtttaagtaaaattataactaagttactaaggaacaatacatcaaaagtcatatattcatttttccctctaagagttttttcttttttaaaaaaattaaattaaaaaactccttggaaaaaacatttttaatcttcccattaccactttattccttggcacacagaagggtaccagtctctgctggagacaaaggtggacagtaggccagggtgacaatatcagcctgttcctgctccaggtctcacattaatgcatcaagggcaagatatggtttcttacttgaatactgcaggttttggttatagacagctggagtggtggtaaggggactaggttaggtgaagtcactgggctatcatccttgctctggttctacagctgtgcattttggattgctatttagcttctctaagctccagtttcctcctctgttatatagaaataatgtctgccaatcttttttatagagttatttgtaggatcaaatggaatgagatatgtgaatgcattttaaaaatgtatggaataccacacatttggacaagattattattgaagtgtgcaatcttgtctacatgacaagtgaaatcacgtaggaatcgtagtaacaacaaaccagctgaattttggtctcagtaccaatgcctactggggcactgcagtagagcaagttttcctaacacctcatggaacagtgacagtgaaggttctcctaggtttttatgtgagactgcctgaagagcaattacaggctctggaacaatagatgctactaagtttattttattttattattattttttattttactttaagttccgggatacatgtgcagaatgtgcaggtttgttacataggtaaatatgtgtcatggtggtttgctgcacctatcaacccatcacctaggtattaaggctcgcatgcattagctatttgtctgtttgtcctgacgcactctctcccttcccctgccccctgctccaggccccagtgtgtgtggttcccctccctgagtccatgtgttctctctgttcagctcccacttatgagtgagaacatgcagtgttaggttttctgttcctggctaccaagtttaagaaagtcattgtcagggatgtgaaaatcagaaaaataatctggtattttaggaaaagcacttaaaataaattgtattaatgacaccacattttaatgattaataaaatacttgataaggcaatcctgtattaatattcaaccatttatacatgattatttctaaacattatacaatgcaaaaaaattcacatgtttaaagaagtatctactttatcaggtaccatttgtgaatactctcaacaagcaggtgaatacaactctcaatgcaagtgaatatacacagaaatgggcagcaggatggtcatttgcctgtctgtcttgcttgggagtaaaagagaaggctaggaacatggctgtaggtttggtactagaagaaaagtgggacctattccgacttcctgatcctgtgatttttttctttttttgagattcacacacacacacacacacaaactatgcacaagtttgcttccatgttgtatagcaagagtttaaatatttctgagttaatgatgccaaactgtgctccgattatatcagcatatttacatgatccttgaacaccacatatagattcctatactacacatttaagcaaaatcacctcctgacttcacaatgaaagagacctattggattaaaaagtggtttctagtaaaccccaaagagatactgttactaaattactaaatttaaaggcaaaatagtattcactaaactgatttttctgtcttattttccttatttggcataatcattaaccaacttctagtaaatggaagcattctcacaatttaagtttttttagggggaaacacacaatttrtaaatactgtcaagtgaagaacagattcctgaatactaaaagacccatgcatatccttgtatgtaaaaaaaaaaaaaatccatcataaaatcatagactcaaacaccatctttgattcagtagttctccctctactgtggcttctgctatagagtcattgttaaaaagagttcttcatgaaagattctcacatagcaaaatgctttaagaaaatgtctaacaaacatttttattgtctcaatttgtacacaaactgacacctgaaaatcagagaggataaagaacttcaatctttaaaaaagagaggtaagttattccaaaatgctaccagtcaataattaaaaatacagtttgggggcaagaagttctgaaataactcagagaacttgctcaagattttacttttggaccagtcctctttgggagggagtatgtgaataggtaatgaaagccttatatgagagagtcaatggagagccatatcaaggagcacctgaagatatatggatcaatacagggaaaagaaatccaagtagcccagtgcctgacactcactgggcactcaattaatgcacggtgaattaacaaatgaattaatgaaagaaccatttgctacatataacattcttactttaagaaaaaagaatttgaaacagaagaaaacatacacgcaagaacacatacaaactataaactatatgatatcctaaaggagatgtaaatattaaactgtttgctttgctgactgacactattaatacctaaaagcagtatgagagatcacaaagaataagtactcattcatacttggagtgggctgctcatcttatggtctaacttgcattttatgtcatggccatgttgcttaatctccagctgttctacagaagagcaaaataagttataaataaattattaaagaaaaaaagtaactctatccatgctgaggcctgagggagttgggggaggagtcaattccttttagtttatatttaaaaagagaaactctttggaaaactgtaatatctgaagattttgtggtttccaaaagtgaaggtgaacggtgagaagttttcttagtttagctactgaaccctaaaaaaatataacctcaaaagttaatttcttaagcaatttgggcacctgaatttgataagaacttttttttccagacattctgttctgtctaacccaaaggaaaaatagccaattttgagaatctgtatacaaataaggaaaagtaaaatacagcgctttgcaaagaaatgggagggatttctgatactcaattcatgatgctaaacacttcaagtagatgattcaaaggcagaaatatataactgttctcattaggattgtttatggactataaataaggagcagacttatggccaatgcattagaaaaaaacaagtacaaaggcacttcagaaaataccttactccaacctcccattttagtgtcatttctaaaagggtttcatttcagccttcctacctttcttccttccttcccttccttccctccaacggggtctcactctgtcacccaggctgaagagcagtgggacaatcacggctcactgcagccccaacctcctgggctcaaacgatcctactgcctcagcctcccaagtagctgggactacaagtgcctgtcaccaggcttggataattttttttgtcttttgtaaagatggggtcttgctatgttgtccagactcgtaatgatctcctgggctcaagtgatcctcccacctcagcctcccagagtgctgggattacaggcatgagccaccacaccagacctcttttttctttattatatattcctctaataaagtgctctgtatgcagtgagcattcaatatttgctaaattaaattaatggaaagttttctaactaccatgtagagtatctaaatttacatcattggttctagaactgctgtctgaagcaacacaaattacacttatgacagttcgtcaaatctttgaagcccatcctcaaaataaggatgtcaaaaatacatcacacatgttgacactctaatctcccagccacagtaggcattagcaatctgaatgttatttttactaatccttcacagttttagaattcttctcaacccaacattcaaaaaccacttgccattccagcctaagttttcttgtccctaagtcatgcattccaagtcccctcaaccattgctcacatgcaatgctttcaaattccctatgcatcctggtcacagtgatttgaatgtacactaatttatcgatgatgtacctaaaacaacttatttcatttccttgaactgatgataatattctagatacagtctatttaaaaagtgaagaattattagcttctccatttcagtattatatttctagcagtgcagcccaaaatttcagtagctatgataacagcctcttgtcacaccactggcttatactgaacttgcagttaatttaaaacattcaagcttcctttctacaatctgctgataagtcatcccctaaaaccgtgcccgcaactctctattctctcctaaattgatttttttgtacttaatcatagtattttacatttaagtaaatgtaaatgatccagattctatcattcaacagaatgtctgcaatatctgctggctttatgtttcatatgataagcatatcgtctgtgccttcagacacattatcagccaacatgtcggtgctggatgtattttcccaatgttgcataagaggaataccttcgagagtttggcctaggaatgtggcctgggactccgccaagcatctctctccagcaaaatgactgcaaatttctcgaccttcagattctacatgatgtaaaagaagtttgtctgtgtttaaaaacacattcaagaaataagtgaacatgtgaaaagacagaaaaacttgttttaatttgggcatagtttcagttttcaaaggcacatgaaggcagaaagaaagaatcacaaaatggaactactgatgatagcaactccaaaaccaagactgattagactaaatcccatgtggcaaaaattttatttagtaagtttccttctccctctctccctttagatatatgtgcatacacacacacgcacctttattttagtaattttttttttctgaaaaagaaagttttctgcacctgattgcttccatgaataacacaaagcacaaacaatatgactttctttggttatcatgcaattttttctctgcttaccagaaattggcacaaatttaagatatactatattctactccctgaagcacagtcgctggcatctccactggcatttaaaaatttgaagacatttaaaagaaaatccacaagcttatagttgctgtctaaatcaactttaacatttcatatattcacaatttcataagtgaatcaaattacacataagaaattatagaactaagccaactaaatgacttttataataggtactggggaaaaatattattaaaccttttcctccaatttctgcctttcttccagcaagacaaaccattttcatgaagtttctgtctacatcactagtgataatctgaagcagccattaatcaatctattagtgcattcagcaacatttatcaaagtgcctccccagaactgttttggatgctgttgtgggcgcatgcaaaaatgaactaaatatagatttttgtcatccaagaattttaagtcaatttgtaattattggttcctggttccataacttttttttttttttttttggtgctggctcagatgtataccttcatctattctaaggttaaggcaatccttataattttcttcctttttcttgtttgtttgttttttgtgtgtgtgtttaaaatcttgcttatatttgactttattttattctcacatcttctgagtacattaaagttaaaggtagatcataaatcgaaaacattcttaaaggtctctctactcaaattatttggtgttattgtatctcagaaagtataatgaattgcctgtagcaaataaataaaatcagaacctttatactcaatggttcggtttggtacatatccatgaaaataataaatgttaaaaaggatgctagccgttgattcctggcatgctattctacatttggctacattacaacgttaaaaggatttagtgcatatatcaaattgtggatctgcttgttttaaaatttcatctgtaattccacatgcaacccccacccccatacacactcacaagatctgaatatggtaacaaggaaatcctagtaactgtagcgttggaaaaatggttcatatggaaataagccatttggctagtaaagctggtgattttgttctctaggtggcactattacttcaatttttggtgagttgcttaaattacttggaactgcccgtttattttctttgaattcccattttataaattttaattttatacaagctagttgtaattaaacgacaggttgccttctaggttttatttcagtaagtcaatttgaagttcagtgattttttatcatataattttatgtttccttactatactgtcttagttttaagaaatcctcccttgcctgacctcctctctccaaaaatgcagaggcatgtcaaaaacacagagggtcgtcataaagtttccgtcagaccaaaggaaccaagatgaaagcatgtttaagagctactaggttctgggagatttcaaaatcaggacattactaccatgacaaccaatgaaaagttctttcaagtgaacctttggggaaaactatataacgttccttactctctaggctctctggaaataaacttttactttattatggctgtcactaaagcttgtaaatttactttgcttccttccaatcgttctcctgtcccacactcagccccctaactcacttaatgcaacccatcctcaaacatcaatctataaatgagacatcagggcaatgagccacttcttagcatctagtatatttgataagatttgtctcatcaagaggataagtgccctagagcttctacttgaacttaaatacttaatttaaatgaaagcttccacacttatctgaccagatactcaaatttttctacagaaaagagaataccttcctgttccacttaaagaacacacacatttaccactccccctcctctcccctgcaaaaggttttcaatgtcagtacattagtgagctccattttgcatctgccatcaataatgattccatatagtcaataattgggttcatgacctttctaaatctttacagtgtaaatattctggaaatccagtgaggcacttaagtataaaattatttaggattaartaattctatgccttaagtagaagtttaagaggacgtttaggacacacatgactaagcctacaaataccaaagccactctatgtttcctaggtttaaataccacatgcaaataacatacggatttcatttgccagcatcatttattgcctaacattactccatactaaacagagtaaatggatgcagagtgtaaccagtaagtttgctcattcacttttgaagctcatctgtgcatgttattcatcctaataaagaaaatttatcacaacacaacttgatgcgattcttgttcaaatgatttcctcttccattgaacaacagccagcacttaaaacctagaattccacagaattctctcctcgattcctctttaaaatgcaattcacagtttgagatcacagagcctgccagtggctgaatggctgcactagatggctgagagtccttcaattaagcaacaattttgcaattagtggaaactgagtgctctataacaattgtttgaaaacaagttgagacaagttagcaattaccctataaaagggacatattcacttttgttggataggcgagacccctcacacaaattgaactcttccacacagggagatgcaagttgaaaattaatgttttaatcactaaaatcaaatccatattatgggcacctgaaatgggagtgcctttcttctcaaaagatattcagagtttagctatcatccactctctatgctgtctgtttttattcaggaagtctgaaattgttcttctgtactccgggattaatttcctacatctcaaaatgttaataaactacttgaacatgacctttccattctgtaaatttccttaagagtaagtctacgattgagacccaaagctgctggctgtgttatatttcacagttcacagttctctctctctctctctccccctctacacacacgcgcacgtgcacgcacacacacacacacasasagagagagagagagagagagagagagagagagagagagcaccccaggttttagaagatgaatgtaaaaagaatgtaaacaagttctctgctatactatcaggtgggcgtgcccagctcactgtgcgtgctgaactacaaaccagtgctattcatataagaaatgatatcaatcatctacattttgactattgaaaagctgggactcttaaagattccaggaaaaagggaatagcttacattttcatggcgccccttttaaacaggaaacccacggactttgagccaggattttagaaatttgcatttctttttttacaggattttccctcctggtgagtcaaaatgaacaagaaataccccaggacctcccttccctccttggccattaatgagatgaaggcaattaactcacatagtataaatgaatcatttgaggtgatgactgcattttaggcaaatgatgactttcttggttccattggtttgcaagtaaaagttacacacattgaaaagacactgaaacagatttcctaaatgcttcattttctggatgcaccaatgttgacctactatacatgttaaatggttttaaaatatcaccttaaaataaaggaaacttccagctactaactcagctctgaatgggctatgaaaggctccaaaggtatgtgaaaaattactgttattttgctttaaaaaatgtgatgtctaagagtgtctgcaatgttctaatgcttcaaaacatgtacgtaagccttgtttatctggaaatcatttctttctgcttatatcatttataaatagaaaatgttctgtaataacttaaaatagttccacatacataatgcttttmgtgtcataatacttactactggtctatatttaccaacatttatcacattttacaaaatgaagtagaagaaaaaaaagacaacgactttatggccctggaattccagtaatggtgaccaacatgttttaaattccagtaaaggttatggttacatttcaacaagtgtctctttcctttctcttacctctcctgctaacccagaggtaaatttaccaaaaaaaaaaaaaaaaaaaaaaaaaaaaaaaagtcttaagcaaggcatttgcaaaatcagaaaacaggaacaggagtttagtgattgtttttaaaaggtgctgttcccagggtcaaaactttgtggtgtaatttcaacatgctatgttacctattatgtgtaatgccttgaaacgctacatgccataacatcagaaatctccaacctaaaaattatgttgcatgagataagcattgaaggcacacacgttcatacaaattaaatctgtaattatgcctcaataagttaaaatgtaaagacatatcaaattgtaagaccaaaatggcttttgaccttacaacaaactcatataaaaatagatttttcgataataataaaggggagagagagattttgcaggatattgagccagtagggaggggtctcatttaatatcatgtcgccttttatatgcagttagaaaatcaacgttcccaattacatattactttgctttaaaagattactaggaggattaataaacactcagaaatatgcctttctttgcttctggccaagaacattcctgcgtgcttgtcggaaaatgttctttggttgctactgacattaaggagtaagtgcaggataactagaggaccctaaaataagatccaagaagccctaacacaccgccaatcgaggcttatcaaagctcccccagcgcgaggaaaacttgcatagaagccaaacaagaacgaggagtcaaaatccaccgacgacgagtcgcacgccccaccgagctggagtcagcagcaccattcaacaagtccctcctaccagctctctaagggatcccgcaaaaccttcctttaccacttccccacccccagcctcccgcccccagtagctgctcttggcagcatggccggcagagggcaccctctaccttccctagcttcgttctctgggtcccctcctcctcctcgcctcccctccaccccggtccctcatccccgctctacccccaacacacaaacactgcatcctccagttcaccctcgcagccccgaggcttcttccttagggatgcccctagtctgtaatctccccttcttcttgcccgtcaggcacagagcccccaatcctcagctatttctttccaggagtaactcactcacccattcctcttcccggctctgcatccccagagactaacccgagtcaagaatcccccacgtacatcccaaccactccccgaaagtcaaaactcttaacttccctggagggcgcttcagaagaggggcgcaggatgggtagagatgtgggttcggcctgcccgagagtgtcgcagaccctttcagttcccagcggtaggaattccgcctcccaagttttccaagctacattggcttcggacttgtaagtccacttcagtctcaattcctggggagcaggtagccgtgtgcagctccggggaagggatgcgggctgaaggcgcaagcttccctcccactccccccgcaagtcggcgcggggaccacccaccccctggaaggattcctagcctagccccagcaccctcccctcagtcaggaccctcgacagctctggccccctaagtctctctcgactactcctgggctgggggagggctgcgagggatccccgggtcgccgtctttgctcccatcacgcagctctgggtctcctccaggccttccctcctctacttcgtgacttccccgggtccctttttccctggtggtgccggctgaccttctgggttgtgggatgggggagaaaactccccaagagtaactccaaatcgtcccttctaccggaggggaggaaagaaggagactggcctcgtcccacaactttggggtgggggatcccccagtcaactctctcccgcggacgggcagctcctgcaccaagccccattcccagcgcttgcctacctcggggtccacacaaacctcacgggtccccggcggcggagtcacatcgtggttccgattctggctccagcgcccagccccggtccccgtcgcggtgctgctccccgccggccccacagcagcggtgggtgtctcattaaagccccccgagcaggaggtggaggggcgcaccgggctggctcctctgtccggcccgggagcccgaggcgctacggggtgcgcgggacagcgagcgggcgggtgcgcccgggcgcggcggcggcagcggcggggacccggagctccaggctgcgccttgcgcccgggtcagacattatttagctcttcggttgagcttcgattggtcaaacggcgccgcccccccccccgccccccgccccccgctccccgctcgcccgcgctaccgatacccgttcgaggcggccgcttaaagggaacgccgcgtcttttcctcgcgcggggaaccgaggggcgcccggaactccccgctcccccggggcctgtcctcacctcctcccctagggccccgcgacatcgccctgcgagtcctgcgccctcctggggcgccttggacaggacgcccgcggcttcgaggggtgttccagccccagcctcagccccggggaaccccgcgtcccgcgccctctgcagaaaccccggctgtgggcgctggggcgggagggagcgagtgagaatcgcacgccccgaggtctcgctcccctagctttcaactctccccttcctccccatcccagcacccaagttctctgggagagggcgtgcgtttcccgggccacagacacaccttcccgcaccttcctgcactacggagcttgcgaacgcgagcacacaatgaaatcgcacagagcatgggggctattggtttactctgctgccttaaacacgccggcttaaacagagttcgcgcactgacctctctagagtttgcctaataggaattcaatcaagataataacagcattttttattgatgaacgcccccagataacgttacaccaagttacttgttccagccaggaagcccaggcaatgacagacctcgctaaagccacacgctttctagccgaccaaacagaaaaacggaaagagaaagaaagaaaacaaacccaccttttcagtcactacttgtcaaagtaaccatcaaggcagctgctccgggaaagacttcggccccaaaactcccacactctattattttttcacgttcccttcgcttaattaaaggggggagggggcgcgagtctttggtgcccggtatgtactccttctgttctgcagcaaagaagttaaattattgatagtggaaattgcatggcggaggtaatactcgcaccccatcagcgagaagctccatttgatctcggcagaggcagggagatttcatgctagttcgccggggggagcggcagcgagagcagccctctccgcggtgaatgggaaagtgggtgggagtccacgagagggctccacggtgccttgacgtgcgctgtcatatgatacctccgctgcctcgaaatagacactctagtgcacgaattaccagaatcaaaattcagcgcatttaaaatgatacatcttttattagaagagttccgttccagggcattgcatgcttttgcagatgttttcacttccagccccagcaaacacacgtataagctaacccttttaataacgaaccagggcagccaagataaataaaaagtcttctgctttaaccagagtgggggtaggtgattcgagggtgggggcagaactggctcagttaatcctcccccgccctccacccccaccactgcccgcagcaaaagagcaaatagcctttcgggttctcatttgcctgtagccaagacccttgaagagaacttatatggctagggtccagaggacattttcaattatccatttgatgaactctgtcaaccgtctacctgtgtttctgctttaaagctgaattttcttctcattagttcaaccaatttgtgcagaccttaaaatttagaataaagaataagacagcagtaccgtacttaacttggagtccctggacctcctcggagcataaaaatcacctgggtgagtgttaaaatgaaggtccctcctcctgaaattgtgatttagtaggggtggggcagggcccaggagttataattttaataaataccacaagcaattcgaatgcagacaatctgaagtcacactttgagaaacactctcttgggggtacaacactgggtatcagaggaatctcccaccaagcccacacccaaattctgcaggcagctttctgtgtgtgtgcgtttttctgtaatctcaaaggggtttgacctaataattgcgaagactattgctgtaagaatttccctaaagactccaacattaattttgctaaagggaaagatttataaacagtttcctttcctggaccctcttgtggttaccaagaatgtgctgttgaactgaatatataatattattacatactcagttcaatttacctaagggtttacagttagcaaaatgaattcactaacattagctattttagaacttctaaagactagtgacagaaattatttacccgttttataaaagaagaatccgatcctctgccaggaaataatttacccacgttcacacagtgaagtaccagggacaagacttcagtgaactcaagaattcctgctagaaataaccctgcttccatctcccccaccccctaagtgaagctatctgttccttggaagtgttatcagaatgtgtgatcattcagagcgcctttgcaaattgttggactaaatagtcaaattattcaaatatatgcatattcttcgagtgtcacacatttagctttgcacctctgtcaacttgacagagcacatgaccaatacaaactaccctacagcacagatggcagagtttattgtggaatatttaatgtatgtgaaatacgcaggctaaccagaaagcaataaaggacagagggcatgaagctggataccgctaccccagagaccctctgcgttggttcccaggttgtaagatgaatgcaggcacaatttcttttagtagcacaatacaatttaaaaggctagtgttatacatttaaaaaaaatacttgtactacattataaaggactggaggaaccctactccaaactttaactttgttaacttcaaactgatgcttcacatttgcttgaaaatgagttctaccctcaggtttttaagctcaattgtaatttatttccttcctgaaaaaatacctggcaagttaatgccaggaatctaagctagcattctgaaggctgctcacttagaagttatggcaaatcttttttctgctaaattcacattggcacgtcagcatttctgctgaagg

SEQ ID NO: 17667 - DNA, 137935 bp, Homo sapiens
  misc_feature (1)...(137935): n = A,T,C or G, or insertion/deletion polymorphism (see Tables 1-2)
ccaacatttaaactattgagaaaataaaaccttgctcactggtgaccacaaatttactctgtaccttcccctagactaggtatgctgttcagcatctgttttttttctgttttttaaaattgtgattaaaaacacataaaatttaccatcttcaccatttttaagggtacagttcggtagagttaggtacattcacattgttgtagagcagatctccacaactctttttctcttataaaaccaagattctatatccattatatagtaactccacattcccccatcccttcagtccctggcaaccaccattctgttttctgtcgcaatgaatttgactactctcagtacctcatataagtggaatcatacagtacctgtccttttgtgacttatttcacttagcataatgtcctcaaggttcattaatgttgtagcaygtgtcagaatttctttcctttttaaggaaaggaagaaattcattgtgtgtatatgcaattttgtttacattttgtttatccatttatctgtcgatagacattaggttgtgtattagtctgttcttacattgcaatatagaaatacctgagactgagtactttataaagaaaagagttttaattggctcatggttccgcagactgtatgagaagcatgatactggcatctgctcagcttctggggaggcccccaggaaactgacaattatggcagaagatgaagagggaagccaggcatgttttacatggcagaagcaggatcaagggagagaatggggaggtgccacacactagaacaacaccaaggggatggtgctaaaccattcatgaaggatccaccctcatgatccaatcacctcctaccaggtcccacctccaacaactgaggattacaattcgacatgagatttggatgggaacacagcgtttttctgagccctccatatttttccaacctctgcctgttacccaattccaaagttgctgccgcattttcaggtatctttatagcaatgacccactcctgggtaccaattttctgtattagtttcttcccacattgctataaagaaatacctgagactggataatgtataaacaaaagaggtttaattggcttatggttccagggtctgtacaggaagcatgctgctgacttcttcctgccttctggggaggccttgggaaactcacaaccatggaggaaggcaaaggggaagcaagacatctcatacggtgggagcaggaggaagagagagagggggcaggtgctacacacttttaaactactagatttggtgagaactcactccctacatggtaccaagctaatccattcatgagaaatccaccttcatgatccaatcacctcctagtaggcccctctccaacactggagattacaatttgacataatatttggatccaaaccatatcaggttgtttccatctctttactattgtgaatagtgcttccatgagcatgggtgtgcagatgtcttttcagacattgcctcaattcttttggatccatacccagaagtgggatgctcttcagcaccttttattcgtgtacagtcagcaacactttcatttccccacattgtctgttcactcacctcgagccatctactctattctacattcattcattcttccttctattaagggatgatgaaaacatccgaaggtaattctcttaacttcctctccctccaccttccatcctatctacatccactcacccttaccctcatgtctgtcttccacttttcacagcctatatctttcactcttcatccctttctgtcttttccaggacattgttccttcagttagcccctctctcatcattggctccttcgttccacctccaaaactcctgaagccaagacctgctgagctgcatgtgacagaaatccacctcacactggcttagaccaaaaatgaattttgctaaatcacatgacagaaaagtccaagcatgtagctggcttttgtcaaaacaggaatagtcaaagggtgccttcaggaatatcttctccttctgctttgcctggctggcttcattctctggaaaaaactccctaaaaactggcaaaatatttactgatgatgcaacatgcacgtctcatcagcttagccttccagtacaaagagcctctcgtccaataagtctttcaaaagtcccttcaatagctttcattctccaaatagggttacatgcccccaaaggaaacaataactaggagcaggacagtgaaataaacacagggcaaggcctgagttgcctgcccagccttggagatgggggtagggttggtctacctcattggttctcaggtgggatgattttgccctcccaaggacatttggcagtgtctagagacatttttggttactacaactgaaggacggaagggtttccagcctctagtaggtagaggccagggatactgccaaacatcctccaaggcaaaagacagccctccagaacaaagaattatctggtccacgatgtcaataatattgaggtcgagaaaccatagtcttccagaatcacattgaactatgggaaagaggggatttcccagtggaaaaatctaggggcaaatcccagaggaagggacccatttagagcaacagatatccaccttcacctccatctgaaaaaaatcttcccccaaaccatctatgtttctcgtttaaactacctctcttacaccaaattttctgaaagagtggttggccttagctgtctcaaccactgtagtcattcattcaagtgatgataattatggagctccttctgtgtgctaagcattattttaggtcatgggatttggcagtcgtaaactgacatgttctcatgcagcttttattctggtgggagagacacacaataagcagattttcagttggtaataaaatgaaaaaatgataagtataattttttaatctatatgaaacaggcaaaaaggaaaggaagttctgaattaatgtgcaattttaaatagtggccaaggaaggctccattaagaaggtctcatttgagccaaataactcaaggagatgaggtagtagccatgcagagcgatatctgggcaaagagcattctaagcaaaaggaatattaaatgggaggaaaaaactgaagagaaaaatacacctgctgcacttggagaaataatttgtttgcaagctgatggtaaaaatccagcagaaagaggtgtatgatagtgctggaggaagtgagaattgctggtttccttgagtgagtgagagcaaatcgaatctagggcacaagtggagagatcacccttagacttagactgtgaacagtataattatattaacaggagagacggaggtttcatgggccaaatacaagaatttgggtggagtgatggtagaaaattgtagatctatttgattgtttctattttctcaataaagaaagaaacaaagccattcacagaaattaagaatgttggagaaggtgtcagaaataaatgtcaaaataaaaatatgaaatagtcatttaggagaatgggagaataaatggattagacaaacaatagtgggaatgtcaggcagaagtataatggtccatttgaaattatttgttactaaagtaaggctagtcattgtggctatgtgtcttttccagccacattcagtttcacaggtatgacagcaaaataatggagaattgattctaaccagtaatgttgttttgtctaatggctataataacccaagagaagggtgagggagctaacagtgggtgcaagatggtgattataaagacagagtatggaatttaacctggtagtgatgaaagtgaagacacaaaggaggtgagaagctgagagagatagcggtaggatcaatgggctgcaggcactgagacagacaaagattgctggattcagtttaacgttactagggtaaaagaaaagagttggattggtggttagagagtgggatcattgaaatcactgagaggttgaaagtgacaagtctccgagcatgcacatgagcattagagtcagaggagagtggaggacaagaccacaggcagagaagaggtcaaggcactggaaggccagggatttgaaaatactattgctgtgaatgttgaaatcaccaggaactgtggcagaagtaacagtggagaaggtggccatgagccaggagctcaaactttcaaggaatgagggagaaagtagatactaggagatggataccagcagaagtggtaaggagtggcaccttctgatagcatgtgatgtaaaactggggaaatgagccttctcctcttctcttttcctaagcctactacaatctggctgctactcccattactctgttgagaataacttgaaatgatgatagcaaatccttaaaagaatgtcactggatgtactaaaaactgtgataagtgatatgatcaaagtagacatttcttccactagaattttgggaggaagcctaatggaaaccaatgcgcacagaaagacaaatgctgtatgttattagtcatatgtggactctaaaaaactcatctcatagaagtagagggtagaatactggttaccagaggctggggaagggagagacaatgggagatggagagagattggttaaagggcacaggatcacagatagataggaggaatacattcatccttgaatacttaaccctctgccctaaatctgtcagtcctacatccatacttcttatttcagtaagtagcaccaccattcatttctaatcctggggctaactcttttttttttttcttttctgaatcatgtctccttttaatggttaaggaaaacaagtttaacataaaattagcaacaacaacaacaacaacaacaaaatcaaggtttaaagtcaaaattattttaacagaaaaacccaggcaaaatagcctacctacagacaggcagtacatgtcagaaggacaggccacccccaataaaaaagataaaatattattttttctaccttttttaaacttaattatttaattatttctttcttttttcttttttttgtttcttttttttattatactttaagttttagggtacatgtgcacaacgtgcaggtttgttacatatgtatacatgtgcgacgttggtgtgctgcacccattaactcgtcctttacattaggtatatctcctaatgctatccctcccccctccccccaccccacaacaggccccggtgtgtgatgttcctcttcctgtgtccatgtgttctcattgtggaagctggaaaccatcattctcagcaaactaccgcaagggggctaactcttgattgctttcttctcaccaccaaccttaagaaaggaagtaaccaaaatccaatacatgagcaactgttcattccatctccaatatctttgttaattgtccactttatccacccagtcagggccgccatcaaacctcacttggatgtcggcaaaagctcccctgactggtcttcgcagtccattattgccctattctaatctaccttccatactatacacagatttacattttttaaatgtgtatctaattgtccctcccttttaaaaaatcttacaatggcatgacgtctcaattcagggtaaggaaattgtttcttcacattccctgtacaccgtacacatcgcctgcaattgcccttcaacacggagagcaggcatttcattagctgaccttcccacacacattcttgcaaagaggaaaagttaagcagggtgtttggaggcgagctgccatcatccaccgcctttgtctggaagcgcagggcctcacacgcgggatccatcggaagcccgagcattgtcaagctctgctgctgcacctgggtcagcaaggtgggctctgccagcgaaactcgttagaaacaatgcaaatggggagtaaacatgacctcgcccatgaaggggaagctgtggtcaaaagcattttgtcccggaaccccgcagccctccccacactctgggcgcggagcacaatgattggtcactcctattttcgctgagcttttcctcttatttcagttttcttcgagatcaaatctggtttgtagatgtgcttggggagaatgggggcctcttctccaagaagcccggagcctgtcgggccgccggcgcccggtctccccttctgctgcggaggatccctgctggcggtygtggtgctgctygcgctgccggtggcctggggtgagaggcgggcgggcgtggggaggcgcccgggcggacgrggaacccggggccccgcagagaactcgcgtgcagcgctgagctgcgctgctctgcgcgcccgggtccgaaggcagcgcgatgggtgggctgagcgcgcgacccggcagggcggcgggtgtaggatccttctgcgcactggagaccctcgstgcttctgggtaagcgtggagttcccasgtgcaggggcttaagtcgtgacgagcgcagtggaaggcgcagatgctgagcgggtgccgcacgaaattccttgcctttgtgtattcacagcctcggctggctatagccaagacgtggcgtygatcctagygaaagggracttggggatccgacaaacctgagttctggtcctagaaacttaactgtgaggcaacttagcacacctgagtctgtttgctcttctgtaaaatggggacactggtatctctgcatcgtggagttgctgcctcagtggcattaagcctgtcgagtatctaacacagggctatgtgtccccgagtccatttctatcccccaaccgttacctctgtacttagctcccaatggtgtttagacaagcagtcctagggatgcaggtgttacctgacaactgccccgcatggaactgtcctcgccccccacaccaagccaccacggccatcatcaccatgcacttaattgacagcrtactttaagacagatgcatgccaggcacttgcggattagaagagcaagggaagccccagaacatgcaatgtaaccgttgcaggtagaagggacagtagatatgtttacagttcgcattttagtgatgtgtttagtacaaaataacgcctattataattattatggaaattttgaggccacatctcttcctttttcttaacttcaaataggtaaacatcttcagttagaacccttctattattatttttcggctccccagaagtcttcttggttgcctagactcactggcaacatctcatttgaagygacagtcttggttgtttttgtccagcctattcctgacaactccgggttcgcccttctctgccactagacattttacattcattatttgagtgttccttcttctctaaaagagtaaataaaataaaataaagtagaaccaagtcccgcaagagttgttattaatatttgatctccttaggcaccrgaaagtaacctgtcaggtgcagagatgtgataaaacgtacaatcttatttttaggagagaagcatgcccagtaagttaagcaatctgttgtcaacgcttaggaatttgtgtcatctttgggagtactggccctcttcttactagaatgttgttttacttagcctatgttgattaagttactgttataaacaatcccagacactattaattgcaaaaaaaaaatttactgaggttatcacaataacttccaaatgtgaaacagcctaaactaaactacctagaaattttgttgctgacataatttaaattttaaaatgctgatggatgcttccagtgtgcatggtcctttggaattttaaagaagtataagagctctgcacccaaagtgtatgcatatagaagtaggtggtggagttttatgaaatctacttattaggaagccagcgttctgctttttccagcctctgctacttaccagctggtgtcttggacccagtaagttaagtcacatcactgaccttcagtgtccacatgtataaaatgagcayaactgacatcctgatctctgagagagacgttttgaaaatcagatggtgtaatgcatgtgacagtgttttgtaatctgaaaacccccatgcatgtctgaaaaaccatgactaagaagtcgtgcaagactgcaggatcaccgaaaarcgagaaatctcaactcctatgatcaggaaaggatgagtgaaaggtatatggctttactagcacttaaagagtgaatctagaaacagattgcatacgacaaaaaatagcagaggagctaggattgttttgttattatgagttactcacagtacccgtaaagtggtatagtgctatttgaaagaggacttagattagctgcaaatagatattgcaaatgtaggacaaccmctgaaaaatgtgaaaaaaagaactataatttatatgttaataagtaagagagaattgcatcatataaaatgctcagttaaaacaataaagatggctggggacagtggctcatgcccataatcccagcactttgggaggctgaggtgggtggatcacctcaagtcaggagttcaagaccagcctggccaacatagtgaaaccctgtctctacaaaaacacaaaaattaccagggcatgatggtgggtgcctgtagtcccagctactcgggaggctgaggcatgagaatcgcttgaacctgggaggcggaggttgcagtgagtcgagatcgtgccattgcactccagcctgggtgacagagcgcaactccaaatcaaaaaaaaaaaaaaaaaaaaaaaaaaagaaacaaacaaacaaaacaaaaaacaataaagggcaggaaaagaatggaagacaaaaaatagaaacagagaacaagagaaaaaaagcaacaaataaaaaccagtaacaaaactaaagcaactatatcaacaatcattttgagtgtcaatgatcgaaatgcaccatttgaaacagatcatcagagtggatcaagaaacaagacccaactatatactgtgtacaacaagaccgttttaaatatagacaatatatatgaaaagtaaatggataaagatataccatgctaatgctagtcacagaaagcaggaatagctgtgttaatttcaaacacagcagacttcagaccaagaaaaattattagggataaagagggrcatcatataatgataaaggggccaattatccaagaagacgtaacaatatcccatatgtatgcacctgatggagagacaaaatacgtgaggcaaaacccatagaactgcaaggagaaatagatggatttactatcatagttggagacttctatgatatctttctgatatcagaaaaggtgctgaagtctccttatcagaaatgggcagattcagcaggcagaaaatccgtaaggacatacttgaattcaacagcaccatcaatccacttgggtataattgacatatatagatgacttcatccacaacagcagagcacatattctcccgcttacattcatggggatagaccacattctgagccataaaatagtacacgaattaagctttaccaggcagtgtttaatatagggtggactctggcgccctcacgtggtcctcatataggatctggtttggttatccctgctaggttaaggtgcaagatagaagggaagttccaatttgctttctgtgctttgtggtgtattttggtttacatatgctcagatgagtggatgtgtgatttatattatctattttaatctaaaataagcttcacatttggacaggtaacatcaaaagtgtcctacacagaaatgctgggtgaagatcccagtaataaaaccaactccagaaaacaagaaaatggtagagttgacaatccctctcaccctctccgcaaagacacatgtatacacattttttgtcagaggcattaagtagaagaaatgctgtcagtctaatcacaactgatcacaactcgatgaaaccaaaaaacctagaaagtatcatgaagactgtcgaaataagctttacattcactattgtgaacagagagactcaatgtgactgttttttgtcccgttagatgttagctaatgattgtgctaagtcatgatgattaacaaagcatttaaaatatttattttatctgtgttacatttcaaaaatttatattgaggcatataatttatgttcgcgtacatatataatttataaatttatatatttgaaagggcatgctctttttttaaactgatagaggtgcctaagcaaagcaagtgcaaatctattccttaaagggtaagtatgcagaatggaaagcagagtgttctttgggttgacagctcatattgcaacagacatgaaagtgatgatgtgttaattgtgcatatagcacagaatacatcaacttgctttgaatggaatatctgaaccaggagaatgtgaaagtgggctgagtcatacaagacaaaacccgaaatgagataacaatacatacccactagaatggctaaaatgaaaaagattgaccgagccaagtgttggcgataaggtggagtaactggaattataatatactgctatttggcaggtaaaattataacattaactttagaaaatagttcaacagattcttaaaaccttagacacacactcaacattttactcttaggtttttacccaagagaaatgaaatcatatgtccacacaaagacttgtacatgaattttcatagcagttttgtttgtaatagccaacacgtggaaacaatccaaatgtccctcaacaagtaaatggataaactaaattaagatatatttatgcaattgaatattacccagcaactaaaggaaacaatttgtatacatgcagcaacctagatggatctctaattatgctgtgtgaaggctaaaccataaaaaaaaacctgagtgatttcctttatacaataggatataaatgaagtgatttaggttatatgaaattttagaaagtcaaatcaatctgtagtaagagaaaaccacctgagttatttcctttatatgataggatataaacgaagtgattcgggttatatgaaattttagaaagtcagatcaatctgtagtaagagaaaacacattgaaggttgcctagagaaggaagtggatgtttggatggattacagaagggcatgagggaactctgtgtgggtgggatgtatgatggaaacgtttattgtcttcattttggtgatggtttcacaacgcatacatatgttataagtaatcgaattgtacacttcaaatactcatcaatcattgtatgtaatatatcttgataaagctataaaaacttttaaaattatggtaggtcttcagtttgtggattttatattaatatatttgtcataggaactagtcacaattgagggattggtaataaaggagagaaaggaaactacatcaagctttctttgttgaaggctcatatattccttttttgagctattatacaactttgctttttataattacctatactattcatatactactatgcaggtaagaatattatgtaattaaggggaaggaacttctttccaagaatggttcattcaatttgctttgttactttaggtctcattccttcctctcgttgcaagctttgctgtgacatttaccctctctcaatacagcttttggcgctaggcacttcacatggaatctcttcctttgtccggcatcaatggataagacaaatatcaaaattgtatttcatcccacatatcaactagaggaaaggtgaatgcataacactgaaaataacagcaactgttttactcagtgttttttttttttacagtatcctcaaagtgctgttatctatcaaaatcagctgtgaaaatttttaaaaatagactcctgggccctaacctagacccactaaatcagagatttgggggacatagcttggattcttgatttttttgagttttataagtaattcttcattttttgttcattgcaacaaatatgcattgagttcttataattgagtgttaagcaccaggactaagtattaatttagaggtacaaaaaaacacatcatctcttgcctttaaattatgcatatctaatatctattgagagaaatagatacttctaaaagcacacaaagataaaaagcacaaattgtaataacaaacaattattgatatgaaaggaaaagcaaagtgtcrgactagaaattattatagggtggggcagagggaagtagtttagattccaaatccctaagagggtcagggaaggcttcagatgagattgggtgtgttcagggtggtatggccataggcaggctggggaaggcttctataagaaagtgacattttagcagatgcctgaaggaagaattgaagtcagagtgaagataaaattgcgtcacayagaaggaatgtcatagacgggaaaaatgtgtgtctttgggaaactgaaaaaggggaaagggccacaccttggtgaggggaccaagtggcacaagatgaggcagggaacatagacaagggcttccttgcttaacaactgctggcttaataaagcaaatgtgtgatgatggatacaggctgtctgggaaaaataagtaagaaatatgagctttcttggagcatcatcctttgcttcagtagaaagcacagagttaggcttccaattctgactaaagccattgacaacagggaaaaggcaaccttaggaattctcctctctgtccggggtcccgtgggcactatgatggagctcatgagatgcagatgagaagtcccaggctgaatccggggcacattcactcaggagagctgaggtcaccagtcactgaggtcatccagtgcattcccgacagcataggctcattccaagctagttctgcaaaggagcagaaaatgaactcttggaagcaaagcaagcactcccactttagcggaataatcgaatttaactcttagaagtccccttacccttttctaagggtaataatcgtaagtataatttatgaagtgccttctgtgtatgtggcagcatatactacttttgattctccctgcaaacctggtaggaaaatattattccctttatgaagatgaaactgaggctcagcaagattaagcggtttgcctaagacctcatagccaytaagtagaagacattgggttcaagattcaatctatgaacccaacatttttaatactatataccattctctttttgtattaatttcctattgctgctgtaacaaatttccacaaacttagtggcttaagacaacagaaatgtattctcttccagttctggaggccgacgtctaaaatagatccatagggctgtgttccttgtggaggctccaggggagcaggggttttcttgctctttccagcttccaggggctgcttccgtcctttggctcttggcctccttcctctaccttccaaaccagcaccatagtgtctctgaatatccttcttctgtctcctttcaccctcttgcctcccttttataaggacccttgtgatcacatttaaggtccacctagataacccaggataatctgcccatctcaagattcttaatcacatctgcaaagccctttaaccattacaggtaacaatcacaggcttcagggatcagaacatggatatctctgagaggtccttacttagcctaccacacctttccatatagattctcaaaattttagctgagcctaataagggagttcattaccattagggtccggtttagtagcaagtgcttcctttaagtgaaaaggtgaaagttgtccacttaataaggaaagaaaaacattgtatgttgaagttgctaagacctaaggtaagaaggaatcttctatcgatgaaattgtgaagaaggaaaaataaatttgtgctagttttgctgtcacacttcaaactgcaaaagttacaaccacagtgcatgctaagtgcttagctaagaggggaaaggcattaaatttgtgggcggaagaggtgaacagaaatgtgttctaattgacagctrtcaggtttggtactatctgaggttttgggtatcggctaatgtcttggaacatgtcccccaaagataagtgggtgactactgtatattcaaaataagcatttatatactggggagtaaatctcccatgttatttgtgttttatttgtcccacaaataaagtaaacaaagtagaattttaggcaagattcatttctagaggcagagatattttattataataaagaaggttgctctaccataaaatatagcaatttaaatttttataatcctaataacctcaaaatatataaaataaaagatggacaacattataaaaagaaatagacaaatgtacaataaataaaatattttaacacaactcatttagtatctagtaagacaagtactcccccmaaaatcagtaaagtatctagaagatttgaataaatattaacagattggattcactgaccttgttacaagaaagaattatacatgatgataggagagaggaagccacagcacaggcacttactgattaactaaattttgaagctgtgaaatgcaccttatcctttagtgaaagatgatataaatagcttagttgccttcaaactggcagagactttttgaatggatggatgctgattttttaaaaaggagcccatttctgaggcatcttttaaagcaggggtcctcaacccctgggccatagactgatactgtccagtggcctgttaggaaatgggcagaacagtaggaggtgagcagccaagcattactgcctgagctccacctcctgtcagattagtggcagcattagattctcataggagcagaaaccctattgtgaactgtgcatatgagggatctaggttgcatgctccctatgagaatctaatgactgatgatctgagtggaacagttccatctcaaaaccatttccctgcaccctccattcacggaaaaattgtcttccacaaaaccagtcccaggtgctaaaaagggactactgttgtaaaggaataagtccctttgctattattatttttattaagatggaatcttgctctgtcacccaggctggagtgcagtggcacagtcttggctcactgcaacatctgcctcctgggttcaagcaattctcctgcctcagcctcccaagtagctgtgcacaggcatgtgtacaggcaagtgcaatcatgctctgctaactttttgtattttgggagaggcagtgtttcaccatgttggccagcctggtctcaaactcctgacctcaagtgatccacccaccttggcctctgaaagtgctgaaattacaggcatgagccaccactcctgcaccccttggctattattgaagtgttctttttcttttttgatcacatctatgaagtatattggagagaaagagaaggtagaatgggaatttcaacagggtcacggtggctcactcctgtaatcccaacactttgggaggccaaagtgggtagatgacctgaggtcaggagtcgagaccagcctggccaacatggtaaaaccccatctctactaaaaatacgaaaattagccaggtgtggtggtgggcacctgtaatcccagctactcaggaagctgaggtaaggacaattgcttgaacccaagaggcggaggttgcagtgagccaagatagcgccactgcactccagcctgggtgatggagccagtctccgtctcaaaaaagaaaaaaaaaagtatggtaatttctccattaactttgatgctkctatggtcttgatctccaggtcaatgcaatgccccagaatggcttccatttgccaggcctaccaacctaactgatgartttgagtttcccattgggacatatctgaactatgaatgccgccctggttattccggaagaccgttttctatcatctgcctaaaaaactcagtctggactggtgctaaggacaggtgcagacgtaagtaactctggagtgggaacccccctgttagtcaaacatcygtaagatctgattcaatttgttcaaattttgtaactgagttgcatatgacaattagtttgccaaggtgcaatacatatgagaattattcttgtagatcataccttgttactgctttgagttcctggcgccttcattaaaagtttatttcatgagaaacagtcattgcaggacatgattgagggaaaatccccattcactgggggtctcccattttcatgactaaaattaagtaatgaatgacttgggacaagaaagagaagtggattaaataactaaaagatgtgacaatcttgggctttgagatctttggattataccagttgaattgaattacagataataacraagtttacatttttctgggaggcataatatggggatgaaacagatctgaaaggaaagttttttttgaaagggagctgatcctgaggcagtctggtgagtttcctcaaggtagcaaaatctgtggaaccatcagaactgcgtgtgttcctcagtaagctacaggcaggttgagaccttatgtactaaaaaaagtttttagtttactctacttggctccaaaattctgtttctttcctgtaggtaaatcatgtygtaatcctccagatcctgtgaatggcatggtgcatgtgatcaaaggcatccagttcggatcccaaattaaatattcttgtactaaagggtgagttggcatctcttgaaccaacatctcttggttcaagagttctaacacagccttactaccttctagtcacatgtcagaaaggacaactaaactattaccatctgctctttaacggcttcaacacagatgtttagctcctgactgaaatgagcaaaggtatgacaagatygggggaaaatcatctgtatccttgctggaaaccaaggcagagcatatatgaaaagtgtggcattcattgggtgggaaggaagaaaatgggggaagagtatagtcaaagcacacaaacagccttaacgcagaggggacattgctggaagaaagggaaggccattgagtaactgtgtgagagaaatcttaacggtcatagcacaagtagtttgctagggctgctgtaacagagtactccaaaacgggtggcttaacacaaatgaagtttttaaaattctgttccggaggctgaaagtgcaaaatcaaggtgttggcagagccatgctcccctctaaaacctgtaaggatggatccttctttgcttcttccagcttctggagccccaggccttccttggcgtgtggcagcagaactcccgtttctgtctctgtcctcacatggccgtcttccctctgggtctgtgtcctcacatgctgttttcctgtctgtgtatggctgtgtcgaaagtgctctcttttaataaggacaccaatcataatggattagcgcccacactaacgacctcatcttaactggattgcctctccaaagaccatatttccaaataagatcacattaataagcactggggattaagacatcaatatatttcggggtaagggggacacaattctcattcattgctggtaggaatgcaaaatggtaccatgacttggaaagataatttggcagttttttataaaactaaacatactcttaccatgttatccagcagttatccttcttggcatttatccaaaggaattgaaaactcatgttcacaccaaaaaaaaaagaaatctgcacacagatgtttataacagctttattcataattgccaaaacttggaagcaatcaagatgtcctttagcaagggaatggataaactgtggtacatccatacaatagaatattattcaataccaaaaagaaatgagctatcaagccatgaagagacatagaggaaccttaaatagtgaaccttttttcaccatcactaagtgaaagaagccaatctgaaaaggctacataacatatgattccaactatatgccattctggaaaaggcaaaactatggagacagtgaaaatatcagtggttgtcaggggttagggaagaaggggatgaatsggaagagcacagaggattttgagggtagtgaaactactctgtatgatgccataacagtaggtacatgtcataataaatttatccgaagtcatatagtgtacaataccaagagtggaccctaacataaactatggacttggggtggccatgatgtgtcagtgtaggttcctcaattgcgaaaaaygtaccaccctggtgaaagatgtttataataggggaggttatccatgtataggggcagggagtacataggaaatctctgtatcttctgttcattattgctgtgaaccaaaaactgtgctaaaacacaaagtctattttttaaaactgcatagacataaatacatgggcatatgtgcataaacagacacgcacacaaataagtgcaggtaaaacaggaaatttgaacaaaatctgtggattataactgtttcaatatcttaatgttgatgttgcactattgttttgcaaaatgttattattaggggaaaattgagtaaatagtacctgggatctctctgtactattccctgcatgtgaatctgattatctcaaagtaaaaagttttttttttttttaaagttcctactaaatttccaaggggatgggcttcccctcagatcactaccccttttcagggagcaataaagtaatcttccttggaatgtagcaatctgtaaccaatcaaaatgctgtaactatgcatggtcccatatggaaaatataatcctgctaaaatttctctgtctctgccyatgtaagtgataccttatgtcctccactttggagtgctgaccccattcatttggagttggtctcttccaggtggctacccttaacctttgtgctcaaataaactctatccttaaatatattttctgaatctcattatttaaggktgaaaatgtgctaacctaaataattcacaggatttgttttttattctcattttttcctaacctatccacctggttcaaggcacatagattaagaaggaaaatggaaatgggactaatatcccaggcttcactgtccctcttcggggccctggggaggagactcccaaaagtctagacatgttcacccacatcctgtatgtggtttctggaaacgaaatgatcatggcttttcctgaaccatggcttaactttgtgaatccacaactctctcttccccaggagatccaaaaaggtagggtaggatgtaaaggcttcaatctgttcaagtggatatgagactccctggctccccttacaataagtagcatggattttstctctctgccttacttcctccaaacattctgaatgagaagtgttcaaaccactatttgttcaattgcttaatctactttgggacacaagtttaataaattaaaatattcttctatctgttccccttgatcagtgaacataaagttatcttttgactcatatttaaaatgttcagtattacaacactgaacaatagtatggaggaaaaaaaatgccaacttaagtttgaacttgcttcaccattcctatcccaacccccatgattagaaaatcaaaaagaacactttgagaaataacctcagtggggtcaaaagccagaggagcctccaggatcccttgttcctaagacaaacaggcaggaggaggtgcacatataggattgcagctgttcttcacttcatttgttcacatacttcatacttgtgtttatgtctgttggcagtgcaatagaaaatgatttcatttttggtggtatactagaaggcattaaaaaacaaaataaggccgggtgtgctggctgtaatcccagcactttgggaggctgaggtgggtggattacctgaagtcaggaattcaagaccagcctggtcaatgtggtgaagcctgtttctactaaaaatgcaaaaatcagccragtgtggtggcaggcacctgtagtcccagcagctaaggaggctgaggcaggagaatctcttgaatccgggaggtggaggttgcagtgagccaagatcgcaccattgcactccagccttggcgacaagagtgaaaatctgtctcaaaaaaaaagaacaacaacaacagcaacaacaaaaatcccaaatgatattgaagtcattaataattacatcataatcactagtataatgtaatagtgcatcaagtatcttcaaaagcacccactgttctctcactatttatttgatcttcatttgtcactgttttgttgtttgaataaagctttatgttgccaggttttcttacatactcataaagcaaagttctcagctataccaataaccatgactgttatttgacattgcttcattccttcatgtatagtactatcaagtttgaccctaccctcactatgactagtttcacccaaccatctatcacaacagagagtctaacgtgaagtaaaataaatgtcataaattattccaaatttatggcacactgtgaacagtttgagacatactaattgagaattgctgactttagtattttaagtataaaatgagtgttcaattctttttgatcagcctggatttcctttggttctagttatgtatccccttccttccttccttccttcctttccttccttccttccttcctccctcccttccttcctttccttctttccttctttgctttctttctttcctttttactttcttttttttttttgatacaaggtcttgctttgttgcccaggctggagtgcagtggcatgatcagcactcactgcagcctcaacctccctgactcaagcgatcttcatgcctcagcctcctgagtagctaggactacaggaatgtgccaccacgcctggcttttttataaattttttgtacagacagcgtctcactatattgcccaggctggtctcgaactcctgagctcaagcaatcctcttgcctcagccccccaaagtgctggaattacaggggtgagccactgtgaagggcctaatttggccttctttaatgaatcttattgataaaagcccatccatgcatccgtgcatccatacttttaaggcaaagaaatacatacaacaggactgtatacacacatatacatgtatatatatgacagcttccctgcactcaagaactttgtgctatcttttaaaaaatgaaatttataggaaaaactacaattcatcttagatttgcataaaaaagtgtcataaggtaataaagaagagaaagctcatccaattgagaatgtatgaaaaagaaagtcaaaaagtcccaagaagaatgtgaaacttgggaaagtgatagatagtcctttgatgagtgtaaaaagtccctctgaatcctataagagtgtaatctctggaagtagtaatttaattgggtagttgacctgtgtctttagaatgtaacattccttattttttgcctctagataccgactcattggttcctcgtctgccacatgcatcatctcaggtgatactgtcatttgggataatgaaacacctatttgtgacagtgagttgaaatatcccttcctatttcttttaccgacacattctaatttttctctggaataataaaaatcttaactgaattcyttctrtgcaatctgtccttcacacggctgaagactgcggtaatgttctcgaatattcctatggggttcctggcaactctttctttaagttcttccttatcctgggatgtgtcttttctaattccagaagtttaaatacataaaagccttcaaacttgattttacttcaataaacgtgaaattatgttgtttctaccacctccagtataataatcatcytgcttggcaaatcagtaaagattttwaaaattgatactcttcaaggttagcgaagctgtggaagaacctggactctcatgtaccacgagatcaacacatcctcttgaaaggccccatgcactataaacctcagaagtgaacatatattttaacctayttcttaaaatttatacttaggaaataatcacacactttttaaagyagtttggtataaacttttcattgcagcattatttatattagttaaaatgttagagtaacctaaatattttaaactatggtttggaaataatctactagtaggaaaaagatgtgttcaaatgaccattataaagaattccctaagaaacataaaayagctatgcagaatgaaaataagtatatccatacactggcatggtattcagccataaaaaatgacagcataaagaagcacttaatgactagaaagagatgtattttacgtggaaaaagaatcagatgaayggcatatatggcaagatctcactttattaaaaaataatacacctatgtagtgagggccaggctgaggctgagagaaatacagtgtataacatctttgtcttactcttctctttggataactggactcctttacttttcttcttggtatttaaaaatgttacttttactagaaagtttamgagcttcagaatctaagtttacaaatgacattggtcacacatttattgctgtttatccactttaagaaacagttttgctattttgtaaaacaaattgggaaaccttccatcttatttgaaatctgtaataaacatggaattggaataggaattttcctggaaatatgaaaaagattagtaaaatagagaaaacaaaaaatataataatacacctatacctgtatytattttttatctctgtttctacttctgtaacctctctgtatccaaatcctggtaaatggcctcaagtcttcttggaaaaggctaggggaagatttacaatacatgcttttgaytgygtagcatggtgcttcctcaagagaatccagtctcccatccgttggtgctgctctgggtctataaactattcaagtctaggaattgttgatgaacaatgaacttcttttgcaataattcaagtcagacttctattcacttgacctaaaactcttacacttatacaaatcaagtaacactttagtcggctatccgtctactttggttttagagactccatgatcaattagcccaataacaatgtcctcttcaatcaaatcattctgattgctgtttcagctcaaatatgcattacaagaacccccattgtctctggcaattaagtgctgccactgggactctgccaccctgaggtcctttggtccccaagtgaattcagagaatccagttcaatggcaacagttcccattgtcattcctggcctacagagaatgaaccgttgcagaggatgctgaaactccccatgtgaatgtatttctcaagcctctggtaaaaggtctgtcttctgaaccctctactcctgcactgtgcctcaccagctctatccaaggatacaactttcagagtggaatggctgttgcttaacttctgcctctcaaatatcaggctaatttctcatgctataaccctagtccagaaccgtacagagaaagtaagtctggaaaacttaattccaaattggcctggttgacatggtgccaaaccaccaaataattataattttatttaactctttgtcttcttttctttctttccttccctccctccctcctttcctccctnnnnnnnnnnnnnnnnnnnntccctccctccctccctccctcccttccttccttccttccttccttccttccttccttccttccttccttccctctttccttattttctttcttctttaccacgctggctaggaccaccagtataacattgaacattggtagcaatagatgtcatccttgtcttgttccacatctcaaagttaaagtttaaaacatttcaccattaagctggtgtttactgtaggcttttggtagataaccatttttgaaataaggaaattatcttatatattcttcattgctaaaaaatttatgtctttgaatcatgttgaagtttatcaaacactttagttacatatattgatgtaatcatatctgtttctctttttctgttaatgcaacaaattgttttgagtacatttttgaaaggcaaatgattttaaatttcaattttacattcttaaaataaatcaactcagtcataatatttaatcatttttatatatggcaaatatgcttttatgatatattttagatgtttctattaaaatataattcatgtatcataaaagttacctttttaaattatacaatttagtggtgtttagtatattcacaaagttgtgtgttatggtctgaacgtttgagtccaccccaaatccatatgttgaaatccttacccctaaagtgatgacattaggaagtgaggcctttgaaagatgattagggcatgagagcagagccatcacgaatgggattagcgtcctaataaaagaggcccggaagagctcctttggccctcccaccatgggaggagatgctgaatctgccagtgttggtcttgaactccccagcctccaaaactacaagaaataaatttctgttgtgtacaagctaaccagtttatagtattttgttatagcagcccaaatagactaagacattgggcaaccagcaccgccaattaattctagaacactttcatcatcccattcctaacatattttagagataagactataattttctttcttgtaatgtccttaataagattttgatatcaaagctatgacagtcttataaagccagctggtagtgtttcatatatttgtttccttgtaagggtttatataagattggcattatttcttctttaaaaataattcaccagaaaaggtatgtggcctggagtttacgttcttgggaagtttttttttttccaaccattttcctgtaccatgtagacttttggctgaagtataacatatatatatayatayacacacacacacacacacacacacacacacatatatacatatatacttatatgtatatatgtatatatacgtatatacgtatgcatacgtgtatgtatatgtgtatatatgtacgtatatatacatacgtacgtatatatacgtgtatacgtatatatacatatacatatataggtatatacatatatatacgtatatatacatatacatatataggtatatacatatatatacgtatatatacatatacatatataggtatatacgtatacrtatacatatataggtatatgtatacatatatacacactatatatatatacacatatatatagtgtgtatatatgcacacatcttaatcatgcagttcaatggagttttacaaagtaaatgtatccatgtaaacgtcactcagattaagatatagaacattatcagcaccccagaagccttcccgatgccctttcccagttatcttcccaaagaaaccactattctgatttataacactaatagttttgttgcttcctaaattttatattaaaggaatcaaaaaatagatactcttttgtgtccagcttcatctcaatgttatatttggaagagtcatttttgtttttgcaggaaggattgttgggtcttctttattattatgttgtatttcattgatgatcttgagtaccttttcacgtttgtgaagtgctattccaaacttttgcctattatttattagtttgtctattgttttgtagaagttctttaaatattctcatgttttctaataaatgtaacacaaatattgtctttcaggctgtggcttttcttttttccttcttaatgatgtcttttgtttatgaaagttctacattttaataatattcaatttatgagtcttcttttttccagttactgctttttctattctacttaagcaattgggccaagtgaggtggctcatgtctataatcccagcattttggaaggccaaggcaggaggattgcttgaagccaggagttcaagaccagcctgggcagcagagtgagaccctgtctctacaaaaaaaataaatatataaaattagctgggctcagtggcacatgcctgtagtcccagctacttgggaggctgaggtgggaggatcccttgagcacagaggttcaaggcttcagtgagttatgatggtgccactgcactccagcctaggtgacaaagccctgtttcttatggatgggcaatagatctaatatcatctattaaaaagactattccttgcatagtgcaatgcgacaccaccatgaccataagtcaggtgaccttatgagtggatctcattccagagaggttctgtttcactggtttatttgccatactataagcactacattaagattttaattactatagcattacattaagatttgatatctggtagcatatatctcctaactatgtgcatcttcaagatttacttggtgattcttggccctttgcattaccatataaaatttagaatcagcttgtcaatttccacataaagaatcctacttgaatttgtattaagtttctgttgactcagtagatcaatttgtggacaagtaacaaatttacagttttgaagtttaaatttatgaatatgatatatcctcccattttgaagtcttctttaatttcttttaataatatttgttaatgtacattatagaagtcatgtacctatttcattatctttattctgacatattatttttaaaatttcattctttaattatttacttcttagatatgcacctgtttcatctcagctccagcaaatttgttaaatttacttataaattgaatagtttatctgtagattcttttgaatttgctgtgtaattatgtcatctatgaatctgacaaagtttttacatcttttcctttcttatgtcttttgtttatttctcttgctttattgcattggctagaacctccagtacaatattgaatagaagacatgatacaaggcttttaatagtcctcataaatcatgatgtatgctgtagatttttgcatgatatcctttattagattaaggaaactcccctttctttctaattactaaaagatttatgaatgttctttctaattgatcactgcatgtattgagattatcatgtttctttttcactctgttaatgtaatatattacattgattgatgtttaaaagacaaacgctgaattcctagaataaacctatgttgcttgtgatgtgttatagatgattatcctatgtatgggggatatgcgtgtgtgtgtgtgcaggattgctcatatttttattgtaacattgtaacattgatttaatatttaaaatcagtcaaggtaaacctcactttgatcattgtatcatcctttggaaatattgctggattcagtttcataatattttgttcagaaaatttgcatttatattctcaagagatcttgggttataatttgcttttattttaatgtccttatcaggtttgggcatcaagattatgttggcctsataaaatgtgttaaaaattatttattttttctagtgtctggaacaatttgtgtaacattatttttccttatatgtttggaagaattcagcagtgaagcaatctggacctgagggtttgttgttgttgttgtcaggatttaatatctttaatagctgtaaaactattattttatatcttattgaattagtttgggtaagttatatttttcaaggaatttactcattttatttagatttcctaggttatcagcataatgctgtttattatagtctcatattagcctttggatgcctgtaagttctgtagtgatacccttacactcattaatttctgatattggtaatttcttttgcttctttttccttgattagttttaccggggctttatcaattttactaagcttttcagaaaaacaacttttaactttcttgttttttctttagtttatgactattttctcttttattgatttctgctttaagctttgtgtattcctccagtcctaaattcttgatactaattaatttgtttccaacctttatttttctaatatgtacatttaacctatcaatttttctctaaaactgttttatttatttccaacaatctttatatttttattatcattgtacataaaagctttctaatttcacttttaatatctcctctgacccataggctgtttagaagggcattgcttaatttctaaatatttagagatcttctagttatcattctttcattaatttaatcatttgagacatggtttattgcccagaatatggacgattttggtaaaatgttacatatgcacttgaatgtacagttattttgcttcattttctagaaatgtcatttaggaaaatgtggtttagaacagtctttttttccccctccacttgttctctcagttatggagaagcatgtgtaaaatatctgtattagtttcccagggctgctgtaacaaattaccacaaacttagtggcttcaaagaagagaaatttactctcttaacagtttggaggccagaaatccagttaagatgtcaataggattggttccatctgcaagctgttctgtgcctctctccaggcttccttccagtggctgctggcaatcgttgatgttccttggcttgtagatgcatcatttccttctctgtctccatcttctcgtcgccttctcctctgtgtgtgtcctttgctcttctgtctcctataaagacactggacatggatttagaggccaccctggcaatccagaatggtcacagctcgagatcattaacgtgattgtatctacaaagactctccaaactgggtcatattcacaggtttcagagatcaggacacagatattttttaaggaggacagtggttattcaacccattacaatccccaactacaactatgaatttgtctgtctttcctctttgttctagcaatttttactttatgtattttaaacatgttattaaatgcatgaaatttttggtttattctttctgctgaattgactattttatcataatgaaatgtctctctttacctctcataatacttcttaccttaaaatctactttgcatattaatacagctatataagctttctttattgtttttatattatatgtgttttaaatcttttactttcagcccttctttgtcttatatttaaagcttgtctcttataaacatcatatagtaaggttttgttgttttattcagtcttagttgttcattggtgtgtttggaacattaaaatttaataataaaaattaaaaataaataaatttaatatagttactgatataaagtctaagtcttggtatttgtttcatgtgtttgttcctttattcctcatttctcacattttttaattcatcaagtatttttattattctatttccccagtagcttttaagttatattccattttttattcttaaatgactactctagagatagacatccttgatttactatagtctgctaaaattgtacttttaccactctccaaacaacgcaagtaccgaaactattaatagttaattccatttatgtcctccccctctttttgtattgttgccatacgttttgcaaaaagaaaagcttcagctgaattaaatttaaaagagtttaattgagcaatgaacgattcgcaaatcaggcagcctcccgagccaaagtaagcgcagagactccagcccagctgcaatgggggaagaggatttaccgacagaaaaaggaaactgacgtacagaaaacagaagtgaggtacagaaacagccgattggttatagctcagcgtttgccttatttgaaaacagttcaaacagttggccacatttgattggccaaaactcggtgattggcgtaagagtagtctgcggtctgtttacatcttcacttgttatagtttgcagtttacagagaaacctttaggctgagcttaaactacgtaaggctttaggctaaacttgatttaacgatttacatatattctatatttcaaagacactgttgtctttataaaaacagtatttatttatatttacaccttagtgaattcttagaatttttatgttgcctcagcatccatttagaatatgtttagctttctcatgccagaagcagggcttagtcacccttaatgccctttctagttctgtacctcctcccaattttkcaacgtggtcgagccagatatctgccttatacaactgcctcctggtgaccacctctctatgggacagctagataaaacctacttgactagcgtccctgacctctgtgccctgcatggacttcgcagatatgctgccgtgaccacctctcagtcgcagcacgactgcctggaacatgtgcctgctttctttaaactcaccaattagaactccccatgggagataccttggcttgtagatgcaagatgctgggtcatactctggtccccaataaaggcattggctgatgggtccccttctctctctctgtctcctcgcgctgaccaacctctgtgtgatcttcaggcgtgccatacccccagcccgtaataaaatctttactgccatcttgtgtttcttgtaatgactgaagaggttttctctatcataaagatcctaaatgaaaacatacccgcatatgagctctttctggtgtgtttccttcttattgcaattctgtcaattctatatgaaactattttccttcagcctgaaaaagtctctttggcatttttgtattgtagagcttctgacaacaaattctttaaacatttttctaagtgtggttcctctgaaggttattgtccatgtttcctggctgcttttaaaatggattacactttaaaacagattttttacaatattattgtgttgtgtctaggtaagaatttctttgtattgcttgggtttgcacatttttttttttttggttgttttttttttttttttttttttttgacagaatttcactcttaycacctgggctggagtgcagtggtgggatatctcggctcactgcaacctccgcctccggggttcaagttatcctcccacttcagccttccaagtagctgcaattacaggcctgtgcctccatgcctggctaatttttacccttttagtagagatgggttttcaccatgttgaccaggctggtctcaaactcctgacaagaggtgatctgcccacctcggcctcccaaactgctgggattacaggcatgagccaccgtgccaggcctgtatagccttttgaacctgtaatttaatgatgtcttgcatcagtcttggaaaattctcagttattaattcttcaaatgttgtttatgctcagttctctctctcttctcatcgagggacttcagttaaacatgctaggctttattcttctatgtatttagtctgtattttttaatctttttatatattggtgcttggttttgagtattttcttctgtcctagcttccggttcattgattttctttcagagtctaacctgctattaatctcacacaaattcttaatttcagcaatcatattttacttttacaattctagactttttattttccaaatctgccctcttccctttttttttttttttttttttttttgagacagggtctcactttgttgcccaggttggagcacagtagcataatcatagctcactgcagcctcaaccttcacaggctcaagcaattctcccacctcagccacctgagtagctgggaatgcaggtgtgcaccaccacacctacacatctggataatatatatatatatatatgtatatatacttttttttttttgtcgagacagggtttcgccatgttgcccaggctggtctcaaactcctgagctcaaacgatccactctcctcagcctcccatagcgttagaattacaggcgtgagccaccacatcccaccctgttctttttaatagtttctagttcttacaagtttcaattatacccttgaacaggtctgtagttctaatgggtcagtttctgtcatcagtaattgtgtgtgttattttatctctccaaatatctggttatctttgattgtgtatcaggaattctatttgaaaactgtgtctgtagaaataatttcaaggccttagataacccatcttcttccagatggaatttttgtcattgtttctgcaggcatctggggacattagcaatctaggaccactctaattcagtctcaggaactgtgattttccagggccacccacagtaccagtacttgaagtactagttccagtctctgagacagcaaatttattttcagttaaccctgattaccagggcctagttcttgtggcctcagaacacatcagaaggtattaccaggccttccatttggggcaggccctggacttccattgttgtcccttaacttcatgagaaaatcaaaagtctgttcagcctctcagttgccccgtcctgattcagctgcccattcccaaacaataagcagcccagktgccaagcccaaatacccagctctcaactggattctcatcttctcctagatcatggcccaggaatgcttcactagtttgttagctttctgatgctttaacagataaatatttttaattctccagtatttctagcctttcttgagggtggatggttggagcaatattttatttgaactgttgagattactattagtagaagcagagcctgaaaaatttttatttttaattttaattcattcatttctaaatttatccaattaaattcactcagttttaatttcaagtgttttgggatttgggttgaagaaattttgttctagtttatagcaacacagtatactatgtactactgctatactttaaaatgtatttaggggtttttgtggactaatatatgatcacttttacacagatatcatcttatgatatcaaacttagatttgatgaaatgagttggtaagcttcatrtcttttatatgttgtgaaaccttgaaattacatttggaagtatatttttgaatgaattttggtaatttgtatttccatttatatcatttagattttcaaaatatttaaccccctgtagtctacagttttataaatattctcatatacataaaaatatgyttaaattctttttcctactgtgtatatttgtgttttctctcatcccttatactttatcttttagcaaatgtttttgtattttatttttctaaaaaagctaaccttggttaataacaaaaatggaaattaagaaagcaaacggaaaagagtaggagaaaactgtrtaaatactataacactatgatcaaagagctatttaaaatgaaaagaatgtggattgagttaatacatgcatgcaaatactataggaaatcatatcagtaagaaaggcaggacacatcatattatgcccattgaagctacaactttataaaaatgtacctatgtgttagcaaagattaaaagcaaataatgaatgtaaaaatagctatagtttagtgactcatgagatttctgtcattcatwatttaaactgactgttatttatcctgctcttcctttttccaggaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacratcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccaggggtgagtctgactgaggcctagaagggccctgccagtgacatgcgttgctgttggatcaggagattagtatttgttcagggggagggatgtgtgctgagcagggtcgaggagcaaattttctaggtagtgaacatgaaattcagaaggtgtgtgtacatgcacatgtgctgaaattgcgaagcaaagctcaacctgggcaagggatatgatgtttctttggggttcttataaacagatctatcaattacctttgagtataataatggttgatacaaaatgagtgattcctctggccgggcactataatacaggctacatgtgaattttaatccttaaaacaaagttattaggtagttaccagttgttctatgtttgtctgtattgttttgcttgagatactgtcttgatctgtcactcacgttgaactgctgtggtgccatcatgacttacttcaacctccgcctctctggctcaagcaagtctcctgcctgagcctcccaagtagctgggaatataggtgcatgccaccatgcctggataagttttttatatattttttgtagggatagagtctcaccatgttgcccaggctggtctcgaactcctcagctcaagcaattcacccaccttggcctcccaaagtgctgggattataggcatgagccaccgtgcccggcctctatgttttayagagaatatgtgccttagacacatcagataacattctgagacagtaacttgcagacaaaactggattgcaagtccacctcactccagagccttggctttgctcatcagcattcagtcatgaaatcaaaacttactctagatactttcaaggagggagggatttcatgcaggttgtattagtctgttctcacattcctataaaaaactacttgagcctgggtaatttataaagaaaagatgcttacttgactcagagttctgtaggctgtacaggaggcatggctagggacccctcaggaaagttacaatcatggtggaaggtaaagaggaagcacgcatatcttcatatgcttggcaggagagagagagagagcaaggcagaggtgctacacactttggaacaagcagatctcgagagaactctatcacaagacagcactagggtgatggtgctcaaccatwagaaaccacctccatgatccagtcacttcccaccaggctccttctccaacactgggaattaccatttgacatgagatttgggaggggacatagagccaaaccatatcgcagctaataggtcacaaaaatgttagaagggcaggaaaagcaataggacaaaggcaaagttacgagagatcagggagctgctgtggctcccagtctacagcacaggagcctggagtgatggtgaaatggccagcccctcccactgagcaggcagctccctgtaagctgctagtgctgcaggagccaccactgctgccagaatgcagctgatattgctggagccaaagtcattggcatcgttacaattgaagctgtagctactcactgaagccatctatactgccactgcctgagccacttctagaagtagaacagattctgccatcatcctgctttttaatttggtatatatgcctccaattggcagaacctaaccagagcccagctatcaaggaagatgaacaattgtagttttaaggcttcctttgctagctgtcaaaagacagtgcagaagtgtgaggctgggggccaacagaaatttaaccagcacagcacctcaatattacatcaccaggcattgattagtccagggaaacactgggtgatgagccctgaaaatggacattacagcatcagagtatttacaaactccytaaagaagtcatttttctattccaatcccccatttgatgcttgagaaagctgaagtccagaaaagggaactgatctgctcaaagacaaaccgaaattattttttccattttataacagttttatgtaatttagttgagatccaaatgtgttctgatttcctgagttccaatcaactatattaagagagagccagcgctgcccttacaatatgttgcgtaaatatacactctcatcatggtgacagtaggtctttcagattttgttcgacagtttcccaccttctcactgaagtgaaatgaatgactaggcagcaccttgctacatagcatgaggagaggagacccatagttctttaccatcctatgtcaggtggccgctgagagaagacttgaaaggagatgagcatagatgtatggacgctctttgttgcaccagtgtgataggtgatggagggacctattagatgrgacatgggcaggggcactcctttattgcttaaaatgcaagactaaattggtgatgcctttctagaaaggaagtatgaagatacraaaatccatcattcctcccaattttgtactgggtgaacagtaattggaagcattctagaaggaactgtccattgtgaaatcttagttgcatactttagatgaaaaacaatgaattggagatacctctgttttagtcacagttgtgccacgtgtcagttctatgactgatggcaagacatcttccttgccctgtgtatttagtttatcaatgtaataaggctgttattctaactttattattatatatagattcgtaattattattcccttggccagtttaacagtgagaaaaaagttgttttcacacaattagctgtactttgtttctctctccccagtatgtcagccacctccagatgtcctgcatgctgagcgtacccaaagggacaaggacaacttttcaccygggcaggaagtgttctacagctgtgagcccggctacgacctcagaggggctgcgtctatgcgctgcacaccccagggagactggagccctgcagcccccacatgtgaaggtgactagactcttatctggcttgatatttttagcttgcgtctttattctccacatgccagtgatttctgttcatttttctttatctccagtgaaatcctgtgatgacttcatgggccaacttcttaatggccgtgtgctatttccagtaaatctccagcttggagcaaaagtggattttgtttgtgatgaagggtgagtatgagcttgcctgacctgctggacattgaaattggggttgggaatcagtctaaaaaggggagatttggtgtggcacacacacacacaccttcagagagatgaactttcgaaagtatacctaggaagaaaggaaagaaacatatagaactaataacatgagatatgaagaggaaactggaacatatattaactggcaagttcaaaggcaagtataactactggttatgaatatataagtaacacattaagcaaaaaatatcagccagaaacggtggctcacccctgtaatcctagcacctttgggaggttgaggcgggcagatcacctgaggtcaggagttggagaccagcctggacaacatgatgaaaccctgtctctactaaaaatacaaaagttagctgggtgtggtggcatgtgcctgtaatcccagctattccggaggctgaggcaccagaatcacttgaacctgggagatggagtttgcagtgagccgagatggcaccattgcactccagcgtggacaataagagtgaaactccatctcaggaaaaaaaatcatattttacaagcaaaaaggaatatgagtaatttagagagtcccaggaaaaaactggaagtaacaaaagcttattataaaaagctaggatcatttgtgaatcatttcagtaaattctttaaatcgtcaacagtgaaatttgtaataggactgaaaatgtaaaaatcagcattttttaaaaaaatccagccatatatcatctggttaatcatgggctctgggctctgagctggggtcctgatggctgctgttaatatttccrgcaagctcattaccttgtttatgtccacctagtgctcttcgcagggtgcacatctctacacgggagctgaccggcatgggcaacaaagcacctgatcccaaaatgtaacacagaatcttggcagcctccaaatgccagcacccagtaagagttaggagggcatcggggtccagcagacattgagaattttcgacaattgcatgcaraaaataagtcctctcttctttcctttttcccctagaatattcatgcttactcttcagcagcccaaattgcccttttgagccttcttcacgccatcacagatgtggagatgaaaggacagtctgttctctcgccagctatttcccacttttccactccaaactgggagctgttttacttgctgttccagggtcagagttaggaaggcattacattagaagactgggtttctaataacaacaatgagtgatttatcaggttatcatggagtaatcagtgaaactccaagcctgggtcctgggtcaaggggatggcgcctatgtcatgaccacctttttcagttcaagcaggactatcatgtgaccaagctactgcattttgccattctatattgttcccttctggaggctgtgatttttccagaataaggtagcctgtgcaactctgccacctgctggcctaaggtcctaataatcctgaaattggggctgggccttagattgtgaactaagggttctcttggctgaaacagctcacactattcactcctattttcttctttagatttcaattaaaaggcagctctgctagttactgtgtcttggctggaatggaaagcctttggaatagcagtgttccagtgtgtgaacgtgagtagcaggagtaacatttcaggccagtctctcccttcatctgttcagtatttgacccatgacctcccctaatgtggttcttcaattttctagtttgaattattgatttgaaaattgcttattttaataatgtttggttgtgaatcaaatgtatacatcacctgtctttggaaccatctgatctgtctctgtccttctgtattctgtgttctagtgcgataaatcctatggtagcatgattctaggtcaggagagattagataatgtgaagccttaacaatttgctttctttctctctttcttttgtttcttttttctcttccttcctttcttcagttctttcttcccttctctttctctcccctttcttccttccttcctccttctttcttttccattttgttcttccatcaggtgcagtctacaatttttgtatatatttgataatacacaaatattaaacatgcctttatttaatcaatatttattgatcacatactttgtgcctgatgttcatctagccacaggagttatatcagtgaacaagatgaatgaattccctgtccccatgttgtttccactcagttggggaaagggacaagaaaaaaaataaatacgatgctatgaagatagtagagcaaagcatttaggcatgagggaaaagtgaggagcaacattagacaaggcgagcagtttgagactccttaaattctcaaaacatgtacytaaataatttatgctgagagattcataaataatgtcatttttaaaaatttattatacttttaagttctagggtacatgtgcacaacgtgcaggtttgttacatatgtatacatgtgccatgttggtgtgctgcacccattaactcgtcatttacattaggtatatctcctaatgctatccctccccgcttcccccaccccacaacaggccccggtgtgtgatgttcccctttttgtgtccaagtgttctcactgttcaattcccacctatgagtgagaacatgtggtgtttggttttttgtccttgtgatagtttgctgagaatgatggtttccagcttcatccatgtccctaaaaaggacatgaactcatcaatttttatggctgcatagtattccatggtgtatatgtgccacattttcttaatccagtctatcattgatggacatttgggttggttccaagtctttgctattgtgaataatgcagcaataaacatatgtgtgcatgtgtctttatagcagcatgatttgtaatcctttgggtatatacccagtaatgggatcgctgggtcaaatggtatttctagttctagatctttgaggaatcaccacactgtcttccacaatggttgaactaggttacagtcccaccaacagtgtaaaaatgttcctatttctccacatcttctccagcacctgttgtttcctgactttttaatgatagccattctaactggtgtgagatggtatctcattgtggttttgatttgcatttctctgatggccagtgatgatgagcattttttcatgtgtctgttagctgcataaatgtcttcttttgagaagtgtctgttcatatccttcacccactttttgatggggttgtttttttcttttaaatttgtttgagttcattgtagattctggatattagccctttgtcagatgagtagattgcaaaaatgttctcccattctgtaggttgtctgttcactctgatggtagtttcttttgctgtgcagaagctctttagtttaattatatcccctttgtcaattttggcttttgttgccattgcttttggtgttttagacatgaagtccttgcccatgcctgtgtcctgaatggtattgcctatgttttcttctaggatttttatggttttaggtctaacatttatgtctttaatccatcttgaattaatttttgtatacagtgtaaggaagggatccagtttcagctttctacatatggctagccagttttcccagtaccatttattaaatagggaatcctttccccatttcttgtttttgtcaggtttgtcaaagatcagatggttgtagatgtgtagtattatttctgagggctctgttctgttgcattggtctatatctctgttttggtaccagtaccatgctgttttggttactgtagccttgtagtatagtttgaagtcaggtagtttgatgcctccagtttgttcttttggcttaggatagacttggcaatgcaggctttttaaataatgtcatttttaaaaaatgagccccatatgttcaataatgagtagactactgatttctcctagtctccccatttataatttccccaatagaagatagaactttgcttcatttcttgattctaatgattgggaaatgtgtttctttagaaaaccatgaaattttactaaaatgtttatgttgttagaaatggacatcttacagtgctttttagagtaaaattttggaagaacataacttatatagagattcttgctgtctaagaaattcagtgctccttgaagcagcatgacaaatttctgttctaccatcatgaatgaaagctcattgattggactactcaagctttctcttatttttcataactgttgctagttaaagtagcttcttccaaattccagttctaatgaaaaatgccaattagaaatgaggaagaaactgttctaaacaaatcagcagatgctagaaaggagaaacaacttgaaacctgacccagaaagttaaaagagaaaataaatcatcaacagacctagacattttcaaaagcaaagccatctgaatccatttggagttgttttttatcatggccttactatgttttaattcactgtgacagggctattgttatcactgagattgatgatcaatatcaagaagtaatcagcgaaaggtttcacctatttaagatgattagcacacatatgtacatttgagaaatatttcctaagaatgcaggctccttcctcagcactctgtccccaggatcctgatgagtggctgacacaggacaagtgcttaattaatatatattgactaaatgaatgagcaacccttcaaaatggctatttttctttttcaaatgttttgctacttcattaaagttgtaaagtttccattgtccaggaaccgttactatccggaagattcaggatagacaagtctcttttgtactttgcaatacactttcattgatatctcatttaatccaactcttcaaagtcctaatgtctactgtcatctccttagcatattttcagcaacaccaatcatagcaccctgtaattgcagaatacctctggtgaaactcctgaatgaaacttagagctttyrtrttttttctagaaatcttttgtccaagtcctccagttattcctaatgggagacacacaggaaaacctctggaagtctttccctttggraaarcagtaaattacacatgcgacccccacccagacagagggacgagcttcgacctcattggagagagcaccatccgctgcacaagtgaccctcaagggaatggggtttggagcagccctgcccctcgctgtggaattctgggttagtgctcatttccccacatcccaaatgggttcagaatatctaacccaggccctccatatttccgtaattacaatgtggtatttatttgtgcatttgccacaatggaatgccaaaccaatgatagatggttctaaggtaggtcaacacataagatcctkatgacctttgcagatggagggactgatgaaaaaagagggaggcggtgagtggtgggaaagtccttcattagaatcatatgaattaaaaacagatgcctgtgaatctccttattgaaatgtttggtttagaaatctgacctagaaaatcggtggctccttctgccaggaaacgtcttgagttcccgcccatgcttgacagcctctcattggagttttgatgacttgaagtacaaggaaaccagacaggaaaggtggaacctgggcagaaaaactctttctggcttcctaaaaatgtgaaaaattaaatgggagctatctttacattaaattatatgagcattagctgagcgtggtggcaattgcctgtggtcccagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaggagaaattagagcagaaatatctctttcaatagtgagagaataggaaaaagaagtagaaaagctgggaacaataggtaaagtttaggctaggccttagacttctcctgcattgtaatccctctggtttgccacatatgcatgctgtcaggaagttgatgaggtatgtacagcacaatttattttccattttttgcctttaggcaccgactcattggtcactcatctgctgaatgtatcctctcgggcaatgctgcccattggagcacgaagccgccaatttgtcaacgtgagttgaaatctctttccccattcaccccaccgtttaatcctagagttgtcctcctagaattacaaagaatggatctcatccctcttggaaatggtatccttctcatatttgaagaatccagtcatatccttaaaatggctcacagcattccaaacttccaccttcagctagaaatgcttttttattttttcttatctcaaggtctaattttttttaaactagtctttagctcacttaaacagtcccccaatttcatcctctgttgggtgaacacctcccagtttaaagagcattttatttagtgaagtcaacaaatacaaagtcagtgaaagaaaccccatatcctctctgcaagctcttagtatcacatcagatattcaagccatgcagctctttcttccttcttattctttgtctaaacaggatcatgccatcttccctgtgagttgtttggaagatgagctttctacattttggggagcaaagacgaatgagcaattgcaagctaacaaggaatataaaatgtgtataatcctgggtttagtgatggtgtgaggaaatcagcaatttcaaacccagttggtgggaggataagtgggaacaaactttgtagaaggccaataaactggctgggcactgccctacggtagagtaggacacagtattcagttcttccaagatcagacgagattgggcgcatttagggtggtatggttgtagatcagtatccagttctttttattatttctgaatctgtaagtatcatgtttattatatgtaatattrtatatttgtactttgtctttgttagttcttccagagcttttgttcttattatttaataaagatgttatactgagccacatgtggtgactcaaacgtgtaatcccagcactttgggaggcctaggtgagcagatggcttgagtccaggagtttgagaccagcctgtacaacatactgaaacgctgtctctacaaaaatacaaaaactatacgggcatggtggcacatgcctgtagtcccaactactcaggagactgagaggtgggaggattgcttgagccagagaggtcgaggctgcaatgagccatgatcgtgccactgcactccagtctgggcagcagagcaagaccttgtctcaaaaaaaatgctatgctgtatgctttattatattaatatccaatagaataaagacacatgccttctatatagagagaactaaattaataatggtgagataacagttaaattctcatttagcaggagaaataaaaacatagactataggctaggcacagtggctcatacctgtaatcccagcacattaggaggctgaggtgggcagatcacttgaggtcagtagtttgagaccaccctggccaacataatgaaaccccgcctctactaaaaatacaaaagttagccgagtttggtggcrcatgcctgaaatcccagctactcaggaggctgaggcaggaaaatcgcttgaacctgggaggcaagggctgcagtgagccaagatcacgccactgcactccagcctggggaacagagtgaggatctgttaaaaaaaaaaaaaaaaagtggactctaataatacatggacacatttagtgaaataaacttaactgagtagagcagaacttataatattttaaaactgtaagaacatgtctgtacmttagcaaatagtagatgagaatagtattttcaatatttacttctggtaatttggaattaaaaaaaaaacttttgggaaaatttacaataaagtatgattttaacaaaccagkctaggcgtggtggctcacgcttataatcccagcactttgaaaagcagaggcatgcagattgcttgaggccaggagttcaagactagcctgcccaacatggccaaaccccatctctactaaaaatacaaaaataaaccagacatggtagtgcatgcctgtgatcccagctactcgggaagttgaggtaggaggattgcttgacctgggaagtggaggttgcagtgagccatgatcgtgccactacactccagcctgggtgacagagcaagactctgtcccaaggttttgtyttggttaacttgctgtccctttttccaggaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattayacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccaggggtgagtctgactgaggcctagtagggccctgcaagtgacatgcgttgctgttggatcaggagattagtatttgttcacggggagggatgtgtgctgagcagggtcgaggagcaaattttctaagtagtgaacatgaaattcaggtgtgtagacatgcacatgtgctgaaattgcgaagcaaagctcaacctgggcaagggatatgatgtttctttggggttcttataaacagatctatcaattacctttgagtataataatgkttgatacaaaatgagtgattcctctgcccaggcactataatacaggctacatgtgaattttaatcctkaaaacaaagttattaggtagttcccagttgttctatgtttgtctgttttgttttgcttgagatactgtcttgatctgtcactcaggttggactgcagtggtgccatcatggcatacttcaccctccacctccctgactcaagcaagtctcctgcctgagcctcccaagtagctgggaatgtaggtgcatgccaccatgcctggctaagttttttatattttttttgtagggacagagtctcaccatgctgcccaggctggtctcaaactcctcagctcaagcacccacccaccttgggctcccaaagtgctgggattataggcatgagccactgtgcccggcctctatgttttacagagaatatgtgccttagacacatcagataacattctgagacagtaacttgcagacaaaactggattgcaagtccacctcactccagagccttggctttgctcatcagcattcagtcatgaaatcaaaacttactctagatactttcaaggagggagggatttcatgcaggttgtattagtctgttctcacattcctataaaaaactacttgagcctgggtaatttataaagaaaagatgtttaattgactcagagttctgtaggctgtacaggaggcatggctgggaaagttacaatcatggtggaaggcaaagaggaagcacgcatatcttcatatgcttggcaggagagagagagagagcaaggcagaggtgttacagactttgaaacaagcagatcttgacagaactctatcacaagacagcactagggtgatggtgctcaaccattagaaaccacctccatgatccagtcacctcccaccaggctccttctccaacactgggaattaccatttgacatgagatttgggaggggacatagagccaaaccatatcgcagctaataggtcacaaaaatgttagaagggcaggaaaagcaataggacaaaggcaaagttacgagagatcagggagctgctgtggctcccagtctacagcacaggagcctggagtgatggtgaaatggccagcccctcccactgagcaggcagctccctgtaagctgctaatactgcaggagccaccattgctgccagaatgcagctgatattgctggagccaaagtcattggcatcgttacaattgaagctgtagctactcactgaagccatctatactgccactgcctgagccacttctagaagtagaacagattctgccatcatcctgctttttaatttggtatatatgcctccaattggcagaacctaaccagagccyagctatcaaggaagatgaacgatttatttttaaggcctccattgttagctgtcaaaagacagtgcagaagtgtgaggctgggggccaacagaaatttaaccagcacagcacctcaatattacatcaccaggcattgattagtccagggaaacactgggtgatgagccctgaaaatggacattacagcatcagagtatttacaaactccytaaagaagtcatttttctattccaatcccccatttgatgcttgagaaagctgaagtccagaaaagggaactgatctgctcaaagacaaactgaaattactttttccattttataacagttttatgtaatttatttgagatccaaatgtgttttgatttcccaagatcagatcaactayattaagagagagcctgagmtgccgttacaatatgttgtgtgaaattacactctcatyatggtgacagtaggtctttcagattttgttcgacagtttcccaccttctcactgaagtgaaatgaatgactaggcagcaccttgctacatagcatgaagagaggagacccatagttctttaccaccctatgtcaggtggccgctgagagaagacttgaaaggagatgagcatagatgtatggacgctctttgttgcaccagtgtgataggtgatggagggacctattagatgggacatgggcaggggcactcctttattgcttaaaatgcaagactaaattggtgatgcctttctagaaaggaagtatgaagatacaaaaatccatcattcctcccaattttgtactgggtgaacagtaattggaagcattctagaaggaactgtccattgtgaaatcttagttgcatactttagatgaaaaacaatgaattggagatacctctgttttagtcacagttgtgccatgtgtcagttctatgactgatggcaagacatcttccttgccccgtgtatttagtttatcaatgtaataaggctgttattctaactttattattatatatagattcgtaattattattcccttggccagtttaacagtgagaaaaaagttgttttcacacaattagctgtactttgtttctctctccccagtatgtcagccacctccagatgtcctgcatgctgagcgtacccaaagggacaaggacaacttttcacccgggcaggaagtgttctacagctgtgagcccggctacgacctcagaggggctgcgtctatgcgctgcacaccccagggagactggagccctgcagcccccacatgtgaaggtgactagactcttatctggcttgatatttttagcttgcgtctttattctccacatgccagtgatttctgttcatttttctttatctccagtgaaatcctgtgatgacttcatgggccaacttcttaatggccgtgtgctatttccagtaaatctccagcttggagcaaaagtggattttgtttgtgatgaagggtgagtatgagcttgcctgacctgctggacattgaaattggggttgggaatcagtctaaaaaggggagatttggtgtggcacacacacacacaccttcagagagatgaactttcgaaagtatacctaggaagaaaggaaagaaacatatagaactaataacatgagatatgaagaggaaactggaacatatattaactggcaagttcaaaggcaagtataactagtggttatgaatatataggtaacacattaagcaaaaaatatcagccagamacggtggctcacgtgtgtaatcccagcacctttgggaggttgaggcaggcagatcacctgaggtcaggagttggagaccagcctggacaacatggtgaaaccctgtctctactaaaaatacaaaagttagctgggtttggtggcatgtgcctgtaatcccagctactccggaggctgaggcaccagaatcacttgaacctgggaggcggagtttgcagtgagccgagatggcaccattgcactccagcgtgaacaatgagtgaaactccatctcaggaaaaaaatcatattttacaagcaaaagggaatatgagtaatttagagagtcccaggaaaaattgcaagtaatgaaaagcttattattaaaagctaggatcctttaagaatcatttcagtaaattctttaaaccatcaacagtgaaatttgtaataggactgaaaatgtaaaaatcagcatttttttaaaaattcagtcatatatcttctggctagtcatgggctctgggctctgagctggggtcgtgatggctgctgttaatattcccagcaaggtcattaccttgtttatgtccatctagtgctcttcacagcgtgcacatctctacacaggagctgaccggcatgggcaacaaagcacctgatcccataatgtaacacagaatcttggcagcctccaaatgccagcacccagtaagagttaggagggcatcagggtccaaaagactgagaattttcgacaattgcatacaaaaatcatgtcctctcttctttcctttttcccctagaatattcatgcttactcttcagcagcccaaactgcccttttgagccttcttcacgccatcacagatgtggagatgaaaggacaatctctgttctctcgccagctatttcccacttttccactccaaactgggagctgttttacttgctgttccagggtcagagttaggaaggcattacattagaagactgggtttctaataacaacaatgagtgatttatcaggttatcatggagtaatcagtgaaactccaagcctgggtcctgggtcaaggggatggcgcctatgtcatgaccacctttttcaattcaagcaggactatcatgtgaccaagctactacattttgccattctatattgttcccttctggaggctgtgatttttccagaataaggtagcctgtgcaactctgccatctgctggcctcagatcctcaaaatcctgaaattggggctgggccttagattgtgarctaagtgtcctcttggctgaaacagctcactattcactcctattttcttctttagatttcaattaaaaggcagctctgctagttattgtgtcttggctggaatggaaagcctttggaatagcagtgttccagtgtgtgaacgtgagtaataggagcaacatttcaggccaatctctccccttcatctgttcactatttgtcctatggcctccctcaatgtgattcttcaatattctagtcttaattatcgatttaaaaatagtttattttaataatgtttggttgtgaatcaatatgtacatcacctgtctttgcaaccatctgatctgtctctgtccttctgcattctctgttctagtgcgataaatcctttggtcttgtgctcctaggtcaggagagattagataatgtgaagctttaacaattttctttctttctctagttttttctttcttttttctcttccttccatccttcagttctttcttcccttcttctctccttctcccctttcttctttccttcctcccttctttctttttcattttgttctcccatcaaagtgcagtcagtctacaatttatatatatatgataatacacaaatattgaacatggctttatttaatcaatatttattgatcacatactttgtgcctgatgttcatctagccactggagttatatcaatgaacaagatggatgaattccctgtccccatgttgtttctacttaggtggggagagggacaagaaaaaaaataaattcaatgctatgagacaatagagcaaagcactgaggaatgaggcaaaaatggggagcaacattagacagggtgagcagtttgagactccttaaattctcaaaacatgtacctaaataatttatgctgagagattcataaataataagtcatttttttwaaatgagcctcatatgttcaataatcagtagactactgatttctcctagtctacccatgtataatttccccaatggaagatagaactttgcttcaattcttgattctaatgattggaaaacgtgtttctttagaaaatcatgaaattttactaaaatgtttatgttgttagaaatatacttggacatcttacagtgatttttagagtaaaattttggaagaacataacttatatagagattcttgctgtctaagaaatccagtgctccttgaagcagtatgacaagtgtctgttctactatcatgaatgaaagctcattaactggactactcaagctttctcttatttttcataactcttgctagttaaaatagtttcttccaaatgccagttctaatgaaaaatgccaattagaaatgaggaagagactgttctaaacaaatcattagatgctagaaaggagtaacaacttgaaacctgacccagagagtaaaaagagaaaataaatcatcaacagacctagacattttcaaaagcaaagccatctgaatccatttggagttttttttttttttttatcatggcctgaytatgtttcaattcactgtgacagggctattgttatcactgagattgatgatcaatatcaataagtaatcagtgaaaggtttcacctatttaagatgattagcacacatatatacatttgagaaatatttcctaagaatgtaggctccttcctcagcgctgtgtccccaggatcctgatgaagggctgacacaggataagtgctcaattaatatatattgactaaatgawtaaataacccttcaaaatggttatttttcttcttcaaatgttttgctacttcattaaagttgtaaagtttctactgtccaggaactgttactatccggaagattcaggatagacaaatctcttttgtactttgcaatacattttcattgacatctcatttaatccaactcttcaaagtcctaatgtctactgtcatctccttagcatattttcagcaacaccaatcatagcaccctgtaattgcagaatacctctggtgaaactcctgaatgaaacttagagcttttgtatgttttctagaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggttagtgctcatttccccacatccctaatgggttcagaatatctaacccagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatttgttgtgatatgtgttttattgtggtggtctggaactgaacctgcaatatatttgaggaatgtctgtaacacgaagtgggcggcttaatacaacagaagtttttggagttccattctagagactggaaatccaaaatcaaggttttgggagggccacgctccctctgaatcctgtagggaaggatccttcattgcatcttccagcttctggagccacaggccttccttggcatgtggcagcagaactccaatttctgtctctgtcctcatatggccatcttccctctgggtctgtgtcctcatatgctgttctctctgtgcatgtctgtttccaaagttttcccttttaataaggacaccagtcacactggattagggcctacyttcatgacctcaccttaacttgattgcgtctgcaaagatygtatttccaaataagrtcacatccacagggactggaggttaagacttcagcatacttggggggagacacaattcaacctataacagagcccctttgaaaatgtcaggcatcaggtgctcacagcacacggtccagctgttggtgctcacccttgctcagcacacggtggaggctctgcctcaatctcattcttcatgggaacagctaagccaggtagcgaatacgggttatgtttgtgtcaccacaacagacactgaaaggaagtttgtggtgtccagcacayttgccagcataggcctcacagaccacagcacctagaatctgacaaaaattagaataaatccgatgtctccttttctctcttttttttaagcatttttaaatrcaattggtaaatttcctgactgtaccctmctcatcttgcattgctgaataagtgaggaacctctctatggcatgaagcagaaaaccmttgagcttatgagaagaaacaggaaatacatgtaaaagagaccagtctgaaaaatcaggagaaattttacaaaagagatttactgccaagaaaccagggaaactttcagaacactctccttttcatatttgtaacaagwttcaattgtacaaatacttctgtgaaactagccatgaagtgtgtacatgaatgaatatatgtattcagtgtgtttatatatttcatttcatacatgtgatctatatcatatatatatatcacaatgaatattgcagaaaattaaagcaaagagtaagaagagttaaccaaatgttccctgaatgcagtgagaaaagatgaaaaggagaagacaggcaagcacagtggctcacatatgtaatcccaacacactgagaggctgaggcaagagtatcacttgagcccaggagctcaagaccagcctagacaacatgrcaaaaacccatctctacaaaaaagtataaaaattagctgggcatggcagcatatgcctgtagtcacagctaggcaggagactaaagtgggaggatcacctgagcccaggaggctgaggcttcagtgagccttgatggcaacctgcactccagcctggatgacagaatgagaccctgtctcaaaaaaggaaaaagagaagacatatgtaacacagtgtcaggattcaaaatacatgtagcaaaaattccagaagggtaagcaaataagcccatacctagccatcactagggaaacttctgtgtttcagggatagagaaaaaaactctgattccagaaataaaatgtgaaaatataatacccgcaaaagaaataagtttattgacaccacattgattctatacaacactaaattgtagaagatagcatttctcttgagccaagctaatattcacacctagaggctccagatacacattaaaggataagaaagacacaaaaattgtaccatttaagtatgtttcccaggtaattcataagcaaatttttaaaaaggagaatgatgaattccaaaggaaatctcaatgagataggatattggtaaaaagaaaaaacaacaataaaaaaatacacacaaaaactcggcaatgtaatcataatttactaataatctctctaaactcatagaacrtatcaataaaactagaaaatgtgagacagcaagaaaaggtaggctaaacttacattacagaaaagatgagtagactgactatatagagtttgactctaaaattgagaaaataggtttaaatakctgttgtgtgcatatccatgtgtgtaatatacatgyacatatataaaatgaaattcctcattagaaaaaataataagtttaatttccaaattattagaataactaaaacagctgaatctatctcttccatatagcaagtgagagggaaagaaaaggaaagacaaggaatgcatttgtctcttccaccagaaataagccccctcatttttgggtcaggtcattttattcattgctttctccacatcctcatcattgggcatcatgaaatcaatgaaaaaggcagtgaaagaatgatgatgaaagcaaatcaaatgtatcatttatctcaatacatttggtttaatcctcttgttgaaaaacaaagtctcttagacaagatcaaaagcaacaaatcttgtatttataaaaaacatgtctcaagtaaaatgacatagtattatacacacacacacacacacacacacacacacmcaaattaagtgaaaatgcaaacaaaaaaaggcaaaaataatatttagagaaagatagaatttaagaaaaaaattgtcaaactggtctacaaaataattgttttattttcgtgccagttgcagtccacagtgaagccaagatattaagaagcaatgtgggccaggagaagttagagcagaaatatctctttcaataatgaaagaataagaaaaagaartagaagagctggaaacaataggtaaagtttaggctaggccttagacttctcctgcattgtaatccttctggtttgccacatatgcatgctgtcaggaagttgatgaggtatgtacaggacaatgattttccattttttgcctttaggcaccgactcattggtcactcatctgctgaatgtatcctctcaggcaatactgcccattggagcacgaagccgccaatttgtcaacgtgagttgaaatctctttccccattcaccccaccattgaatcctagagttgtcctcctagaattacaaagaatggatctcatccctcttggaaatggtatccttctsatatttgaagaatctagtcatatccttaaaatggctcacagcattccaaacttccrccttcacctagaaatgcttttttttttcttatctcagtctaatgtattttaaactagtctttagctcatttaaccagcccccaatgtcctcttctgttggttgagcacctcgcagtttgaagagcattttgtttagtgaagtcaacaaatacaaagtcagtgaaagaaaccccatatcctctctgcaagctcttagtatcacatcagatattcaagccatgcagctctttcttccttcttattctttgtctaaacaggatcatgccatcttccctgtgagttgtttggaagatgagctttctacattttggggagcaaagacgaatgagcaattgcaagctaacagggaatataaaatgtgtataatcctgggtttagtgatggtgtgaggaaatcagcaatttcaaacccagttggtggcaggataagtgggaacaaactttgtagaaggccaataaactggctgggcactgccctacagtagagtaggacacagtattcagttcttccaagatcagacgagattgggcgcattcagggtggtatggctgtaaatcagtatccagttctttttattacttctgaatctgtaagtatcatgtttattatatgtaatattrtatatttgtgctttgtctttattagttcttccagagcttttgttcttattatttaataaagatgttatactgagccacgtgtggtgactcaaacttgtaatcccagcactttgggaggcctaggtgagcagatggctttagcccaggagtttgagaccagcctgtacaacatggtgaaatcatgtctctacaaaaaatacaaaaactaaacaggcacggtggcacatgcctgtagtcccaactactcgggagactgagaggtgggaggattgcttgagccagagaggtcgaggctgcaatgagccatgatcgtgccactgcactccagcccgggcagcagagccagaccttgtctcaaaaaaaaatgctatgctgtatgctttattatattaatatccaataccataaaggcaaatgccttctatatagagagaactagattaataatggtgagataacatagttaaattctcgtttagcaggagaaataaaaacatagactataggctaggcacagtggctcatgcctgtactcccagcacattaggaggctgaggtgggcagatcacttgaggtcaggagttcgagaccagcctggccaacatggtgaaaccccatctctactaaaaatacaaaagttagccgagtttggtggcgcatgcctgtaatcccagctactcaggaggctgaggcaggaaaatcgcttgaacctgggaggcgggggttgcagtgagctgagatcacgccactgcactccagygtggggaacagagtgaggatctgttaaaacaaacaaacaaacaaamaaaaaacacatggactctaataatacatggatacatttagtgaaataaggttaactgagtagagcagcactcataacattttaaaactataagaacatgtctgtacattagcaaatattagatgagaataatattgtcaatatttacttctggtaatttgaaattaaaaaacaaaactgttagcaaaatttacaataaagtataattattagaaaccaggctgggcacggtggctcacgcttataatcccagcactttgaaaggccgaggcaggcggattgtttgaggccaggagttcaagactagcctgcccaacatggccaaaccccatctctactaaaaatacaaaaataaaccagacatggtggtgcatgcctgtgatcccagctactcgggaggttgaggtgggaggattgcttgacctgggaagtagaggttgcagttagccatgattgtgccactgcactccagcctgggtgacagcaagactctgtcccaaggttttgttttggttaacttgctgtctcttttccaggaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccrccgtgtgaagtgccaggccctgaacaaatgggagccagagttaccaagctgctccaggggtgagtctgactgatgcctagaagggccctgccagtgacatgtgttgctgttggatcaggagatgagtatttgttaagggggaggtatgtatggtgaggagggtgggaaagtaagttttgggggaagaagcatgaaattaagaattgggggtgtgcatgcacccatgcatatgtgtcttcatttggaaagcaagaccttaattagccaagaaaaaagctattttggactcacctattatttgattctcagggcaaagtaccagctgcaatctctctcaagtatattgaaaaattatatggactttctctatgatcagctatgtgctaagcactttatatgcattttctcattcattatttacaacaacactttgaaattgtgctattgtattatccatttaatagtgacatcagcttgatctttcagaggttaaataaattagctaagtcacatgttctaagcgagacacccaggattttaaaatgcaagtgtatcagaccccagagtctgaatgttttggctcttgccatactttcatcagtatccattgctgaaagaaagagactggcttacaaagacagaaatcatagcctcagaatagacaaagaccttagagtttgtctataatggtctgcctcctacattttattttgattttattttatttaaaaactatttattagagttgaygtcccactctgttgcccaggctgaagtacagtgatacaatcatggctcactgcagcctcagattcctaggctcaagccatccacgtcctacattttatccctaggagtctaagtcaagagtgaaagtaacttgttcaaagtcagttaaatatttctaaattcatgtttaatgaggtatagattaggttgatgttaaaatgggttctgatgccctaagcatgaacgaacaggactataaataaaggcagatgttgagtcaaatactctccaaataatatgccctctcgtgacaaaggactgtcttatttaakggcttgtgtttttgatggctcatcttgtctactgatgccacaatagctggcttagcagctgtgtaggaggtgttatggttgatacatagggacagagaaggagcttacgattcttctaccaacccatgttagccttgtgcaaccactgagctgggaagatgaacagataaagggatataaagacggatgtactgaggcaggagatgggcagggcttgtgttctggtcacaatcctgctgaccaaaacaggctctggcccagacaggatgaagtgaaaaaacagcaggaaccagcagatggcgatgaaagcaattgctagctgccctcatagtcccatcagcaccatgacagtttacaaatgccatggcaacgacctagaagttaccgcccctttcctggaaagttctaaataactcgcccctcaatctgcattgatccaytccttaatttacatgtaacygaaatgggtttacagcagtataaacacagttgcctgccaggaacccttatgttgctgactctgggtgtgctgcctgtgagttagccctgctctgcaagaagcagtgcctttcactaacagattgctgtctagcaccactggctcatccttgaattctgtcctggatgaggcaagaacccttccagagtaagccccaatttaggggcatgcctgtcccgaaacagtatgactgtactttagtcattggtgtgcaatcagagaaatygggggaaatctgtaaaacagatttggtctcaggtgacagtctcattacctgaataacaatggtacaaatygggattaccttcctaggaaatatgtagatggagaatccaccaatactgataacttcacattggatagccagagctaggagaaaatacctcatgccctgtagatttacaagtgaatttggggccttgtgctagggagaattgggttctatttctctacctctgactagctatgaggtcttcaggaagcataggaaattcccccataactaacaagtactctggaactgtcctttccacagtgtgtcagccgcctccagaaatcctgcatggtgagcrtaccccaagccatcaggacaacttttcacctgggcaggaagtgttctacagctgtgagcctggctatgacctcagaggggctgcgtctctgcactgcacaccccagggagactggagccctgaagccccgagatgtgcaggtgcctcaactctctggcttccagatttctctctttaccccacacatggaggtcttactcctattttttcttttttttttttttcttcttctagtgaaatcctgtgatgacttcttgggtcaactccctcatggccgtgtgctatttccacttaatctccagcttggggcaaaggtgtcctttgtctgtgatgaagggtaagtgtgacccagaattcagatcagggactcagcactgcagagtgactcttgagcttaaggatcaatccaaaaagagggctgacctaggagaagaagaatccagggagattaacctctggaagtgtagctttaaaataaaggtagggactaagtggcactactatcaggagataaagagataaagaaaaaatggcgcatataactgagtgtcaagtacaaacagaaatacagtcaccagtccagaaaaggggaccaacctggtggaaaagaagtactagaggagactaatatctgaaacaatgattggaaagtgtggtatgaaccagctggatccatgaacagaagtttaaaaagcaaaaagctcaactcatttgatttctcacttatagaggctcagaagtaaaatcattttggaaaacgtgcagcttccagtaaggcacaaaggaaaaacaatggccgaaatacaaaagatcttgaaaaaaaaagtgtgtatatatatgtatacatacgtatacatatggacacgtatatgtatacgtatacatgtacatgtgtatacatatgtgtatacatggacacgtatatgtakacgtatacatatggacacgtatatgtakacgtatacatatggacacgtatatgtakacgtatacatatggacacgtatatgtatacgtatacatatggacacgtatatgtatacgtatacatgtacatgtgtatatgtatacgtatacrtgtccatatgtatacgtatatgtatacatatgtatatatacatatgtatatacatatatatggaacatatgtatatatacatatgtatatacatatatacatggaacattagatgtatgaataaataataatttgcagacatgaagagataaataaatattctaggggttgttaagaaaagtttgatatataagagaaagttgtatataagataaaataacatgcaaagattatttcacaaaacttttaatcaaataaatagtggaatttggaataggaacgaaagagtaagtagaaatattctaaattccaattacatgtgattgacagctctgccagctattattgctttgtcctcactgaaagctacactttttccaaaatgatttggcttctgagcccgtcaatgagaaactaagtgagttgagtgttttcacctgtgctttagcttgagcagtaaaatgttaattaacttaggaattctcagggaggaggttgagatctgtcacgaagggaagagagaaatggtgcattcatccagccactactgctttgttctttaggtttcgcttaaagggcagttccgttagtcattgtgtcttggttggaatgagaagcctttggaataacagtgttcctgtgtgtgaacgtgagtagatggaatacttgttcagtctggatctttctgtttttttcttaatatagtttgccccatgggattatctattgtttgtcccgctgtttgtgcccgcttttgatagaaattgttctttgttggaatagatacaagcaatgttttgggraaaaataaacatgagaatcatgtgttttgggtaccatcctataaatatttatgaggagagtctgtgctataaatagagagaaatgcttcatagaaataaatgtatggcaagatgctaggctaaatttttctcttctttcctgtcaaaagtaatagtcatacttcaacttttcagttcttccctcaatcatccatttagtcatatactcattctttcaacagaaaattatttgagcacctactatgtgccaagcaatcttctgggaactggggatatacctataaacaagacagataagtccatgtttaagtttttgtgcaaggataaagacaaaaatcaaagacatgaatagaaatgttcaaatgatactaagtgttattaagaaaatgctcttaattgagtcagtgctgtcaattgagaatgtagctgaggacccaaaaggcaagtgtagcccagcaaacctctgggtgtagctgagggttcaaaatgggaggctgttgcagcaatctaatcagagatgttggcccaggatagcaattgggaaaggtgatgatgagaagtgatcaaattctggatatattttgaaggtgcagatgacaggatttggtgatggttagcttagatagagggtgtgaaagaaagagaagaaacatagccagtttccaggtttttggccagagcaaccgccagggtagaatttcccttagctgaaatgcaggggactgcatgaagtttgggaatgggggaaatcaaaagttaagcttgggacataactttagtgttcctcttagatatccagatggatatgttggagagtcccaggctgcccatagatakgtagaagccatcattgtatctgctatgcttgaaatcaggactgaaagagatcttcacctagggagtgagtgctgctagagaacagatgcatggactgagcctggatgtccaggattaagagttgcaaaggtgagaaggaatcagcaaaggggattatgatgaagcagccactgcagtaagagaaaacacaggagggtgaggtgccctggaagccaagtatggaaattattttaagggattagactaatcaactgtgtcaaattctatagagaggtcaaattaggtgagaacagaaaattgatctttgggtttagcaacttggaggtaacaagtggaagtttcagtggagtgctggcaaacactgattggaatgaattctagggagaatgaatgggaggaactgtaacagatcatagacaatattttagaggagttttcatgtaaagagagtagaaataggactatagctgaagagggaaatgacagcaagaggtttgcttttgatttttaagagggcagaaaatagtgtgttaaaaacagaaacactactatgtcccatctatccatttacttcttcactaaatcaatcagggtattgcttccccttctgatcatagctattaaaaatacatgtttacaatagaattttgctcatatgaatactttgccttaaatcatttcaatgtcttgtattgatttatatgatgaaaatgataatttcatcttacattgttggaagtcagctatttgacaatcttaacttccctggaatagttaagaagtatgaaagaaaagaaaaagaaaataccctcatgaacccaacatatacctgaaatcgcttactagagtgtaaacattggttaagctattttaacctttgattagtttatctatarttcttttaagctgtaatatcctcttcccaaattcaaagcaaattagaaaagggaaggagtgtccccaaatagaggcattccaaggaataaatgtgtttctttaatgaaaaaaataaataaataaacccttaaaaaccaatgagtatctcaaaaaaccgtaacattcttgagccttttgaaacacatacaggagtacatagcatttttttttcattgtgacagcattactgcaatctttcatctgtattttgaaaatcatagcctggcatcatcaagaaaaattaaatcactgatatacaaataataaatgtataatatattttagaaagatgtctctaggatgaagactcttgatgtcaaagatcatatttatcctgtgctttaaacagtacttgacatacagcagatattcaaaaacatgcttgttgaattaatggatgattcccctttaatgtgactgtgaagatttttatttactttaaaggaatatactctttattattcagaaatattaactatctgaaaaatttaggatgcttaatttgggaaaggcttttgtaataaacattgatttagttgtcatttcatttagctccatcttagcagaggcctaatacatttattttgcagtttctactttccttaagaagaaaagtacgcttaattggcaacacagtcacagtatgacaactgtagaatcrccttggattatactttaaaattttttatggaattgagagctcttgttttctttctagatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcagtatccrcttccacatatcctaaatgggttcagaatatgtggacccaatccctcatgtttctgtaataagactatggtatttgtttgtgagcttaactttgtcataagtgtaaatgtcaaaattacataccatagctaaaacagatgggtttcagcagcgccaaggtatgtttgaatctataagatgaaaactcttcttgctggtggagtggaagagggtgggaaaaagggactgagggaggggtggagggaaggcagtaaggcacagttatgtaaatcaggaagaaaaatgtattcactggagacgacatgaaaacawctgcctctgaacactaaccagtatctgtataattgacagtctccataagttcatgaggggtacatgggcatgcaaagttcaaaattggaaatgtggatattatttagctaaggttttaaactagtgttctgctgcatgggctaagtaaccaaaaagactctctttgtcttgacttaaagtttgtccacttgtcatcttgcctccaggctgtcttaatctttgtacttgaactgttccactcagggggtaagaagcaaggaaagagtagcscaaagaaaagagtaggaaaaggaagaggctatttcttcctaaggaggggaagaagttgcctggtccttcagggcaaacattaggccttttccagagcagaaactggagtagattagggatgtggcaccagccttggaatattccattatccacagggaagccctgagagacaagagccagccaaggtgaaaagactaaacctgatgaaaggcatttaacctttctttgacctttactctccaactgagtggtacccatcagaatgcagtaaatttttttaatgtaaatgcctagaccccagtgcaggcttaatgaacagatggaggaagccttctccaaaaaggaggtaatggagttcagactctatttgaaaatatgcagcacatggctgggcacagtagctcacacctataatcccagcactttggaggccgaggtgagaggattgtttgaggccaggagttcaagaccaacctggccaacacagcaagctcctaactctacaaaaaataagactgaaaaattgtaaaaactgtaaaacaaaaaaagtaaaaatatgcagcacacaatatactctctcagaaagaagacatagcttcttacagaaggctgatggcttagtctgttttgttctggttctttttttgttttgttttgtgtgtgtgtgtgtgtgtgtgtgctttttttgagagagagggtcttactcttttgcccaggtggagtagagtggtgcaatcatagtttactgcagccttgacctccctggctcaagcaagcctcccatctcagcctgccaagtaggtgggaccacaggtgcatgccaccacacccagctaattcttgtattttatgtagaccggttttcatcatgttgcccaggctggtcttgaactcctgggctaaagcaatccacctgccttggcctcccaaagtgctgggactacaaggcgtgagccaccatgcccagcctattttgttctatctttaaatgcctggtttagcatcagaagaaaaacactgtattagtttcctagggctgctgtaacaaattaccacaaactaggtggcttaaaacaaaagaaacttattatttcacagttttgtaggctgaaattgagatgttggcagaggtattttcccatcttctaaggctctggaaaataaccaattctttacttcttccatctgctgctggttcctgggattccttggcattccttggtttgtggatgcatcattcaaatccctgcctccatcatagccttttcccctgtgtctctatatgtcaaatccctccactttttccctgatagggacaccagtcattggatttagggcccactctaaataaaagatgatctaatctcaagaacctaatcttaattctatctgaaaaaccattattccaaataagtttctattctgaggttttaggtagagatatcttttgggagaacatcattcaactcactacaaggggtacctgctatgaaaggccagagaggcagcttatgatgggcaccctgagaatggagtatggagagagatgataaaatatgtcttgctactcakgagtgaattagcacaaacacatgaagatttgagtggttaactgaggatataggcactccgataggaggtcagaatgtgaaactacaagctgaagttcttgctttggtgaaataagggaagaaagatcagaaagctgagtggtcttccaaatagtaaaaaaaatcctgctgagtagatgcattgaagagcttcatcccaaggtaacatcaaggagaagaaaatcttttgctattcttgtaagtctctttgtttctgtgatccacctatcagcttaattgaagagaaagaggmggtagggtggaagtctctctgctaactttgatattcctgtggtttttctctccaggtcactgtaaaaccccagagcagtttccatttgccagtcctwygatcccaattaatgactttgagtttccagtcgggacatctttgaattatgaatgccgtcctgggtattttgggaaaatgttctctatctcctgcctagaaaacttggtctggtcaagtgttgaagacaactgyagacgtgagtaacccctccctgggaactacttcatgtctgttaaagcataggtgggaccgggcttggtggctcacgcctgtaatcccatcactttgggaggccaaggctggcagatagcttgaactcaggagttcgcaaccagcctgggcaacatggccaaaccccacgtctacaaacaacaacaacaaaaacaacgtaggtgggatttgattcaatttgctcaaattttggaagcaagatgtctatatttgcccaagatattttgataaaggaaaggatggtcttgtacatcaccccttcttcttgcttgtagttcctgaaccttgactagatgctcatttcatgagaatggctctcacaaaagaattagagagaaaatttacattcactgtagatcatccttgatggctgacaccattaaatgaatgaaacaggggtacaaaagaaatttatgtgagttgcagtgaactgtgcttggctaactaaaaataggggagacatcccaaattttgaggcctttgattttggctggcggaatgagagtacaacactttagccataaatgacttgttttgtttttgttttgtttctgctgttgctgttgtgttttttgtttgtttgtttgtttgtttctgagatggagccttactctgtcacccaggccggagtgtagtggcgcgatcttggctgcaacctcctgggttcgagcaagtctccctgcctcagcctctcgagtaactgggattacaggcacccactcccatgcccagctaatttttgtattttttagtagagatggggttttgccacgttggccaggctggtcttgaactcctgacctcaggtgatctgccggcctcggcctcccaaagtgctaggattacaggcgagagcccatacataacctttattaggaggtgcaagatagtctttttcaaagttgtgttcgtagctacatgattctgaagttgtctgccaagtttcctcaaagcagtcaattccatgaaacaattggaactgtatatgctgtttagtatgccacactccagtctgaaccttacaaaggtaagttgaactctatatttaatcccaaattctgcttcttcccctaggaaaatcatgtggacctccaccagaacccttcaatggaatggtgcatataaacacagatacacagtttggatcaacagttaattattcttgtaatgaagggtgagttgagaataccatctcttgaatatgagttccagaacagcagagccaacttctgacccagtctcagatagacaaactaaactattgctccctttactttaaaagcaagcaataggacttatagatggagatgatacgttggacatagccatatgatcaaaggaatacaaaaaagaaggtacaatatgtattgtattgtaaaccagaggagggcaacatgttcctgtcaaaggtgrtacatgtgaaacctggtcaggcattcattggatgaaaaggagcagcttacaaataaggaaaaggaaaaaaggtagttgaaccatgtaaacctccttaactgagatcagtaggtaatacagttgagttggaggaccctgaagcagagtttgggagggtaaacattaattgtaacagcagctctggaagagtatgcatcaaagtgcacacagagaggagacattatggggttcttgctcttgacttctccttgggacaagtagccacaccaaaagccattgcctcaactgagaaggggcttttaaaaactctggagtrgacctccatcaaactccagcagacctgcagcagaggggcctgactgttagaagataaactaacaaacataaaggaatagcrtcaacattaacaaaaaggacgtccacatgaaaaccccatccaaaggtcaccaacatcaaagaccaatgatagataaatccacgaagatgaggaaaaaccagcacaaaaaggctgaaaattcccgaaaccagaatgcctcttctcctccaaaggatcacaactccttgccagcaagagaacaaaactgggtggagaatgagtgagttggacagattgacagaagtaggcttcagaaggtgggtaataacaaactcctctgagctaaaggagcatgttctaacccaatgcaaggaagcgaagaaccttgaaaaacaggttagaggaattactaactagaataaccagtttagaaaagaacataaatgacctgatggagctgaaaaacacagcacaagaacttcatgaagcatacacaagtatcaatagccgaatcgatcaagtgaaacaaaggwtatcagagattgaagatcaacttaatgaaataaagcwtgaagacaaaaaaagaatgaaaaggaatgaacaaagcctccaagaaatatgggactatgtgaaaagaccaaacctacgtttgattggtgtacctgaaagtgacggggagaatrgaaccaagttggaaaacactcttcaagatattatccaggagaactgccccaacctagcaagacagtccagcattcaaattcaggaaatacagagaacrccacaaagatactccttgagaagagcaaccccaagacacgtaattgtcagattcaccaaggttgaaatgaaggaaaaaaatgttaagggcagccagagagaaaggtcgggttacctacaaagggaagcccatcagactaacagtgaatctctctgcagaaaccctacaagccagaagagagtgggggccaatattcaacattcttaaagaaaagaattttcaacccagaatttcatatctagccaaactaagcttcataagtgaaggagaaataaaatcctttacagacaagcaaatgctgagggattttgtcaccaccagacttgccttacaagggctcctgaaggaagcactaaacatggaaaggaataactggtaccagccactgcaaaaacataccaaattgtraagaccatcaacaatatgaagaaaccacatcaactaatgggcaaaataacaaatcagcatcataatgacaggatcaaatttacacataacaattctaacattaaatgtaaattggctaaatgcccccagttaaaagacactgactggcaaattggataaagagtcaagacccattggtgtgctgtattcaggagacccatctcatgtgcaaagacacacataggcgcaaaataaagggatggaggaatatttaccaagcaaatggaaagcaaataaaagcaggggttacagtcctagtctctgataaaacatactttaaaccaacgaagatcaaaagaracaagagcattacataatggcaaaggatgcaacaagaagagctaactatcctaaatatatatgcacccaatacaggagcacccagattcataaagcaagttctgaaagatctataaagagacttagattcccacacaataatagtgggagactttaacaccccactgtcagtattagacaggtcaacgagacagaaaattaacaaggatattcaggacctgaactcagctctggaccaagcagacctaatagacatctatagaactctccaccccaaatcagcagaatatacattcttctcagcaccacatagcaattattctaaaattgaccacataattggaagtaaagcactcctcaaaatgcaaaagaatggaaatcataacaaacagtctctcagaccacagtacaatcaaattagaactcaggattaagaaactctctcaaaactgcacaactacatggaaactgaacagcctgctctgaatgactactgggtaaataacgaaatgaaagcagaaataagtaagttctttgaaaccgatgaaaacaaagacacaatgtaccagaatctctgggacacagccaaagagtgtttagagcactaaatttatagcactaaatgcccacaggagaaagcagaaaagatctaaaatcgacgccctgacatcgcaattaaagaactagagaagcaagagcaaacaaattcaaaagctagcagaagagaagaaataactaagawcagagcagaactgaaggagatagagaaacaaaaaacccttcaaaaaatcaatgaatccaggagctggttttttgaaaagattaacaaaatagaccactagccagactaataaagaaaaagagagaagaatcaaatagacacaataaaaaatgataaaggggatatcaccactgatcccacagaaatacaaactaccatcagagaatactataaacacctctacgcaaataaactagaaaatctagaagaaatggataaattcctggatacatacaacctcccaagactaaaacaggaagaagtcgaatccctgaataggccaaaaacaagttctgaaattgaggaagtaattaatagcctaccaaccaaaaaaagcccaggaacagatggattcatagctgaatcctaccagaggtacaaagaggagctggtaccattccttctaaactattccaaacaatagaaaaagagggactcctccctaactcattttatgaggccagcatcatcctgataccaaaacctggcagagacacaataaaaaaggaaaatttcaggccaatatccctgatgaacattgatgcaaaaatcctcaataaaatactggcaaacraaattcagcagcacatcaaaaagcttatccacaacgatcaagctggcttcatccctgagatacaaggctggttcaacatacgcaaatcaataaacgtaatccatcacattaacagaaccaatgataaaaaccacatgattatctcaatagatgcagacaagggcttcgataaaattcaacagcccttcatgctaaaaactctcaataaactaggtattgatggaatatgtcccaaaataataggagctatttataacaaacccaccactaatatcatactgaatgggcaaawgctggaagcatgcgctttgaaaaccagcacaagacaaggatgccctctctcaccactcctattcaacatagtattggaagctctggccagggcaatcaggcaagaraaaggaataaagggtattcaaataggaagagaggaagtcaaattgtctctgtttgcatatgacatgactgtatatttagaaaaccccattatctcagcttaaaatatccgtaatctgataagcaacttcagcaaagtctcaggatacaaaatcaatgcaaaaatcacaagcattcctatacaccartaatagacaaacagmgagccaaatcatgagtgaactcccattctaaattcctgcaaagtgaataaactaccttggaatacaacttacaagggaagtgaaggacatcttcaaggagaactacaaaccactgctcaaggaagtaagcgaggacacaaacaaatgaaaaaaacatttcacgattgtggataggaagaatcaatatcatgaaaatggccatactgcccaaggtaatttatacagtcaatgctatccccatcaaattaccaatggctttcttcacagaattacaaaaaaaaaaaaaaaaaaaactactttaaacttcatatggaaccaaaaaatagcccatatagccaagacaatcctaagcaaaaagaacaaagctggaggcaccacgctacatgacttcaaactatactataaggctacagtaagcaaaacagcatcgtactggtaccaaaacagatatatagaccaatggaacagaacagaggcctcagaaataatgccacacatctacaaccatctgatctttgatgaacctgacaaaaacaagcaatggggaaaggaktccctatttaataaatggtgttgggaaaactggctagccagatgcagaaaactgaagctggaccccttcctttacaycttatacaaaaactaactcaagatgtattaaagacttaaatgtaagacctaaaactataaaaaccctagaagaaaacctaggcaataccattcaggacataggcatgggcaaagacttcattactaaaacaccaaaagcaatggtaacaaaaaccaaaattgacaaatgggatctaatgaaactaaagagcttctgcacagcaagagaaactatcatcagagtgaacagacaacctacagaatgggagaaaatttttgcaatccatccatatgacaaaggactaatatccagaatctacaaggaacttaaacaaatttacaagaaaaaacaaccctatcgaaaagagggcaaaggatatgaacagacatttctcaaaagaagacatttatgcagccaacaaacatgaaaaaaagctcatcatcactggtcattagagaaatgcaaatcaaaaccacattgagataccatcttgggccagttagaatggcaatcactaaaaagtcaggaaacaacagatgctggagaggatgtggagaaatagaaatgcttttacactgttggtgggagtgtaaattcgttcaaccattgtggatgacagtgtggtgattcctcaaggatctagaaccagaaataccatttgacccagcaatcccattactgagyatatacccaaaggattataaatcatccttctataaagacacatgcacacgtatgtttattgcagcactgttcacaatagcaaagacttggaaccaacccaaatgcccatcaatgatagactggataaagaaaatgtggcacatatacaccatggaatactatgcagccataaaaaaggatgagttcatgtcctttgcagggacatttatgaagctagaaacyatcattctcagcaaactaacacaagaacagaaaaccaaccaccgcatgttctcattcctaagtgggagttgaacaatgagaacacatggacacaccgaggggaacatcacacagtggggcccgtcagagggtaggagtccaggggagggatagcattaggagaaatagccaatgtagatgatgggttgatggtgcagcaaaccaccatgacatgtgtatacctatgtaacaaacctgcacgtcctgcacatgtatcccagaatttaaagtatgataataaaaaaaagactgtgtactcatttttggttgccatgataaattcagagaggaaaaacatgatatatattaaattttactgcaacaactaactgccccttgtcatcagcctattctgtcactagagtgagtcagtattcctcttttctgactgtctgagcctggacgatttaaactgcttttcacacaacctcttgcccaaccttttctcacctcccattgtgaatgaacatagatttccctatggtaaacaaaacaaaatatcaccaaatctaaggcaagataaagaaattgaagataaaagaaaccaacccaagagatcagagaaatattcatctgcacaacagcttcctccaataaacaggggacaatctttaaaaatctctcatatgtgtttgtaacatagaatcgatggaactatatgaggcatttataagatttaatgatctgatatcagaaaagttgagatttgaatgaaacacatgggagtcggaaaaggagtgatgactggtagattggagcctgcccccaacccccggaaaaaaaaaaaaaaaacaccaaagggataatgaagacaagattgaattctccagaattcatcaaggaccagacttgaaatgacacatatatacacacaaacacactacacacaaacacacagggatataatatagaaattccagaaaaaataaaagaaagcagaatgaatagaagcattaattagcacataatggaagacaatttctcaggctataaagaaaaatactaagttgatccttgaaggcttactagacaaatcaagattaacaacaatgggccccggccctacatggaagaaaattatgccatccaaatataaaaaaatactgccactctccagaaataacaaaaaagaagaaattcatcttagcaccaagcttccgttctgtaacactaagtagtagaagttagtgtttgagaggaaatattgtacaataaaatttctgtactcggccaagctgccattcatctgcaaggcacagatgcatcgtcttaaataagaaggaaccccaaacatacaccagttagatatactgcctacaaaaagaaaaactcccacaaagctgtgggagtttttctttttgaagaagaaatcaaaattccaaatggtgttgtatcaaagaaatattaatgaggcacaaaactagttaaatggggtcactaaaactgttttatttaatatrgaaataaaatatcaaagcaggactaattcttgaaagataattcatgtaatatgaaaagaagaagaaacttgatataaaaaatagattttatcacttcagctaggaagttagagatgaagtaagaaaaaccatcataaacttatcatatgtaggggacacatattcttgacataaaaaataaggagaaaatggtacttcacaccagtataaaatctatatatctatatctatatatatctatatctatatctatatatatatatawaatcaaattttaaaagataatcagaagggcgaaaccacttggtccataaaacaaaagaggggtgagagaaacaagagctagcaagctttctgtctctcttttgggaaactagcattattacgttaaagtgaattaatacatgtattttaatgcctcagtttttctttctaatataataaatattaacagatataaactccattggtaaaatcactttgaggtccttaatacttcttaaagtggccgggcgctgtggctcatgcctgtaatcccagcactttgggaggctgaggcgggcagaacacctgaggtcgggagttcaagaccagcctggccaacatggagaaaccctgtctctactaaaaaatacaaaattagccaggtgtggtggcgcatgcctgtaatcccagctactcgggaggctgaggcaggagaatcacttgaaccygggaggcggaggttgcagtgagccgagatggtgccactgcaccccagcctgggcaacaagagcraaactctgtctcaaaaaataataataataataataacaataacaataacaaaaatgtttaagagtgaaaagaattcttgagaccaaaaaagtttaagaactagggcttgatgatgttcaagcaaagataggaaaaggctattgcaagtacggtacaaagcacagggggaaggtttcataagtatatatataatatatatataatataacataaaattcatatatattataaaaataataaatatgatataaatttgatatraaatattatataaatctgatttttaacatattttgattttatactggtgtaaagtactattttctctttattttttacatcaagaatatgtatcccctacatagtataagtttatcatagtttttcttacttcattcctaacttcctagttgtagtgataaaatctattattttatatcaataaaaatattgatataaattttatttacatgatatacaatatttaaatataacatattttatattacaaaatatactactatgtattacaaaaaaaaaaacaaactccatttagcagagcaagaatggagtttgttttgtacagtgctgagttccaacccatagaattgttaaataaataaaaaggaaagaacactataagatcaaactcatcagttataatagtaaatgtgaatgattccaatccccccttttgaaagacaaaggcttctaaatatggtcagaatcctatttacagtarcaycaaaaagaataaaatacttaggaatcaatttaatcaaggaggcacaagacctgtgcactraaaactcagtaactgaaaatgagcaaatgatgtgatagacatgtctccaagggaaatatacaaatgcccaataaacacatcaaaagatgttcaacatcaytagtcattagggaagtgcaagtcaacctgactttgtactaggatgttttgtattaggatggttataatatttttaaaaaataggaaataaaaggtgttggcgaggatgtggagaaattagaacgcttatacattgctggtggaaatgtaaaatggtgtagcactgtggaaaacagtttgatgattcctgaaaaagttaaacatagaattaccatataaccagcaattctgctcctaggcatatacctaaagaaattgaaaacaaggactgaagcagatgctcaaataccaatgtccgtagcagctttgttcaaaatagccaaaaggtagaaacaacccaagtatctacgagcagatgaatggataaatgaaatggagcttatccattccatggaatattcttcagctatacaaaggaatagagttctgatacatgctacaagatgcataaactttaaaaacattatgctaagtgaaatgagccagacacaaaaggataaatactgtattccacttttatgaggtgccaaaaataagaaaatttattggactaaaaatagattagagataaccagtggaaggagagaatagggagttacaactcaatacatccagtttctcattgggatggtgaaaatttttggaactaagcagtgataatggttgtataatgttgtgaatgtcattgatgccactgaattatacccttaaaatggttttaatggcaaattttatgttgtatctcttttaaaacaataagaaagaaaaaaatttttaaatatatcatgtgatattaggaaagaaaaaaacagataacagtataagaaaaataagaatttaaaacatatcaaataagatttaaaaattttgtttaagatattgatacttggtccagtgcacaataaagacaagaactttttttttttttcttttgagatggagtctcgctctgtcaccaggctggagtgcagtggcactatctcggttcactgcaacctccgcctccagggttcaagccattatcctgcctcagcctgccgagtagctgggactacaggcatgcgccaccacgctgagctcatttctgtatttatagtagagacagggtttcaccatgttggccaggatggtcttgatctcttgacctcgtgatctgcctgcctcggcctcccaaagtgctgggattacaggtgggagccaccgcgcctggcctgaagacaagaacttttgaacaagagagcgctaactaacgtattgaaatacataaaacaaatactgatatatagaagagctcattcagctgyttcaaagacagagctctgtaacacatgtactcttacctaaagaactgtctcccaccactggaaaggaggtcttctctgaccaaatacacagcatcttggagttggccagcattaacttggatcatctggctggccaggaaaggagtgctcagggagaaagaggatggtcaccatcccaaccagattggccattagatctatgtatcaacagagtgacatacgggagaattaaaattctagtatgcaaaaatacrccgtatgttaacagaaaatagactgcagggaaatttgtattaggtaaaaccgagagaaagttaagagcatacaacagtagataagcaatagacaacccgatataaaaatgaggaaagaatatgcacaggcaattcacaaaaggaaacataaaaatggccttaaaaattgctaaaataaatatttaagcaaaaaagctcarcttcactatggtttggggaaatgcaaattaaagcaacaatatgtcatgttttcacagtcacattaataaaagtttaaaagacggaagtagaggtaaataggaatttgaggaaaaggagccctctcatagtggttcattggaatgtgaattgctgcagctttcaaaaaaaaatcttacactatccacaaacaatgaaagcatagatatcttcttagctactaatcccactcctaggaaaaggagtattaattacaataggttctttattgcagtattgtttatataagcaaaaagagcaaacaaccttgacatccttctattagcagtaggttgaataaatcataagacgtctactatgaactattttgcagcaatcaagaagacttaattagatctctgtttagtgatttgaatgggtgaccatgttgtgatgtcaacagaaaaaaataatttgcagaaaagcatatagagtttgttctcaatttggaaaaataatgacaaatttggaggagatatcctatacacatatgtgtgtttgattgggtttggaaaaatcaggaccacctgagatggaggtgggagtgacaaaatatacatggtatactaagtgaatatataggttatacaattacgttgttaaatttctgaaaacaagtgcaacttaagcatataactaaggagtagatgttaacctggacaaatgaaacatagattgttttgagcaagagacrgcaaaattttttgtcaagagccagatagcaaaattttcaattttgcagaccatgcaatctctattgcaattactcagttctgccattgcagtggaaaaatagccctagacaaatgaatgtgtgattgtattttgataaaacttcatttacaaatacgtgctatagaacaaatttggcctgtgagccatagggtgacaatctccggttagatgaagggattgagagcattatttttcttcaattcttgtcattatgcaaagtcagagaattttctaaaataaataaaaatacaaattggcaaaataataatagttgaaaacttcagattgggcaaataagtgaacaaataatcacatgttgaggaataaggctgctttgattcttgtgtgttcaactttgaaacctttatcacagttataaaaaccatttataaaagtgatataactccacagagtatacctcaataaatttgcacatagaagaaatcaaaatgggtatattttctcatcgcaatacaccaaaaactaggaattaataagcaaatgatacattaaaaattcaaagttttagaaaacggagtaccttagatcttgatcaaagagaaatttaaaaacagccattgcagattacctggagaataacaatcgctaaygatcctcaagtgcatgtgcctcaagcattcttctaagtcctttacttgaattgatttacttagtctttaaaagaccctttgaaatggatatcatgcatatccctcattgtatagaagagaaaactgagacagacaggttaactaatttgtccaaattcatgtgacaggttgaggttagaattagaatatcgccagtcagcttcaacaacctgtaatggtaagccttacattatttatcttcttaattaggaatgctgaaacatatattactcataaaaatttctggggtgctgatgccaaaactgtcctcagagaaatttttcaatcctttttgttacttgacaggaaaaaattcaaataaatgaacaaaacatttcttaacaatttttaaattattaaaaacatatataaaaggctgctggagtaaggaattaataaagtaatgaacaaagaaaaaatcatagaaattataaagaaatctaaaagcagattctttaaagtgaccaattataaaacaaacagactgggtcaattgtcatttcacaaaataacaattctataaatatacaagaatgagaaagaagacataagcctgttgatattgaagagatttaatacttgataaaaatattatatcttctctattctaataaaattaaaactatccatgaaatgtaccatgtcagaagaaaaatacaatttaccaggtgtagtttaaaataggcagaattgctgataaacccatatctgtttgagtccatattttcaattcttttaggtatatacccagaagtggaattcctgggggatatggtaattctgtttaacttttcaaagaattgccagactattttccacagctgctgtaccattttacatccccatcagcartgcacaaatgttccaatttctctacatcctcaccaacacttgtcatttttctggtttaaaaaaaattattattataccaccctaaaaggggctgaagtcagtttgatttacattttcctaatgactaatgatgtggagcatcttttcttgtgtttattggccatttgtatgtcttttttggaaaaatgtctattctcatcctttgtccatttcgtaattgggttgtttgtttcattgttattgagttacaggagtcctttatatgttctaagtattaaatccttatcagatagggttttcacatattttctatcattctgtgggttgtctttttaatctcttggtggtatcttttgttcttgacttggactgcaggacacttcagttcctcactacatgggcttctccaaaggacagctggcctctcccagaatgagcatctcaaaaagagaagaaaacattgcagtgctttttgtggttagcctctgaagttgcacactatatcatttccactttattctaatcattagaatcaagtcacaaagcacagcccacattcaaaaagagaggaattgggctccatcacttgaagggacatgtataaaataatttgtggacatatttaaaaccaccacaaagaagcacctttaaaaaaagacaatggcccagttttgtaactcttttttaacttcaagaaatagataatccaagtattaatattatttaaactgttatggaacatagaaataaaattatagccataattaaagtttgccaaagattacaaatgaaaataaaataaaatatatctctggctcatttgctaatataaatactaaaaatcttaaattgactattaaataaaaccaatattaaaagaattatgcaaggggaacaagtaaggttattccagaaatggttccaaattaggaaacccacaaacttacaatattaaagagtacaacttttcttaaatgtcatataaatatactctctaatgccaaaaaacacaatgaatggttaaaatctaaaagcatgcttgaatataattaaagttcaaaggaaaagaacactcggcatccttcctattattcaaagtagttgtggaaattcaaaccagtaaaatgacagccccctgtatttagagagatatacatatagatatagatagagagagagagaaggcaaatttattattaactgatggttgtttacctgaaaacccgaaggaattatttgaaaggttattagaataggaaatggtagtgagatatcgagtaaaaaataaatacttataaattaattactttctttatgtaggtaacaaccaaatagaatataaggaggaaaaataccattcacaacagaaacaaaatcatctagaaagaaatttaacaggaaatatataggacttataagcagaagatttaaaagagggggacatagaaaaatacttcaagaaatggaagatataatattttatttaaaagatttaatgttgtggtgatgttaattatccctgaattagtatgcaaatttaatgtaatcagtttcaatgacattcttttttttaatttgacaagatgtctgtaaatgtcatgagacccaccaacagaatattctgagataataacaagaagggtgtttgataccagatcagaggtgggtttgatacccacctctcagtgtctggtaaccacctttctactctctacttctacgagttcaactattttagatttcacatgtaagaaagatcatgcggtattagttcttctgtccctagcttattttggaaggtattttaaggcacaaatatgttgtagtgtaattatgttgtaatttttcctgacctgatgtcccacgtctgtaaaattcttttattgaagcctaggctctttccctaggactccctgtctggaatcataaatatcttacttctgtacttaacagaattgttctgtctgcatatagtccccactttttctccaagtagtttctcaaacaaatgcacttcctttcctgaaaagatgagtaagattttaacagctttaaatctttatatatagatatattttaagccaaacgactacactgtacatggttttatagccctctttaatacttacgaactatattgtataattattctaattattatatattactctacaacaccatttttagtggttgcattttggttattacttggatagtccataacctacctaacaaagtccttaatgtctggaattaaagtggtttcgcatttcaactgttagcaaaaacactacaatgcacgatcctgcacacgtgaaaagaaatgagatgaggacttcactaacttcaaagacagcttaaggattcagatcttcacatgtacacaagagacaagatttgcagatttgagtgaaaggctatgcacgattttaagcctttcagtacatattgccaaagtgccctccactaaactttgaccatgacctacggagtgagtcacaacagtgactctttctttgagtttatattactgctaggttttgtcaatttgccaatctaatgggcaaaaacggcattttatttgcattttaaagtgtatttatcatgtttataaggaagctaaacttttcatatgttcatttgactatttccatttttcgtttgtaaattatttgttcataattctttaccatttttctacttgggtgtttgcctttttataattgatgtataagagttgtttttattatttttcctctgtggtttgtcttcaaatttgtatgtagaaaggtttatttgtaattattcagttttatcagttttgttcatagtagaatttttcctcaatgtatgtctatagaagcctcaaatcagaaacacgtttgcctaaatcacctagttcttttatggttttatttttgacatttaatctttgatacacacggattttgctttgatgaatgtcatgaggcagagatctagcttagcttttcagatatttgccctatcaatgaataattcagttttccgtgtcttgaaatgccatctttatcactgccaatttcttacaaaaacttgtatctatttcttgggctttcccccattttgctctagggatctgtgtctctattcctgcatcatttcaattattttacattttaaatgcattttaacatcccttctgtttttgtgccttaaaataccttccaaaataagctaggcacagaaaaactaatgccacatgatcttacttccatgtgaaatctaaaacagttgaactcatagaagtagagagtagaaaggtggttaccaggcactgagaggtggggagctgagatttggtcaaagggcgcagggtttcagttagacaggaggagtaagtttcagagatctattccacagcatggtgactatagttaataataatgtgtatttcmaaattgctggccgggcacagtgtctcatgcctatagctctttgggaggctgaggcatacgaattgcttaagcctagaagttagaaactaggctgggcaaaatggcaaaaccctgtctctaccaataaatacaaaaattagccaggcatggcagcgcatacctgtagtcccagctactcgggaggctaaggtgggagaatggtttgaacctgggaggcagaggttgcagtaagccaagatcacatcactgcactccagcctgggtgatagatccagaccctgtcaaaaaaaaaaaaaagaaagaaagaaaagaaaaagaaagggaaaaaaaattgctagaagagtagattttaaatattctcaccacacacacacacacacacacacacacacacacaaaacaaatatgagaggtgacggacatgttaattagcttaatttaatcatttgcaacagaaacatatatcaaaacaccacattttaccctataaatatatacaattattgtttgttcataaaaataaaatcagattttaaaaaatattcactgtgtttttttcagccatacataggctggaaccttcttcacattttggctccaacaatctagcttagtcacagcgagcacatctaaaacaacctctaggaggccaaaagtcagaggactcccatgatcctgtgctcttagacaacttttaaatgtatgataggagacaggcagaggaaaacacaggtaataatgggattatccttttctttcctttctccagtggttctcaacttgtttaattgcagcaatttttaagattttttttcttggcacacttgaaaagattgtataccatagcctaaacaggctagcaataagtaaaattcaatcagtacctaaaacgtaaaagagactcactgtgtctacaaaaacattgacggtcattgccatagtcacacagttccctttagctttctgtcactgtttcgggaagagctggtatatcagttaggatttccagctgtaaaagacagaagaaataaaataacaggatctcaaacatagatagtagtttacttctgtctcaggttaaaaatcacgaaagtaggcagtccagggtttatacgatgactccataatccacagaaacctgggttccttccactttgctactctgacctcttcaaaatgagagcccatcttatctcatggtctaaactccagccagtatagaggacacagggaagaagggaaggccaattcctttaaagacactttccagaagttgcacaagacactccacttacatcctctggccagaagttagtaacatggctatgcccggctgtaaggaaaggtgagaagtgaaacctttattgcaggtggccaatggcccagttaaaaatagagggttccattactaatgaaggagaggaaagtggatactagggatggcaccagtagtctttgctacaaatggttactgccctgatcacatttcttacataatcaagaggaaaagttcttaactgttgcagttactgcctcatcattatatggcattccattttaccctttaatttttacttggtcaagtttaggcctgctgtacaccagaacacatgaatagctttgctcagcattctttgtgacgttgctcacagtaacattatggatacctaataaattttttaaaagacaaaatgttctacgttttgtggcctactctggatggctttawggtaaagtgggtgagtatccctaccctttacatttcaagtgtaggggtgtttagctgtctcttctggctctcatttactgactcttctgggtaaatccattgttctttcttttatacaagagactatctgagcacccaaaacttgaaagtctctaagctaggtgctatagtgttaaatatttcagtaagatattttccctgcttaatccaggagcttgtcatttccttgctggaagtacacatggataaaataactgcaaggtttctgaaagacttaagtacaaaaatgtcctgcaaagaaaaagggaaatatctcattcagttgtgagggattaggaataaaaatgaattggagaggtcaaaatgtaagcttgtcctcaaaaagaaaggactaatttgcagatggagatggggtttcttccttccgaggtctgccatggtgtaatctgtcctgtaatgtctaatgtctacctgctattattttctaaatggtgagttaaatgggaaatatgtgtagcgtataaccattttctatcmtttgctttaggtttcgactcattggttccccatctactacttgtctcgtctcaggcaataatgtcacatgggataagaaggcacctatttgtgagagtaagttgaaatacttttctccacaaattcctctgtgtgatcctgacttgcccctggagtacaaagaataaattgaatccttcttgcacaaagtagtctctcagatatttgaaaataggagtcagatgcttcatggtcttcctggcttttctttatcttaaaaggtgatttatctgaaactgtgggcttgaacctaggcaaaataccctactttcccattataatagtaaatatttccagtatagagagtgttgtccttaatgagtacattttaaaggcgttagacaaaattagatctgtctttgccaactcttactatctatcaggttacaattccacaaagtaggctactcactttcttgttattctaatccaaataataaaaagaactcttcttccagttcttagcaattttcctaagcctctgatcattttgagttctaatcctccttcaattcttttaggcccatgtcttcagttgtatttgttctcgattagctgaccctccatttttcccataagatatttttcaatgaatctccaaaactttaaaaccatggaagaatgattgcaaattggcaaagtgttatagctgtgaagaagtcgtcatcgcacacagagttgatggcagcaaaagtaggcacagacttccagaaagctaatgaccaatataaacaaaagtaaagtaaataccctctgactgacaattccatttcccagaatttagcccaagaaaataatcatgaaatagtcccatgattttggtccagagatactcaatgcaataatatttgtgatagtggaaaatgttaaacaacctaaatgttcagcatggtttgaaaatagctagtagaagaaataaggcatattttaatggctatcagtttttcggaaaggtaaaaaagtgcaccaggaggaattaaaggttgagatgcctcatccaagtggaaaaagtacatctatgtagctacatgactgattattattcagccaccaaatatggtagtatagaaaatatatccatccatacatatgcatgtatccacatatgtatctaagaggatataattaaattgttacaaatagttatctttgaaccattttcactttcttctttctctttgtccatattttataaatttcctacaatgaatgtgttcattgtagtcactaatattcttcccccccaaattaacattgacttttaaacattaaatgaatgagaatgtatacaaggtgcctcccatatctgccaagaacttgaaattctatgaaataattcaaattatcaaagaattatcagtttactatacraagttttcaaggcatggcaccttttgtagggggttatcttttataaaaaaatttccacttctacatttataggtcagtgatcatttaattgagtcaatactggttatgtgtgtatatgtgtgtagtcacttagccaatatgtgaatattattatcttaygatagaacacagtattcatttatcattttattgcccttaaatctgccattatttcatttctcatgccttatcttttgtgtttccttttctctctttttcttcataaataatgccagaagtggtatatttaaactgcaaagaggttattttaataacctataggaaaaaatagtccagcaatagataagtaccttaacaatctgtgataaaatcacatgtattatccacttaaaattataaatatataaacccaaaaaaacatggattttttttgtgaaatatgagcagaacccatatcatacacacctaaatttcaactaggtaaaaatgtctgattattagcaaatattttaagaaaataacagtattgtaattccatttagaaaatcattggattatttgcatttggtatttaaattcatagtaaaataattcattattaaaaaataagctgttttaccatactcttccttctctcagtcatatcttgtgagccacctccaaccatatccaatggagacttctacagcaacaatagaacatcttttcacartggaacggtggtaacttaccagtgccacactggaccagatggagaacagctgtttgagcttrtgggagaacggtcaatatattgcaccagcaaagatgatcaagttggtgtttggagcagccctccccctcggtgtatttctactaatraatgcacagctccagaagttgaaaatgcaattrgagtaccaggaaacaggagtttctttwccctcactgagatcrtcagatttagatgtcagcccgggtttgtcatggtagggtcccacactgtgcagtgccagaccaatggcagatgggggcccaagctgccacactgctccaggggtgagtgtgacccatcaagactttgctgggtgtgagggtacgtatagatgataggagttgttgaaattaaggaagaagtgtataaggactatgaaattggcataaacataatagtagcttcactgtctgttatctctgttaataattgtctcaaagtaatggcttattctctcatctatagtagacatattttagatgcatttttgaatttaacatttacagcaaatatatgaagtagctactattggtatccccattttactttgagagaactgagtcttagtgatattaaagaacttttccaaggctctgactccagagcctaatcataatgtacagtggaatgtatcatgaacaataatgtgtaatagtgatgatcgtatctctatccctggagtggggcagtaggcaagtgagccatgaggaccaaaatgagagcatcaaatcaaaaaggccttggacttcaacttcaactttttctcattataattgaaaagactgaagctcagaaaaagtgttttgctcaaatccaaacaaatatatatatatgtatatacacacacacacatatatacttgatatataattatatattgttcagattgaggctcaaattcattctttgaggttttttgattgtttgtttgtttgtatgtttgtttgagagaaggtctcgctctgttgcccaggctggagtacagttgtacaatcatagttcactgaagcctctaactcctgggctcaagtaagacctctgcctcagtctcacaggtagctggaactccaggtgctcactaccacacctggctaatttttatttatttttagagacagagtcttgctatgttgcccaggctgatcttgagctcccgtcctcaagcaatcctcctgcctcagcctcccaaagtactgggatttcaggcctgagccaccatgcctagtttcaaatgcattctgatgccctgagaacacaccaattgtcctgtggatggaggcagccaacatttcggttaaaatacggtctaagcaatatgttctatcactaaaaagtctgtagcttttttttctttgagggggggttgttctttttgtttatttttaatttattaatctttaatttttgtgggtacatagtaggtgtatatatttatgggtatatgaaatgttttgatacaggcatgcaatgtaaaataatcatggagaatgaggtatccatgcccttaagcatttatcctttgtgttacaaataatccaattacactctttcatttttaaatgtacaattaagttattactaactatagtcaccctgtcatgctatcaaatactacatcttattcattctttctttttttttttgtacccattaactgtccccacctcccctccctaccctcaccccctatccccacgattttgttcttgatgcctcctcttttcttagctgaaatgactggcttaaaacatggagtgggaagaattaggactggtcacagggacagaaaggaagctaacagttcagccctgtgctgactgaaagagggtcagggagtgtggaaaatgaagaatacgtgaaggtgtctgttagatgagaccttggcaacagtactccttgctgttgccttacgcatgagcttgagggactgcctctgtaggaagtggaagagtggccaaaccacccgcactcacgactctgtgctccataaccagtagttgaaagcaagaggaatatgctgccttatagtctttggaacatgtttcagtagaaaaaacacagacaaggtgttggagagactttgattctagtcacagttctgcttggtttccttagcttccttgttagtgagatgtggctactgaactaccaatcttctcttttaatagctgcactctgcaatgacgatttttaagccctctggtaagcataagatatarcaaaggaaattgccccatatctaacaagtgctctggaactgtcctttccacagtgtgtcagccgcctccagaaatcctgcatggtgagcrtaccctaagccatcaggacaacttttcacctgggcaggaagtgttctacagctgtgagcccagctatgacctcagaggggctgcgtctctgcactgcacgccccagggagactggagccctgaagcccctagatgtacaggtgccttgactctctggcttccagattgctctgttttccccttcacatggaggacttactcctgttgttttattttttcttctagtgaaatcctgtgatgacttcctgggccaactccctcatggccgtgtgctacttccacttaatctccagcttggggcaaaggtgtcctttgtttgcgatgaagggtgagtgtgacccakcgttgagaccaaggactcagtgtggagaatcactctcttgagatcaggggttaatccaattaaggagctgacctagtagataagaagtacccagagagattaatttatggaagggtagttttgaaataagrgtagggactaagtggcaccactttcagaaggcaatgagaaaatggcacatacagctcaatgtcaggtacaaacctaaatacagtcactgatcttgagtacacagttggaacttgaaatgaatgggtacgtatttatttggaggcaaaagaacataattttataagaggtatgctagaaaataaatgatgaataagacaaaaattgtttgccccataagaagtaaggtagaggttgtcttaagaaacttaaaaccaatcaatagtggaatctgtaatagtgcatggataagtgtgttttaacccaataatatatcttcaggtcaggaatggccagtgtaattcttttaatgcaggatttttctcagccactttgccagccagtgacttctggacagcaatgcccctgcccaggccttgcttgggcccaggctcaccgcaggaaacaccccagatacttagcccactgggcggcgtctggctggtgctctgactgggaccctggggccaccatgactgcacactcagcccctggtgggaggggatgtgtgagtgagtgagtgtggggtccagctggccactccaagcacctgcacaggaatgggctctgagcagtgctggcggctggaccaggcatgtcacactgaagggaacgtggtggtgcccaaacaggggtgcccatgaccccaaagcccagaggaggtgttacagcacactaatggctcttagcatttgataatgcctgcagcccaacagatggcagtgtgcttaacagctctgtcaatcctgtcgccccacatctcctgtcgcccagctctggcttgatccgctgctgcttcctttcgcgtggtacagctgccctcccacagcagagggcggagggccacagtgttacaggcttctttgtacctgcgtttggtgggtcctgagttgttgtcccgcatccaagaagaacaaggttatactgacaatagaagggtgaggagggtggagaagagttttattgagtgacraaacagcttctcagcggagacgagacacgagggtggaccccagatgaagtcagggggtcattctctctctcagcgtggctggttctggggcttttatggacacagaatggggagcctgtgctgattggtttgtgactatgcaaaaaagactaaaacaaagacaccactcaaaggtgggcacaacagtgtaaaaaaccaattagggaagctcaggtatatgtaaactaaatgaacagtgaggatcaatcagaggaaagcacaccaaatgggaagagaggttctcaarccagtccatggatttacctggaacttgtagctaggctttaaactgtcttcagcttgaaggtcgggtttcaccgggatctgccccatctgcctaggatttgtctgcctcctgcttctatcagtttcaagtggtattattagttgtttatgtgtatccattactcttggtggtgtgcactatgagtctggagggataactagattgggcaattaagcagttatttttaatgatttccaaagaatcttcggcatttacaaagtccaccacctaataatgatttccaatttcagaatgatttcagatttcagaaggcaagcaggattcaataagttgggcattttggggtgcaaagactcttcccccctcccttctttttttcttagagcacgtggttcagcatgcttctgtgagcctcctctggcctgttacagttgtagtagcaagaagaacagtgcccgttctctttctagatgttcctggctttgcttaccaaatcgagagctgttctgcctcatgacccactaatgagaataagtgggatgtcagagagccatcagtgaaagatgacacctgaaggttatggctcttgtgcccatggagaagtatggttctgtgttcatgccttctgtaggtgatgctgggctatgaagtttatatggcaattatgcacatcagctctaattgctttgccagtcacagggtaccatggttctttagaataaattggcctttgagtttctgtcagctactgaagaattcagatccctaatgaactaagacttttagctgggcctgaacctaagacctaaatgatagtcgaggaggaaatggtagtgaggaagctgagcatctattagcgaagaaatcaagggagagatgggaattgctcacacatttgctaccactttttttttctttaggttccgattaaaaggcaggtctgctagtcattgtgtcttggctggaatgaaagccctttggaatagcagtgttccagtgtgtgaacgtgagtagaaagaactatgtagtttggatagctctccttattttcgttttccagcatgtttttccgcatggcatcacctgttgtctagatctttacttaactaaattatggataaaaatacttctttgttggaagaatttcaagaagggtcttgtaggtcttctctgacatgtgtttttgttactaatctgcaaatcacttagtttaatgactgtttaattttgtggggaatgtgtggcaagaaactagatgacataaaggtgcagcacgttttagtcagtcatttatttttagttttcttatcaaggaggaatctttcttaaatttttatttttatttttattttctgagacactgtcacccaggacagagtggagtggtgcaatcacagctcactgcagcctcaacctcctgggctcaaatgaccctcgcacctcagcctcccagtagttgggactacaggtgcatgccaccacacctggctaatttttgtactttttgtagagatagaatctcgccatattgccccagctggtctcaaactcctgggctcaagctatcctcccaccttggcctccaaaagtgttaggattacaagtgcgagccaccatgcccagccaaatttttatgttcttttatcccctcgcatatcataaacaatttagtcagcttgttttttagcctgcagtatttaatgacatagggcttcccatgtgccaggactttccatgtgtagaaaaagcratgaatagtgaatgaatagtgaagacacctccctactttcctgggatgtattttcttgttgggaagcagactatgaacaaggaaataaataagtaaacaaaattctaaaaattataacatataaaatggtagttaaatagggatgttatggagaaaataaaacagagttatatgataaattagtacgatggaaggagctgggatgatgaatcagtgtctgaaatgatgaggtgtcctaagtttccaaaccatccgcttaaataaaatatgccaaaattcagaaaaaattcagaaactcttagataaaagtacatgtttgacataccaagacattactgattgattctattctgtctactaaagcaaggcaagaattttttaaaccttgttttcctgattattagaaaatgtttattttaatttgtattgtgttaaaataacttatagaaatcaatttggataccttatggtgagtattatggtgaagaacattcaatacctgaggaaactcaagtattcaacaaactcaaccttacagagacacatagagctgaaaataaatatataaataaacttaggaaaacacaaacaggtaaaattcaagcatgagaagtcaatcattgtttgatgtactaggtcttttatatacacataattctgataaatttgggtatctcttcctaaattcatrtcaaactagaagcatcaattgcttttagggaaggaactgttctaagcagactaaaaggaggaagaaatggtggctaataattggaagaaatcaaaaaaggctctttggcaccatttaatctgagtaaaaacagccttactggtgtctgatgacaccactggaaatttggtattggtcctgatggtaatggtcttgaatcacyaagaaacatttacattgctaaagatgatagctcatgtttattaaagttcatagatttccttgaaacttatggtctctgatgaccaaaactttgtctgtcttgaacctcattgtcaactcaggaatcttactatgcctgagttaaagtagacaaccaaatgggtgtttttaaaaaaaataaaaacaattactttccaaattcattgtgaacataggtacctgagtggtccaggaacactgtctttgggcttttgcaataaactgtaatttaggtctcacttcagttagttgcctctcaacaaaagccttacagatttaaattccgtctaccttagttatattctttctaaaagttatattctttttaagcgcacagtcacaggtcactattgtttcagtcatcttaagtgaaattctaatagaacttaaagctcttgttttctttctagaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccstcaagggaatggggtttggagcagccctgcccctcgctgtgaactttctgttcctgctggttagtacctgcttccacatatcctaaatgggttcagaatatctaggtaagaacctccatatttctatagtgacagtcatttttgcttgtgaaaatggctttgctgtaactgtcagagacagaactacctcccaagtgaatgacaaaygggttatagataggcacgctgtctcaattgttggtattctgatggtccttcctatggggtgaagagtgtgggatggtaaggagagaagggggtggacagtgaagagaattgatgaggtccagatttagtagggaatgttttcaaagtactgaaaacaaatgctaaagaaaatactcttttattccacctctactactacgagttatctttatcctggagagatggatgtgctgtgcaaaaagtacacattgatgatgtaatttacttcagaactgataacgctataaaagtaatttgagaaactcagatgtagggatttatactttttatgttgtttccaagggtttgttcaagccactgactatgtttgtttgatccttcacctcaacattaacaaagggaactcaggaggccctggagaagcagagtttaaaattgtactcttagcctaatgggtgcagcaaaccaatatggcacatgtatacctatgtatcaaacctgcacattgtgcatatgtaccctagaacttaaagtatatatatatatatatatatatatgtgtgtgtgtgtgtgtgtgtgtgtgtgtgtgtatgtgtgtatatatatatgtgtatatatatgtgtgtgtgtgtatatatatatatatatatatagagagagagagagagagagagagagagagagagagagagagattgtactcttagcctccatagctcattcctttgatatattagtctggctttaaacgacagtacctgacaactgtaggcacatgtgtggctgtgactgcccacaccagttccatcttccagtaaggacagaacagcactgaatcggtagcttgtcgatccctgtggtactcccccatctgatctagtttgaagttagagactgtagaggatagtgtttaaatgtcaagaggtctaggtttagagaacccgtctttcactgatcaaataggagggagtggcttatgacctggctggttgaggtcttcatgtacctctaatagccagagatattggatgtgttcatgtattcatatgtctatgtttaactgagtgtcttttcttgtgtttgtgtgggaacttgttcttagcctgcccacatccacccargatccaaaacgggcattacattggaggacacgtatctctatatcttcctgggatgacaatcagctacatttgtgaccccggctacctgttagtgggaaagrgcttcattttctgtacagaccagggaatctggagccaattggatcattattgcaaaggtgacttatttcttggtattccttattcttgctgggttgtatggaatgcatgaggcttgtaaggctgagagacattgaaatgagcttaatgaaagggataatatttttttcttctcggcaactgctttcttttcatttacataaaattatttcatcttattaactgtcctctttgcatggtcgatagcagtgcttctccatccagagcattaacaaaatcaccttgttaaaaagattctcaaactccattccatggcctcygattctgttttaaagtggggtcaaaagtctatttttaacaaactcatcagaatgctctgatgcaggaagaccacagaccacacttcaagaaataccactttgccttcttggtttgtatctaggaaaaaaatattgtaggcttaattttgagactattacaactgaaaagaagtctgtgcttgaagatgaaggatgtactgatggctgggcagaaaaagaaagtaaaacaaaggataagttaaacaaaataaagtagtctgggtgcggtggctcacacctgtaatcccagcactttgggaggctgaggcgggaagatcatgtcaagagatcgagaccatcctggccaacatggtgaaaccccgtttctactaaaaatacaaaaattagctgggtggtggtgcgcgcctatagtcccagctactcgtgaggctgaggcatgagaatcacttgaacccagaggcagaggttgcagtgagctgagatcacgccactgcactccagcctggcaacagagcaagactccgtctcaaaaaaaaaaaaaaaagaaaaagaaaagaaaagaaagtaaattaattagaaagatgtattaaattcaggctgggcacggtggctcaggcctgtaatcccagcactttgggaggccaaggtgggcagatcacctcaggtcaggagttcgagaccagcctggccaacatggtgaaaccccgtctctaccaaaaatacaaaaattaatcaggcatggtggtacatgcctgtcgtcccacctacccgggaggctgaagcaggagaattgcttgaacccaggaggtagaggttgctgtgagcccagatcgcgccactgcactcctgcctgggtgacacagtgagactcaaaaaaaaaaaaaaaaagaaaaagaaaaagaaagaaagataaattttaaattcacaatcatgatttactaacttctttgttctatgtgcagaaattggccagaattatgcatttaataaagagcagagtgccagtatttgttgtgaagccagacagaattaacatggtactcctgttccctcacagmgtgaccccagtggctccagggctagatcaccgttagcctaattcctaatctttccacagctttccagttgcagagctgttaatcaacagtgaatgcacagtacattccatattctattactttacattaagaaatgggagtcaggaaatgttaaatcataaggtttttggaggaggaagattagtaacatgtttaaaaacatgcttcctcttagccaagggcaaaataggttttggctattttctcctattctcgcagttaaaacggacaatcaacaataaaatatcaatttmtttctgattkgtctaatttcagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtaagtgcaagtgcaaggaatgtgggatcttcccggtcatggttattgctcattcattcatccatattggcatcaagtgtagtgtgatgtttatggcatatgctatgagctatagagtacaatatgagcatccacctattccaaaactcccatagtgagagtaaggccagacttcctcttctcatacttctcactgcagctctgcaccttttttgtctatatcactttgtggttgcatgagccacacagtaatgatttatttacagcctacgagccttacaagaaatgttttcagcatgagttagggagcaccttccaagctgcagagagcagccggcctgtctccctcactactggaggggacaggattttaagctagcacagctggatagagcagatttagaaattacgtatcattgagctctgtagaagagtagccctctgctggcaactggaaggtactgtaagatagaaaactacccacatcatggagcagatgagcaaagttaataatgaacagcctttcttaatccaagttagtgctacactttccyttctccccatctcttatgactcttctaatacatggttctacaccaagattgttcaagatccagttttacaattaatcctgtaaatatgctaatatgactcgcagataatatttctaaattatcagcttgacactcccttaatatcaaattatatttgcttttttggcaaaaatctcactggataacttactaaatgcttttagagtattctgaagatctggctgggactgacagaaaattcaggtcattggagaaccaaccgtatcaaatattagaacaaaatataaagcaataatacaaaagtcactttgcaccaggataagaagagacatacaaataagtggaacaaaattgatattaataaaataaaggggccaggtatggtggctcatgcctgtaatcccagcactttgggaggccgaggcggatggatcacctgaggtcaggagtttaagaccagcctggccaacatggtgaaaccccatctgtactaaaaaataaaaaaattagctggtcgtggtggcagatgcctgtaatcccagctactcaggaggctgaggcaggagagtcgcttgaacacgggaggtggaggttacagtgagccgagatcgctccattgcactctggtctcggtgacaagagcaaaacattttttaaaaattgtccattaaattaacaataaaaaggttgttaggtgaacacccaatacaaagcaaggatgtgatgaaactgatattgttgtgtgttgaaggtactattgtaaatttgcaaaaactcttatgaaaaacaattatgaaatgtatgtggaaaataatacaactattcctgccagttagccctcctagaaatttaatctaaggaaataatgtaaaatattaaaatattctatgcattttattaagggtttcatgagacagaaacctagaaacaagctaaatgcacaatagaagtcattgaatacactatgatgcatctactagattatgttagtttgcctttgttgtaacttatatttctagtatataattatgtgaaaacacacatataaggaaatgtaccagaacagaatgtatcaaaacattttttgggtatgaggattggggtgacttttttctttagttctgtattataaattttcttctgtaattgtattaataataatttttaaaagtcttctctgagtgcagaaggtaaaatgagagtatgtgaatgaaaccaatggctttttgcattagaaaaaatattagactgagtcctgaagaaaaatcaggatgacttgtcactggctgagaggtcctgttcaatcatgttgcatgccagagtgatgttttgtgacttttgtcttccttttaggtrcacatgatgctctcatagttggtaagttttatgaaagttttgctgaggaattctggcatctataacagtaagtacctacctataatgaatgaaatgtaaaaagagagatcaaaatgtcttgaggtgtaaagagatcaaaatatcttcagttgtaagttcaactagaaagaaaataatgataagttaggccacaatatggtgaaactggcatcgtcatatgcatactaaataaccttcatcaaaggctctttactatctttgaaccattacaaatgaataatcattcatcagtgtcaaaaattctttatttgaatgtggtgggagaatgcaacttcttctttcagttgtaacctggagtatgcttccagatggtgatcctgctcatttgcacaaatagaaagccataagaccagtcttctgagcccatatctgtgatttgcctaaataagaatagttttgtaataaagtttgcttccaagggaatactgtggcatattactcttacatccctttttacgcatctggacactgagacacagagagttaacgtaacttgtccaagaccacagaatggggtagcctgggtctacttatctgtggagactgtgcactttaacaatcaataaatggacaaaatgacctaaatatgtaattcaacaagagagagaattccagtattttcacaatgaaatgcctgtgtgttaagtcttaggcaagagacatgggcagggccatggagagctggtggccagctgccccatcacggttctcacttacttttggaaaagctgacattggactaaacgttacaaaacggctcagctcacaccttaactttaataaccctgtgggagtgagactaatgctatagaaacccagagtaaagcagaatgtatagttacatctttaaaaaaaaaaaagcattggcaatctgtagtgggactggatactaagatagaatttaaaacctgtaagttatattttccatgcatttaattaccttgttttactgcctaggcactttatctggtacgatcttctttattttactcatcattttcctctcttggataattctaaagcacagaaaagggtaagtatagccatattatcccaagaaatgtaaactgtacttaccccctcttggaagtcaaaagaaagtaaaagacaaacaaacccattgctacataaacagatgtggtaattcttataaagaaagtccttgacacacagtatagacaaagaggtattcacactaaaggaagtatataggatactaagaacaattaaaaaataataataataacaaaaaaaagaccatttggccaggtatggtgactcatgcctgtaatttcagcactttgggaggccaaggtgggcagatcactagaggccaggggttcgagaccaacttgggcaacatggtaaaaccctgtctctactaaacatacacaaaattagctgggcgaggtgggacacacaactgtaataccagctactcgggaggttgaagcatgagaattgcttgaacccaggaggcagaggttgtagtgagccaagactgtgccattgcactccagcctgggtgacagagtgagactacatctcaaaacacacacacaaacacacacacacacacacacacacacacacacacagcattttaagaaggaattgagttttacagaaagagaaagtaggcagaaggggtttttaaatagttgttcatgaggctgtttgatatcctagttttgctaagacattgcagacactgacctctaagcccagatcctatcatagcactagaagttagattgggtcacttatggcacacatatcatatggcacacataggctgccagtggggaagaattgaaactttccattgggtattttaatatataaacaaatattttgtaaacaccattaactttttttttttttttttttttttttttaagaccgagtcttgctctgtcacccaggctggagtgcagtggcacgatcttggctcactgcaacctctgcctcccagattcaagcgattctcatgcctcagcctcctgagtagctgggactacagccatacgccactacaccaggctattttttgtatttttagtacagaaagggttttgccatcttggccaggctggtcttgaattcctgacctcaagtgatccacccgcctcagcctcccaaagtgctgggattacaggtgtgagccactgggcccagccatcattaattttttaaatttgaaagaaaaaaaacttgcaaagactaagatctgaataaagaaacgtctttgacagggaagagaacctacacagcttttgtactggttgattgaattataacaacctcaatgaggccagaatcaataatatcaatgttatatggttgatgagcaagttctatacccatagaaaaactgaatttgtaacttttaagtgaacggttttctatagcaaatattctaaacaagtacagtttcctacaacaagctttacagaaactgaagttttgatatttcacaaagatgccaatatactttttaaaaagtagtttgtcatagtagatcttgctgtaaagaacctagacaggaactcaatttcatggaaaaatactgaattggtagatatttaaatttaaatatccatccttcctaactaatgttctctatattttacggcttgacatatattctttgctcttttccattataaaaagaaaaggtaagtagctgggcactttaccttaacaaagtacttgtgtcaatacatttttcctcttaaagtttctcattaagtaccatataattagtgagttaattttttaaaaaattactactacgtctgaattaaaggagttggggcttctaattttctgtatctatatcagtctgtagttaaaaccacacaggggaaatgattatcccttcttcttggaagtattcaagatactttaatatcttgaagatatttgattatctccacccttctaactatgtcattcttcattacttatggtccattccttgttaatcaactagagggtcacactcccaagcctaactattgatttgtttcacctacataatttaagatcatttcctcatattaatcaccttcaggcataaacatgactcaataaccatttcataaaattatttctttggaaatgattgtcttgtaaagtctaagcaacctgagaccatataccatttcttcatgttttccatctcgtaaaacctgcctcctatttttttcatattctttaaagtgtaatgtccatggcacaaccattctctctctgaccagtggctaccagaaatgtggcagaaagaaagatcatgatccttgttagacttaaaggtcagggaggtaaacctcccaaacatctatgtaacccacactaaaacctattctatatgtgtaatccaggaaagtttttaaacattttctaaacttttacttttgacctgtttcacttcttgggattgtaactgcctgatgtgttcttcctgcctgtcatacagacaaaaccagttccctgagataatggcatattgcagtaaagaaagagatgaattaatacaaggccagtcacgtggaagaactggagttatcactcaactcagtctccccaagaacacaggggctagggtttttatagatcatttggtaggaagggagctagggaatgggtactactgattggttggggatgggggtgtgggaaatgttcctcatgtgctgtgtccacctctggttgggggccacaggaccagttgagtcatgagtcacargtccaggtagagtcagtcagttgccaaatgcaaaaacctgaaaaacatctcagaagaccaatcttatattctacatagtgatgttatctataggagcaattagggaagtcacaaatctctgagcagtaatggattataaaacctatgcctatattttagcagagttcaggtccctctcctaatcctaatctcttggcctttcattaggtttcaggtcctgagcaaggagagagctagttttaggaagagactgttattatccttgctccaaagttacattataaactaaattcctttcatggttagcttggcctacacccaggaatgagcaaagccggcccacctgtgaggctagaagcaagatgaagtcagccatgttagatttctttcactctcagaatctttgcaaaggtggtttcagcatagtgagtgcatttatctaacaaaacaccactgattttcatgttagaaataacacatagctaaaactgggaaaaagaagtaataaacttaaataatcagaaggcagaggtcccttctttcggaaggagttgggctgattaatcatgcagtcatacctccttgagtgggtgtggccaataagctaagtcattgtggctatgtgaggagggctgattattccttatctggagctcaagctttcctcacagaaagacaagggcataaagggcctcatggcaaagaagaaggaagccatgtgggaaacacagactatgagtggagagtatcgtagtggtcaccaagtcagaagagccatttatcctggagctaaaaaagactgacagatatagaatagtgtagaacaagatggcctgctctatgggagagccacagtcacaccaggcctagagaggtgcaggctgacttctacctcaaacactggagacaattcagaagctgcataagcagtctgaagacttactaagaaactaaaatgaggctgggtgcgatggctcaggcctgtaatccctgcactttgggaggctgaggcgggtgggtcacctgaggtcaggagttggagatcagcctggccaagatggcaaaaccctgtctctactaaaaatacaaaaattagcctggtgtagtggcacatgcctgtagtcccagctactcaggaggctgaggcaggagaattgcttgaacccaggaggtggaggttgcagtgagttgagattgtgccactgcactccagcctgggcaacaaaggcaaaactccatctgaaaaamataaataaataaattaaatwaaataaaacaagaaaagaaactaaagtgatagagaaatagaaggaatacacacacagaaatgatctcaccttctttaaaatgctcctcaaggaggtctactttaactatcctagtaaagatgacatgaccccacccccacattccyagtctctcttatcctgctttatttttttcatagccttattctcttttattataattaattaaataattacattccatgtttattctctctctccctccatgaagtcggggatttttgtcctatcttcaccaatggatacacaacaaatctaaactgtccctgggacaaagagagtctcaataaatatttatcaaatgaatgagtgagctacacaccactaacagtgttaccacaaggggaaatttctgccgtaattctctaccaagttgaacagtgcgtctttaacttgtcctaaacttactccaggtttcaaggctgctccttgttctaatataccaactgtctcagtctgttggtatatatacttgggcagttataacagaaactccatagactgggtggattcaataagcatttaagctgggtgcagtggtacctgcctatagtcccagctatctgggaggctgaggcaggagtactgcttgagccaatgagtttaaggccagcctgggcaatatggtaagaccatgtccctaaaaaacattatgtcatttctaaaaaccaagcatttttttctcatagttctagtgggtagagagtccaaggtcaaggcaactgcaaattcagtgtctggtggggatcgctttctagttaatagacttcaatcttttctccgtgttctcaaatcagagaaaaggagtaaaggagctctcctggtctcttttctaagggcactagtcccattcacaagggctctgctctcatgatctaattacttctcaaaggtctcacctttgagatcctatagtaattagatcctataaattttcaacatataaatttggaaagatacaaacattcagtccattgtaccaacactgcatttggtaagcacatatgcttaaacgatatcacacttgatttcatgtgccttctcaatcctcagctttccctgattaagaatacctaattactctgcccatttcctcygcaccctccaccttggcctttccactcactattactactatctcctgccttcttggtctctactattctcctcaccatccctgctccctggactatgatcccctgtgagcagggaccacctatatccacccaaagcaatttttatttaatgattttttaatctctacttgtacagcagtcaaaattaataataagagtagaaatggttaatgtatctacaaaaagagttaacatgtttatttataggtttatttaccatttattatcttctttggtcctcaaagcaactctgtgaggtaggtaggcccaatcatattgttatcccaaagcataaaacactctaggttcaaagaaattcagtggcttgtttaaagccagtaggaagttgttaggaattaggcctttagtccagattatttaactggaaatcttgaactctttgtgctagtattttgacaatgttagttgccatttctgaatctgactctatattactgaaattcagtatccagaactgtacatagtacaaacctaaagtattttccttttttctttcaatattctttttctccctatattttactgagtttgttttagctactttggtatattgaaccagtatctttctagagaaccgtatgcaatctctactttttttactctttattctgagtcattaggctataaaaaattaaggtatttctttaagggcatctttccatattgagatttcctggcgtttcacacagacttggcaagttcttcctgtgatttaatctcactgccttgttatttcactagttaaaaatatgcgcctgcacgttttgatatttcactgtgtatttacaacaataatttgtgataatgttaaataagataggtcataagataggtcatgcactcatcagtgaggaataatactggttagacttcttcattcagagcccattattgcctcttgttactgcctcgtacccactcccatttctacacaaaacagccttgtmcacagtcaaaatttcaaagtttccattgttgtgatgtttagaatgataaaatacttaaggccatcctctgtgaagtctccctgaattttcctatgttcacattaaccaccagtaactaaccaaatagctcttcattcaacatatactcaccgagatcatattctccaaaaccccatgtaccactcatcacccaagaccaccttcagaacactactcatcttaccacttaaccaccactccttggaaggtcataccacctggctatataccactccactcttcctcatccatggatctcaagtgtgccttccctgtcctgtgaaaactctgccccctgaagcagtctgcctctttttctcaaatgatgctgtcattctaatttccataagatggtaaagaataactgagtgatgaggaaacagtggtacatgttgaagtgagttaactcttcaagcttccattctaaaayccctaataccaactcatacataaaatctccaggtactggtactgttttatcatttcattgataaaagatgaagtgtttattaacccccaaagaggcagtgtaccataccaagtgagggtgagggctttgcaaccgctaaggcctgtgttcacrgtcactcactctctatgagaccctgagcaagatacttatcctcagtaaatttcattttccttgcctgtgaaatggagataataatagttmctaccttacttaacatagtgcctcatttatgatgcatgtcagaaaatgttagctattatttacacatgattgttattactgatattaaaaagtgagtaaatatttctttttactgttagttcttaaataccttcatgacagctactgctgctcccctaaccgtggatattgcttgtacagaaaacagaacacatatcttcactataggagaaaaaggaagcctcgtgtaacactgcagtgcaaagtcattcatgttgtgcagcttaagtgtcaaaatctcgatgtaaatcctatttactaatcaaaattatgtcagaaatagtgaaatgtrttaaggcatggacatctgcctataaacaatttagagtactctgacagaaaatataggatgattttagtattattttctaatctaagtttttgcttagtattaaaagatgagatttggttatgattttcctttcagacgtcttgcaaagatatcaggaacttaaggcaaataataccttaaatttcaaaatgcaaattactaatttctttcaaaacagatacttaaatgattaagacagtttttctatttttttctctgccaattagcaataatgcacatgaaaaccctaaagaagtggctatccatttacattctcaaggaggcagcagcgttcatccccgaactctgcaaacaaatgaagaaaatagcaggtacctatatacatactgaattcaaaatgttttcaacaactcaaatatcaaaaatggaaacaggacttgaatatgatattgcactaggtaggtcattgataccaaagaatttagaaagtacttcaggagttggaaacttcttttttttttattggattattattgtcatttccamtgttttggggtgatgactctataagttagtacagtcacagtcactactttttcaaagcattcctataatttcctgtatttatgctatgaaactttgmgaagtagtatgcttttttcttgtggaacccaagaatttgctgcctgcttgtacctccaagtcttccagcttcccttaaatgcacagagtcactttaatgtcctctagagactttcactttacctccccagccaccaacccccttgatttctgacttccactgaattctctacttcatttggcctctttgactgctccttcttttggtcctcattcccttgggcttattaaatacctaacctttcattctacctattcaaagcaggcttactgcaagctgttgtgcagtacacattgctaaagatttggggtgaaaagggaaattataccattatcaaaagtggtatgtatcaatattagaaatcactgaactgaaaagtaactagtacaccagggacctgaaaactaccacctgtgagccaaatccagctggccacttgtttttgtgaataaagttttactggggcacagccacacccaatcgtttgtctactgtctctggctcccttttatactacaacagcagagctgagtagttgcaacagagaccccaaaagccaaaagtatttactatctggccctttagtggaagactttgctaacccctgaactatatcatactatgagaaatttctcactggctagttccccttttaacctgggctttccatcctcttcccaggcctctctctctcattggatactcctctcttttgttcaaatctttactgcattctcagggtatgcagtaaatacaggcattcagactctcgggcttcttgcaaattcaaaactccatttttctttaaaattcagagcaatttatttggctctggcttactttggctatgcccaagaatcctaaaatgtcctacccataggtgtttggaacattttcaggaataagatcaccatatgccctagaacagaattaggccagtcctgtagaaagcagaagcaaaagcaccacaatcattactgaatttcctttctttatgtcctacctctttctcatatacctgtgcattaatctaaatttggcatgttacacctacatacatcagaaatcctaaattcaacagaggacagtggaaggggccccaggaaaagtaaaggaagtggaaaaggtattttatagttaaccaaaacataagtagaagcaattcaaacttttctaaacaaaaaattacagattatgtcctattttctcctataatagaaatgaatttgcaatgccctgtttattatctgtcttcctagttgctttgcttctagcttatttgtcattactgtttatgaaaacaaatgaaatatgcattgcttttttaaaattcagaattgatattttactttttgaagctttaatgtttatctggcctgatccttctcaaatgggcatatgtatacactgggggatacatggctaatgctaatataccaaggggatataaaaatcataagatgaaaatggcatggtttcctagagaatatatttttctaatattactccaatagttcaaataaaaattgtattatttcaacatgaacacaaacacatttataagggaggaaaagacaaataaataatgcaggaagtttaagataaaataagacggctgggcgctgtggctcacgcctgtaatcccagcactttgggcggccgaggcgagtggatcatgagtcaggagatcgaggccattctggctaacacggtgaaatcccttctctactaaatacacacacacacacacaaaatttagccaggcgtggtggtgggcgcctgtagtcccagctactcgggaggctgaggcaggagaatggcgtgagcccgggaggcggagcttgcagtgagccgagatcgcgccactgtactccagcctgggtgacagagcaagactccgtctcaaaaaaaaaaaaaaaaaaaaaaaaaaaagataaaataagacagaaaatattgtgctttcagggatgctttagactatgtctccaaagttcttgcgtgaggcattcattttcctttactatcagagtgctatgggggaaaagtcaggcagaactgattcagggccagctgtgtggccactcatttacaaacagacgaaataacagcagactggaagaacaacaaccatttttacaagagttcattttaaaaatattccacaatgataaattatttgatttagcctcattcctgtcagattacctgcctaaaacacttttccgcctttctttctatctaaattccctgaacccagctccagctctgaattcaatcaaccaagatgctctcccaaacaactctagtccaaaatgatatctctctttgaaactcacatttcctgactacaccatttaaaaaataaactaatttattttaacagtaatatctcatcattgttaaaaacaagaaataggggaaaatataaaaaatataaaaattacctgcaataatctctatctagtagtattcttaagcttctttgcatattrttagacatttgcatatacaccttgagattatattgattgcacaatattgaatcctgctttttttaccaaatgacaaacatttctcccatcattataacagtacataacctatagtaattgacatttcctgtgttgttttttgcctgttaactctattgcattcatgtagttgcttatttattcttcaaacattcttagccacttacaatgtgccatacattgtgcttatgtgtgttttcttttccatgctaaattaacytctgatgaatagagacaattttttaaagatctccccaatctctgagtataatcaaatgagaaatgttcagtaatcaactgagcacgttaatcaattgagaaatttttcatgcacgtccctgtgaagagatcaccaaacaggctttgtgtgagcaacatggctgtttatttcacctgggtgcaggcgggctgagtctgaaaagagtcagcgaagggagataggggtggggccgttttataagatttgggcaggtaaaggaaaattacagtcaacggggctttgttctctggcgggcagaagtgggggtcgcaaggtgctcagtgggggagctttttgagccaggatgagccaggaaaaggactttcacaaggtaatgtcatcacttaaggcaaggaccggccatttacatttcttttgtggtggaatgtcatcagtaaaggcggggcagggcattttcacttcttttgtgattcttcagttacttcaggccatctgggtgtatacgtgcaagtcacaggggatgcgatggcttggcttgggttcagaggcctgacaaaattaatttatgaaaatttcatttatcctcaactttttggaaatactcttacatcaaagtacacctcaaattgtgtacactgactactgatcacttttcggtaggtataaagtccttaaaaattttgtttcaactttcccttttaagattagaattttgaccacagtgttccatgggaacaaagtgaatcatctgtggcaaaatatgctagtcaagaagtgagttagaatctgtgccaagcgttaagaccttgtgcacccaggttctggggcggagtaaagaggcaggctccaaagacatagctgtgtgttggacatgagagtatttggaggaatacaggtaacaggtgatgctgggaagtcytgtgaaatggaasgagaacraagatgaggaatctggtggcmgtaataaccggggaacagatgagctggaggcctcatcaggaggggtgtcccttggtggaaggacaccattcccggccttaaaaggagasgctycagcacggctggggaagcacgtggataccttgtactaaatccactactgcagctcattcttaactgtaagtagaagaggaggacatgctttctgaagctgacccctccaagatgaccagttcctatttctgtcccctgctaccaccatggtgtagaacaacagaatcaaaaaaacattttttctgttatgggtgacctgtacgttttctagaatggaaggaggctgtttagtagctcaactctgagaacactttttctttggacaaaattaaaaaaggaaaaggtcaagttaatcattaatctctctgttttctactaatgtctccattttcgccatactttctatgtcctacatagcagccatcacagagggcaataaacacttctaatgaccgtgtaatttatatggaatgctgaaggggtgggttggccctccacacctgtggatgtttctcattaggtggaactagagacttggaaaagaaagagacacagagacaaagtatagagaaagaaaaaagggggcccaggggaccggtgttcagcatacggaggatccaccggcctctgagttcccttagtatttattgatcattaatgggtgtttctcggagagggggatgtggcagggtcataggataatagtggagagaagttcagcaggtaaacacgtgaacaaaggtctcggcatcataaacaaggtaaagaattaactgctgtgctttagatatgtatacacataaatatctcaatgccttaaagagcagtattgctgcctgcatgtcccacctccagccctaaggcgkttttcccctaactcagtagatggaatatacaatcgggttttacaccgagacattccattgcccagggatgagcaggagacagatgccttcctcttgtctcaacagcaacgaggcgttccttcctcttttactaatcttcctcagcgcagaccctttacgggtgtcaggctgggggaaggtcaggtctttcccttcccatgaggccatatctcaggctatcacatggggaaaaaccttggacaatacctggatttcctagacagaggtccctgctgccttctgcagtgttttgtgtccctgggtacttgagattagggagtggtgatgactcttaacaagcatgctgccttcaagcatttgtttaacaaagcacatctgcacagcccttaatccatttaaccctgagttgacacagcacatgtttcaggaagcacagggttgggggtagggttacagatcaacagcatctcaaggcagaagaatttttcttagtacagaacaaaatggagtctcctatgtctacttctttctacacagacacagtaacaatctgatctttcttttccccacatttcccccttttcgacaaaaccgccatcatcatcatggctgtttctcgatggttgctgtctctttggagctgttgggtacacctgcagactaacaacagacaaaacaggcacacaaggattaatatgaaatttataatcgtagtacttccgatggtcttaacccaagtgacagggttaagatttgcgaggccatcagcaactcctgcgattgcctcagttcctggcaccaaatttaaatgggcttttgatgtttcaaaaatttgttcctttaatttggaaatgtctaaagtgagattatcttctgttccctgtagatggcatctgaccatgtcccagtgatgctcagactcattataaacttggggtgtaatacaaaaatctgagatattccagtcacactgtaactggaaacgatggtctaagttcataagcctgtctcccatccaaatgacagtttgtctaagatcattaatttggtttgccaatttttgatcaataccagattgtgaattccacaatcttgtagaatttttttgccaatcattaacaaagtttactgactgaacagaagagtgcaatgcaactcctgccatagcagccgtagctgtgactgcaattaatcccataatcactgtaattaaagtaaaaatgaatcttttggatctatttaaaatggcttttaatacttcagtcaaaatatggacggatggcaaggcctcccacggttggtccatggacatagaaatccacacggcttctcttgccctcaccagcagaatacactgttgccaattaaaagttgaataaatgcaagtaaacaatctgcaattttcacagcttatagtttgagagtctggtttaataactatatttcctacaactagcatataagggggctttacacaggtttggaaaggaactgttagactggaatttaggttgatagtataaaatagcttacgatctcgtttctaaagtttgatttctagaccaaattctaatgcagtatgaggccacagtaagcctccataattctggatgttcaggaccagaaacaggacttattatttttggtcttggggtagagattcctttttctccctattcccaagggtagaaagactgtaattttttagcttatgtttgtctaaactttctgttaagtcgctatcaacagctrgactcacttgtgcactgggacacgactgagtttgtcctgtgcaattgtggtagaattgacctcgaggtgcccaatctataatagttccgaattcactgttttgtaatatcaccgcactattggccacacattcttcccaaactaaaacttctgtattttttgatcctttgggaatttccttggggcaaggtttccctttaggtctaaattttaatgatctttgataagaaaagtcttgtaaataatttacccgtggcctgagtgacatcccgcttaccatgtgataagtgaatctactgatgggactgacagtaggtacttctaccaaccaattttggactgcaggcattaaacatcctggtgctctccctaggcagataggaggataatgatacccaatggaaatatttatcatcatcccttcttcctcaggtttggcagggcaatgatcatctgtggggccaggtacccatacactatcattaacatatacttcaataggattatccatccatgtgactggtgtttccatctccgcggtggcgcttttctttgcatctccgatgggttcatcgtagatcttcaaatgtctagtgggtatccaaacaggaagctgattttctcctggtgaaacacaagcaaaacctctcccccacgtcaccaccttccctatttcccatgtcttatttttattatctttccaccaaatcagttttccttcatgtgggctgttctttttaccagtaaaatgttgttctgcagaagtagtagtctgatttctataaatgtttaaaaaatttaaagtatagagtgctagattaagttgcatctgaggagtggtacattccttactgtctcccccttctttttgcttaactgagttttgagtgttctattagttctttcaactatggcctgtctgtgggaattatagggaattcctgttgtatgtgaaactttccactgatgtaagaatttttggaaagctttactacagtatcctggtccattgtcagttttgatctttttctggaactcccattacagcaaaacaagataataaatgttttttaacatgggaagtactgtctcgattatctggccctaaacaatgtaaaatcacagtactttgatacacttctgaggctgtgcctacgctgacaagccctgtaacagcctttagtttaggccaatttttggccactgatttaaagcaatgatagagacatctgctccagtgtctactaacccttcaaactgttttccttgaataatggccttacacgcaggtctgttctctgagacccgacttgcccaatatgcagcctttcctgttggatcagtgcttccaaaccctcctgttctttttatctcactatttccaaccttaatataaggcaggagtaataattgcgcaatcctgtctcctggactggcactccaaggaattgaagagctaataaccaattgaatttcgccattatagtctgaatcaaccacatcagtacgaatttgaactcccttcagacttagacttgatctacctaagattagtcctacagtcccctcaggcagtgggccatatacccctgtggagattttttgtgggggctcccctggaagcagagagactgcctttatagtacataaatccacagctgcactgccgcttgtggcgggggacaattgttgtactgtggtaactggctcattccctgaggcacttgggacagtgggggttgttgtccctgaaaaccctgaggaacaaagggctgaattgggaatgccccagtttgttgcggggcctgaggctggcccctttgctcattttcccgacaatggttgcccatttctatcaaatttagaatgacattgactagcccagtgttttccttgtttacatcttggacataagtcaggtggctcttttttatttgagactgggcaattcttttttagatgaccaatttgatcacaattataacatttccctccaaatgttctaacttgtcctcctaaagcaactcctgttattgtggaataaagtttagaaaatatccaaagcttatcagcctgtaaattctgggtagttcagttgtctaccatgctgttaattaaatgaaaacatcctgttatttcagggtccttccttgacaaagtactatacagctgaagaacatctcgaatayarttttggtgggaaaggagccaattgatttcaacagaatcagatctgagcttcataaagtctttgaagtgacttcacagagacgcagacatgtgcacttgaagatgctgccccttcccyggtacctagcaaagctcctgcctctttgtgtgcgtcactgtgaaaccccyacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggactaccagtagatgggactacaggcacctgccaacacgcccggctaatttttttgtatttttagtagagacggggtttcaccatgttagccaggatggtctggatctcctgacctcgtgatccacccgcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatatttttaaaataagtgaccttgtgttctttaaccagtccacatctttagagaacaaaaatgtgttatgatattatgggccatgctaatgacctctagaaaacatcagaatatttctggatatttaataatagctttatatatgactaatgctcatttctatgtaattctgtttaatagttgctttaaaggtgaattttgccacatttactttgacagcagtataaggagtgagatagacatgaacctgaatttcaatttaaaatcatggaagagagggaaaaaaaaccagcttaagaaaaatcaactgataaactgcaagaaaaaaatgcaacttacatcacaaaagctaattgctttattatttagagagtacttaaaaattaaagaccaaacttctctccacccaacaaaaatgggcaaaggacatacagctaggtcaccaagaaagaagggcaaataggtggtgagtacatgtaaagatacttgataggacttttgcttagttgaatctttagcaaatctcttttatttcttgggattttgaagaagtaatttttaaaggaggactagaaactaagtgattgggaattggcctttttagaattaaaatttcccattacaagaaaaaaaaatcctgtgttcttttttttttccagaatggagtaggtcagtgagcaatgtgattaataaatatttcaatgtctgtgacttttgatttattttggagacagggtcttgctctgttacccaggctggagtgcagtggtgctatctaggcttactgcaacctcacctgtcactttttaattgcaagaaagctgaaaggtttttttctattatatcagttataatgagaaatactgtatatactaactatgagtaaaatactatattgcctaacttgtattattaagcaattctgctaacctgtgaccttacattttcatctgaaaagcaggggctggacaccaattgccctatgaagctattgctagtcctaacattctttgttttgtttgcttttttggcacacttaagtgtgtactatgaagtttatgatgctttaatgaaattttctgtctctaccattgtaatgagaaaggaataaaatactttattttgcaaatctacttatggaatatagttctgtacctgattgttttcataatccctgtgttgatgtgtaatgccacagacatgctcttgatagtaacaggaaagaaaatcagacacagctaaacataaaggtcagttggctggcaggtgcttagcaggtgtaaatagaggcccattcatgctgctccacttgctcctgaaaagcataatgtaaatacagtatactaattaggaggcaaagaaccatctaacatggttcttttttttttttttttttttttttgagataaagtcttgctctgtcaccaggctggagtgcagtggcgcgatcttgactcactgcaacctccgcctcccaggttcaagcaattcccctgcctcagcctcctgagtagctgggactacaggtgtgcgccaccacgcccagctaattttttgtattttagtacagacggggtttcaccatgttggccaggatggtctagatctcctgacctcgtgatctgcccacctcggcctcccaaagtgctgggattacaggcatgagccaccgcgcccagccctaacatcaaattttaaaagagttggccacagtttaatgacatccctgcacaccagcctccacccatactgcccttcataagccccttaaaggagatcccatagttctaaaccgggtccacaaacacacatatcctcattctctccttttcttctctttggcagtttgacaaaatctttagggggaattggaggaaacattaatctcctaaatcaacttcattcaaagctttggcttcaagttctacccgttaaggcctcaggaagttcattgtcgacattgaactcagtcactaaaatgacctcaaggctaagggatagaccacagctccacttcacaagtaagcttgcaacacctgatttaggaaagtttgctgtgcagacagttgtagctcatccattttacagaccgatctcgatttgtttcctagggtctaaaattatttaaatcaaaatctctcagaaatttctggacatttaataaattcatgctggaggagaactggcagagatatgttaaatgcacttgaccacaagaaccatttatttcatccaatatttaccagctattcattgtacacttactacagattttggcactggagatattataagaaagctctaaccctgacttatggaacttatcccaaaaaataggaaacaaggctcagaaccattcaaatgaagcttcagttaactcaaataaaaattagttttataaatttaatgtgaaagtcttcgagtatattaagaatggcttgattaaccccagggatggaaattttactgattgaaagaaagtttcaataaaataccgatcttcgaatctaatctgacacctgaaactaggaaatcaaacactagccatattttttcttctattctttataataatttttctcatgagaaaaaggtatctttcttccaagcctgaaaataaatggagaatttttaatatctattgatgtggagaaaaataaatagactatctgctttcacaaataagtgctggcattgagccacagaacatgtctgtcatattgctctttcacaccatacattaacaggaataataatttctcctcattgagtttcctatttactatccccttaattatacctcctttaattactgtcatagagtgtctgaattttataatccaagatactaagatgtttatttgatataccaccagactcaatgtcttgtattctatgccaaaaatttgaaaatgtttgggaagaggaaattccgtggtttggtgaacccagaaagtcttcagtacatctcagttatagaactgtattaaatacatttaaactctataattccataagacccattttaggtttatacactaagcatccaattcctcactatcctctcatacaaaccctgtgtaatacaagttctactcccataattctatgaacaaaacaacaattgatacatagatttgatttttaaaatacattttctttaccttattctaagtgtaacatagggtcaacatagaaaaagaaaactgaaaagcacaaggaaagtgaaatatctataatcttaaccattgttaattttgttgtgttccaaattagtgtatgtatatatatatatatatatatatatagcatttttgttttaataaaaggactgccaaaatgcacatgccaatttggactctgctttttccacttacaatgatatcatagtttctcacatttggtattcttttgcaatacttgctgcatagaattccatcacacaaaggtaactgccagaaattccttattacttttgctagacacttagggtttacattttttacaaaaattataaatctttgatcacagctctgatgatttctctgggaactgagagcctaacacaagtcatttccactttaagacttttaacattctgaaaagttatgttacaaacagagtgctggtccccctgcaacatgctcactcacattggctgacattttaattctttgccaatctgaggggaagagatgtcaactttttttgtttgctcttttaatgccagtcatgttcccttttttttcccccttttaccagtcatactggcttactcagaaccctacaaatcaatcctgctcattcttaattttccaacattgttcctgagattgtttcaccagaaaagttctcccccttatccacttcgcctaacaatttctacccatcccaatcctcctgcatttattgcttccaggaatttggcacttaggacacccttgtccttacattgttcatgcatgtatatttcgtcttcaataaaacatttagttgctcaagggcaagggtcccatagagtctcaatatgctaacggcctggtgttgcttaataatttagattctgacgggtcctctccagggaggggagcaaagggcaaattatcttaggggctgggagtgcagaagccaaacctttgagactgtgaaaagaagacggcgccgagacgattcagtagcaggcattcaagcaagaaaaactcaaatattgttcccaataatgcctgactaatgccaaataccaagtaagggcccaggcagtcctgacagcctgcagtgccccaggataaaactaaccctgaggggtgctagcccacgataaccccctgccagggctctggacacgccctgtctcctcgaaggccaacgggctgcccctgcgcgccgaggccccgccccgcggcccgccgattggccccagccgccccggcgctaagactcaatttcacactacgcgcccaggccacgcccacctgtcatgcggccctggaaactgtgagtttggggattgttgtgtccactaaccggactcagaagggacttccctgctcggctggctttcggtttctctgctcacctccggataaatcacggggtctcccgcgccgctcatggcgcctcccgtccgtctcgagcgtccctttccttcccggcgctttcctgggttgcttctggcggccctggtgttgctgctgtcctccttctccggtaggaccccggggtggattcgcgcgtccgcggcgaggctagagctctgctcagtcagtcgggcaggaggcgcggggcgaagctcactgcacgtcgtgcctgcttgggatagagagcgaggccagggttctccgaggggtgccgtgctcagatcccgggggtatgtggcgggggatgcgggaaccacgcagaagcttgtttggtggcatcgtgtgcgcggccgacatttacgcaggatctggctgcgttcccaaaagaagcgtgaatcgtgttttcgggattgagcccagtcagcaaggggagggcttactgggcgccccaggtgagggcttgctctggagtgcacaggtgcgtgggattgttgctagagcccgtgctgtgcccgtggtgagagtttgccctgtgttcccttggtgccttggtgagtagggtgttcattagggcttggacagtacccgcggtaagggttgcagtgcgtctgctgtgccccatgggctgggctggcctgggctgggctgggcgagcaggggcctggccaggtgttgctgggagcgtgctgtgcgcaagtggcctgtgtgcggagttcactgtgggcaagacagctcactgtttgctttgagtggagcgagcgcggactctgcggctagggagggcatgttgagtgagagcaggctctcagtgcctggggttagagaggtggtaagggcgcaccatgcttttagtgccttctgtgaacagtgtccgtgttgcctgagatcgtattggtcttgaattttaagtggctgcttttttggggggtgggtgggccatcgagtcatcttcctgttcccaaccaatatagacagtatctgattccattgcctagtggctttttgacattgttttccttcttttcattagtttgagtcatatttgagagatgtgaagcaacctaaaaaacactggtagccaaacctagtgagaaattagtatcctaacaaaggaaggcagataatgttaatcttgttttcccctacagctcataaactgaagcttaaggcctatcccactgttttgtatttcattgaatggaatcaatatttttaaaaatgcatgctaggccaggcccagttgctcacacctgtgatcccagcactttgggaggcccaagttgggtgattgcttaagcccaggagttcaagatcagcctggacaacatgtcaaaaccccatgtctacaaaaaataaaaaaattagatgggcatggtggtgtatgcccgtggtcccaactactccagaggctgaggtgggaggatcgcttga

SEQ ID NO: 17668 - DNA, 48086 bp, Homo sapiens
aaatattgtccactacagagccaagcaatgtgccattattacattttctttctcaaacaattttccatttttcctgtagtttttttcctttgcttatttttctatatactgtcttaatttcccccccccaatataccattggatgtgacaaatgtccactgatattcttttccaaaaactttatcagttggccgggcgcggtggctcacgcctgtaatcccagcactttgggaggccgaggcgggtggatcacgaggtcaagagatcgagaccatcctggctaacatggtgaaaccccgtctctactaaaaatattaaaaaaaaaaaaaattagctgggcgtggtggcgggcgcctgtagtcccagctactcaggaggctgaagcaggagaatggcgtgaacccgggaggcgaagcttgcagtgagccaagatcgcaccactgcactccagcctgggagacagagcgagactccgtctcaaaaaaaaaaaaaaactttatcagtaaatgcattaattattccctcccccacaacccgaggcctgcttcctagcaccctttgtctttctctccttcccactccgtgtctttttcttctaatctggacaagttgccctctaattttgctgcacagctgtcaagctgagactcctctttgccgataatctgtattagattctctgtttcccaaaaaccatgtcttccccttttttgtgtatatatatatattatatatatataatatatatatatatatatataatatatatatatatatataatatatatatatatacacacacacatacatatatatacgcacatatatatgtgtatacatatgtgtgtgtgtatatatatatatatatatatcattttttttttttttttttttttttttgagtctcgctctgccaccaaggctggagtgcagtggtgcaatctcggttcactgcaagctccgcctcccgggttcacgccattctcctgcctcagcctcccgagtagctgggactataggcgcctgtcaccacgcctggctaattttttgtatttttagcagagacggggtttcaccgtattagccagaatggtctggatctcctgacctcgtgatccgccggcctcggcttccccaaagtgctgggattgcaggcatgagccccggcacccgccttcccttttatattttaactcccttgttttgctggattatatcctctagtaagtacccaagacaaggtgcatgagaagtaaaaacgtttttagtccctgaatgtctgaaaatacctttaatttgtccccacattttattatagaattgttagaaatacttttcccatagacatttcaaggccttgctgcactactttatgacagccagtgttgctcttgagaagtctgatgatctttgtgttgacctttttgaaaatctttccctctctctagaagctgttaggatcttccctttttctttagcattctgaaatttcacaatatgtctcattggtacgggttttctaacttttgagcgtgcctttttgatctggagctacttgtcctttggtttgggaagtattattggattatttctttaattatttcttttgtttggtgttctcttcctctctcatataactcatattagtctgggtgcttcctggattggtcatctgattttcttttccttcccctacccactgccgcccgactgtccatctctttaatttgtgttctgtttttctgggagaattctcaattctatctcctgacttttctgttagaatttttatttcaagaagtattatctaattctctgaatgttcctttttttcaaattgtccctttttcatagatagaattcttctcatatcttcaagggcattgtgatttctttgaagatttttctgctttttgccttgtctctgttgcctgtgagcaatttttctctattttgggctttgcctttcatgtcacaggctttgcccaagtgtttggtgatccttcagtatttagaaatgagacactaaaacatcaattgaaagttctgtgtgtggtgggtagtaaactgattggcctcaatggcaggtgatcaaatagggagtcagctgttttgttatggggcctctgaatgtcattagctgtagataatggtaattaatggcagtaaacttacagtaaagttgcaaaactcccatacatgtcttacccagacactaattgttaacactttgctgcatttgctttctaattcaatatctctgtgtgtgtgtgtatatatatacacacacatatatacacacacatatacacacacacatatacacacacacatatatatacatacacacatatatacacacacacacatatagttcctatatatgtgtacacactgaaacattttaaatttcaaacatgattccttaaatattaggttggtgcaaaagtaattgtggtttttgccattgaaagtaatggcaaaaccgcaaatacctttgcaccaactgaatacttcagtgtacatttttttaagatcagtgacgttcacttaagaaacaattcagttttcaaactcaagatatttaacattaatataatctattattgaatctacagaactccttcaaatttccccaattgtcccaacaatattctttatataaattttttttctgggccaggatccaatatagaacagagagcactgcaatgaggtttcgcagctcttttgtcccccttaatcaggaagagcttctcagtctttccatatctttcattacattgcccttttttcacactgacatttttgaaaagtgcaagccagctattttgtagatttttttttttttttttcgagacggagtttcgctcttgctgcccaggctggagtgtgcaatggtgtgatctctgctcaccacaacctctgcttcctgggttcaagtgattctcctgtctcagccccccaagtagctgggattacaggcatgcaccaccatgctgggttaattttgtatttttagtagagacggggttgctccatgttgttcaggctggtctcaaactcctgacctcaggtgatccacctgcctcggcctcccaaagtgctgggattacaggcctgagccaccgcacccagcctgtagaatgttaatgtcgggtttgtgcaatgtttcctcatgattctatccatattgtgcatttttggcagaaacaatgttgtttcctttttgttgaatcaggaattgatctacaatttttatccaagattgcctcccacacattatttcattctacctgatgtacctggaaactctccagatgtttatgcagaacaacagccttgctctgattttttacacaatataatttattctaaagagcacactgtacccattcttttgccccgtaaacctttcaatggcttttagccaaaagcagtgaaaatctgtctaaattttgccctgctgagttggactctgatgcatttgtttctacactgcccatatgtagactgtacttagaaatatcttgcactattttagatttcgcagcccaacgctggatggatgattaaccaagtaggagggtattaggatacaagaggttgccattttaatgcagtttttgaaaaacaacagctttggccacacctggtggctcacgcctgtaatcccagtactttgggaggccagggcaggcaaatcacttgaggtcaggagtttgagacccacctggccaacatggtgaaaccccatctctactaaaaatacaaaaattagctgggtgtggtggcaagtgcctgtaattccagcggcttgggaggctgaggcacgaggatcacttgaacctgggaggcggaggttgcagtgagccgagattgtgccattgcgctccaacctgggcaacagagtgagactgtatctcaaaaacaaacaaataaataaataaaataacaactgtattgagacataattcacatacccataaaactcaccctttaagagtgtaaaatttcacgggttttggtatatttacagacttgtagtgatgtaaccatcaccaatatctaattttagaagagttttgatgcagggcagctgagaccccagattgggtctcagcccagcagggtttttagctttgtccaggaaagaattcaagagagagcccgtggtgtgagacagcaacttttatggaggtggcggtgtccagcagcagcagagggggcctgctcctgcagtgcagggctgccccacaggcagtgtgctgagagcagcagctctgggcgattctgcagtcatgttgatacccacttttagttacatgcagattaaggggcagtttatgcagacatttctaggaaaagggtagtaacttttgggtcctcgggtcattgccatggaaggggggtgataactccaggggcgtgccctggtaaactgacatggcacactgatatgatgggcatatcttatgctcatcttccacccagtccctgttttagctagtcctcaatttggtcctcaatctggtgtccaagccccacctctggcgttaagtcctgactcctacctgtttcaccatcactgcagttttaagagtaacgaatttgggtcccctggtgaagtggccagaggcagagcttctgtgtgaactatttggaggggaggggaaagaactctcccagactgcaggttctgaaaggaatacagagatgtcagagactgcagttgcaagagaaagcttttataggagggtgtagaattaaaggacaagaggactctacatgtggatggaggagggcaccctgtccggcagtactgcaagagcaaaagtttggaggtgggagtgaggtgagtgcgtctgccggccagaattcttgggccagggtgagcagaaaggttggaggccaagggaaggtgggtggtggtgaaccttatcctgaagtgtgcaaggtgacagtcagaagcttagaactccagccacgggccctgcatgtggcctcctagctgtagtctgtccaccgagatcgtgaggatgctggtggttgaaagaactgcacctctgagcaggtgaagagagaagctaaggaggggtgatggcagaggcgatgggacaggctttctaacaatgaggggctggggatcaacgctctcacggaagctaaaagagccccagcaaccacccgcctgggccctgagctccctccaaagcgggaggggattcactaagaggttgctcccctagcattgaactcagcatcctatactggtcctcaccatgaagacccccaagagtgcttcagaccattgcttctcacattctctgtataaagacactaatttgtttttagatttccaagcatgtcacggaccaatatgtttgttaaatatactaagaatgaattgctagaaagatgaaattaaaaagacatacaccgccaggtgcagtggctcacgcccataatctcaccactttgggaggcggaggtaggtgcatcgcttgagcccaggagttcaagatcagcctaggcaacaaagtgagacccccgtatctacaaaacttaaaaaattagccaggtgtggtggcgcagtctgtagtcccagctattctggaggccgaagtgggaggatcgcttgaggctgcagtgagccgagatcgcaccactgcactccagcctgggtgatagagtgagactctgtctccaaaaaaaaaaaggacatacatcatgcaagtttggatttttgtttttagattcaactgacgaagttacgggatcaaactgctgtaggagctgccaaacgcttctctccatttctggccgcggggccgcggaccgccctttaagtagcccgttttatccccggcagaggtggagccttaggcaggcctagagactttcccgggtcctccaggccggggaacgccccgctcggaggccgggcttgggcggagactgcgccggggctgctgaaaactagccgaggagagccagggagccggagagatcgcgcgcctgccgccgccggagcctgcgagccgagaccgtaagcgcccggggccggccgggcccgcactccccggacgcagacgcggttcgggctccgcgcgggctcggccgccggggtgggcggcgggccggggcgccgaggggtcggggctgcggtcggcccgcaggggtgcagagggacttgtagttggtccgcccccagctcctgccccggccaggagactgcgcgtgccgcctactgggggaaggagcctgcaggcgaccgcggacttctcgcagggaattccgcgtcccagactgtgggcggacgccgcagggagggaggctcgcgaccccgagagcgcaccgcgtcccctggcctgggcgagctctgcttccagggccgtggctcgctcggcggtgaaatgcacttaatttgtcacccaagtcggaacactgattttcatgcgcgtccgtgtgaagagaccaccaaacaggctttgtgtgagcaacatggctgtttatttcacctgggtgcaggcgggctgagtccgaaaagagtcagccaagggagataggggtggggccgttttataggatttgggtaggtaaaggaaaattacagtcaaaggggggttctctggcgggcagagtggggggggtcacaaggtgctcagtaggggagcttttgagccaggatgagccaggagaaggaatttcacaagacaatgtcatcagttaaggcaggaacaggtcattttcacttttgtggtggaatgacatcagttaaggcaggaaccggccatctggatgtgtaggtgcaggccacaggggatatgatggcttagcttcggctcagaggcctgacactgatcacaccttttagttgaaatgcgctttcatctccatctgctgccgcagccgccgcccggcaccccctcgctctggtctcgggattgaaggccagccctctcctcttgtagaacaggaaacttgcccgggagttcaccttgtagttgaagccagggaatgtggtcaacctgagcaaaagcgccgcggagaccgagtggccgcctgcctccctccctggcagatgtcggttttctctgagcttctggctccttccttgccctggcggctcccgagatcttggaggtggggtgcctagcaatgttgtaatcctaattttgacttttttttcttaaagttgaatgccccctccatagcccacctcccattgtttaaacttcaggttccgcaaagcctggatccgcccctacaggcaacactcgttgtcctggaagttctgtgagggctcagcttgtggctggaggtgggaggtgagggggacccatgcacttggcaggcccgcttccaggacagccctttgctgggattgatgagctgttggtggaaaattgttgaggaccttggggttggtggctgtttcggtaccactgtgcagcctcctctgcatccagcataatttaaaataaacattttcaggaagccacacttctccagaaagtaacattgttttctggtgtaacggttgcctccttcagggagctaggtttgggggataatagggggcctttcactggccccacttggtctgacttagcagcaaaaactctgcgagtgctctccaagcagtttttctttcccaaatttccacacctaggaggcgctgaggaggcatgggcggtacttaggaactgctcactgtggaactgaggcacagcggggagcatgccctcgtgggatttgcagttctaggggcagagggataataaacaaaatacatttgtaaactataaagtatgttagaagatgatgtgtaatatggagataaataaaactttaaagaggggagaggagtgccaggtggaaagggaaggcctcactgaagggtggcactggcatagacctgaagagttagggagcagccaagctgctgcctggggtgcaggtgcaaaggctgggggcaggagtgtgcccagcttgaatggcctgatgtttgtgtttgcagagtgtgggtcaagctgatgagtgacctactggataaactgaactagctcagtctgtaagtgaggggactcctgagctttctgcggccttcttcccaattccaggaaaggaaggaccttccacagaaaataactrctcagcaagacagccagggtgaacctcagcaccatctgtgacaagccacatgctctctgcgtgatgcctcctgcctctcagctgtgcctgaagcacactagctggcatggacttacgcggctgggaacatcttcaggaagccctgaatgagggctctgtgggcagagggacctttgcagaaagggcatcttgaccactgcaggaggtggagtgactctcctggggtgtcctggttcctgcctgatgtcttaagcataactggcattttcagggagcccaggttcaccaatgcacagtgcccctcctgtcgacctgatacccaggcttggtgattgctcacctggcaccttgattcccgttctggtatcttggcccaggcccagacatgtgaaagcaggggctaccgagattcatttctcagttcttacgccaagaggttcaaccacatggatcacagctgggtgtaccaaataagggaggaccaagcatgagctggtcacccctgctgaagaagtagctcgaagcccacccactcggggacagagtgggcacagatgggatagacagatagtgattcgagrggtgcctaggatctcatactgaaaacccacctctgctagggccataaatcccatcaacagcaattcattcctttgagaggtaatacagtgatgtgggaagaggattgggctggaaaaaagacttggctcatgtcccagctctgccattaatgtgtcccctctctggacctcatctgtaaaatgaggttaggctcagcgatctgcaggccttcttgcagctctgctatgtgatgattctgtggcaaagtctgaagggatttcaggaaaggaatgtgtaggagggaaacagtaagttttgaagggactcagtgggccctgtagcctctgctgggtccagtgaagacacttcaactagagtgaaggccctggccacagggtaggggaggcaaaatcttaagagttcaagrgccctgagtcaaggcaggagggtcactgcccagcccagctggccccctgggctgcctgtgtgtggttcttgacccagacctagtggcttaggagcagagtctccaaggggctgtgggataaggtggggattgcaggagggagaaggcaccccagcagttcccccgttaggggaccaaagcgttgccaaggatccagccacacccctctcctgaggagggaggagctggtgggcgctccaggaagagcttcctctcaacaaggagaaaactgcgcaatccaatcctccgttatataactgagcacacgattgtgcaaaccaagctcacactgagcagcctcccctattgtcaaggtttatttactttcccaggggaagtcatagttcatcctttctcagcagaaagcagccatttgactgccacagcctgacctacggcattccaggagatgggttcagagacctggtgtggagtcctcatgcccacccgccctgctgtctgtgtctttccgtctgttgcctggtgggtgggtgtggtttagtgcatggtccagcccccgcacagccacacccattaggctctccaaggcctaactgagcaagcttgcagaagaggggaaagtgttcttttctctgaggagttaaagagacttctggaaaattctccagctactccacaaactaggatcacaggccttgttcttaggtcgggagcaggagtttttgctgcctttagcatttgggaagtttgatgaatagagactgaatttgaatgtctttttggtacttaagagctggattaactacttcacatatctgagcttcatttttaattctttttaaaacagaaaaagtggctgggcaagatggcgcacacctgtaatcccagcattttgggaagctgaggtgggtggatcacttgagcccaggagttctgagaccagcctgggcaacaaagtgagacctcgtctctataaagaataaattagctgggagtggtggagcacacctgtaatcccagcactttaggaagctgaggcaggaggatctcttgagcccaagagttcaagaccaccctgggcaacatagcgagaccctgtctcaaataatttttaaaaagaaaaactacctcttcttaagatggttgtagtatgggagatggtgtgtttaagtcttcccaccccagtgtcacagctcagggcttctctagccttcctcacagcggttgggggtgcccagacacatcctgaagtctaggccgtgttctgagtgtctctgccacgggcccgcctggctggctttagtccaggagcagcctggactgtgactcttgaaggctgtgggaggctggtgacygggagcaggaggtctcagtgcatccctgaagggtcagagagccatgccgtgagaggccaggagcaggcagccattggccctccagccctcaccaaaggccaccacctcagcttgtcctctggcaacycagcctgggaatttgctttccctgtggaacgagagacactggccgcattgaggggtgactttccggtcctacaaaattgtagccctctttctgctagaactggtgagacttggctaatttcggagagactttaggaaagtaagagaaatacattggtcccagtgccaagccccaaggccatctttccaggtatgggtatatcctgcagtgataagagaagactgactcttaccagctctttgggggaaatgaatatactttcccacgttccagtttttctggctgtggcaggacctgtttgctgccaagttgttcctgtggggaaacagcagtgggcccagcaaatgtagccaccaggtcggggcacagccaccaggtggaagaagcaaccctgccctcttccggttccatgtgtgcctcactgaggcaggacttccagaccctaccaggaaggctgctatccgggtcatagtgataccctgtcaggacatcgttgtttttgtcttgtttttttttgagacagggtctggctctgttgtccaggctggagtgcagtggcgccatctcagctgtctgcaaactccgccccaccaggctcaagccatcctcagcctcccaagtagctgggattacaggcgtgcaccaccatgcccagctaattttcttttttttttttttttttttttgtagagacaaggtttcactgtgttgcccaggctggtcttgaactcctgggctcaagcgatccacctgcctcagcctcccaaagtactgggattacaggcgtgagccacggcacccggtcgagatggaacatcttaatttcagagttgccttcaggactgttgattgaaccccataaatatttttagtcttttgggacttttaaactcctttttgaaacctaagcattgccacaaacaaactaaccttcaccacgaccaaacaacccagaactcggaccctggtcctcgggctgccctacaggaagcacccctagtcctcttgctgctctgctagatgagacrgcaggctcaggttcctccatgaggcccggctttcagtgctctcctgttacacactgcaaggaagcttccagatcgtggagcacattgttgaggaaaagacaccttggggagaagggggaggtgcagagtgtggttaatggtgggaaggaactccggtaagtgtgttatatgatctgctcctattatcccctggaataggagcctctctccactcaagtagagaatgccaaggactggcccggcatggtggctcatgcctgtaatcccggcactttgggaggccaaagcaggcggatcgcttaacaggagtttgagaccagcctggccaacatggcgaaacccctttcctactaaaaatacaaaaatcagccgggcatggtggtggcaggtgcctgtaatcccagctactcaggaggctgaggcatgagaattgcttgaatctgggaggtcgaggctgcagtgagctgagattgcaccattgcactccagcctgggcaataaagcaaggctctgtctttaaaattaaaagaaaaaacaagttattctaactttttttaattttaaaagattaaaaaaagagaatgtcaaggactgaaattgcatagagggcaatgctttttctttataggtggtgaactgggttctgcttgagttttttctctggtaatttagaaccaatggaagcaactcaacagctctaattttaattggcagaatgtgagatggaatgggacctcaaatgaaactccaggccaagagctcatgagccctgcagcatgtggggcatctctcggtcttcttgagttctgtaacttaaagtttgtgtggcctttaaagagtgtggaagtagccgtcccctctccgaaggtgcacaggatttggccagcccacccgcgtggccttccccttcccctctccagaccctccacagcagatggggccacggaggcctggagaagtggagtcactgacctgaggctacatggctggcaggcagcagggccaggcagcaaagcaggcagtgagggcctaactgcccgcgggctggctcggggctccctcaaccacattggcatcccagtgccaatcccaaattgttttctttctatctctccagacatgtagatagcatggaggtggagggaattccctcccacacagagggcgatatgccccagaacagcactcctgcccccaagaaggctgtctcctgacactttttactgctcttttactctcccccagctttttttttcctgcttgtaaactgcatttttcctttcccttggtttctggctctaagctgttttcccagggcttggctccggcgcttgcacagagataaacacggccattggcctggtgcacaatcccagcttgcctgcatccggcctcttccatcctgagtctccaggggtccctggggttcagggacaatggctgagggagaagctgggagttccccccagggtttgcctccgtcactcttgggccagccaagggagtggggctgggagcttcaggatggcttttgggaagcccctgggagccccaaggcttgggtagctgctgacagggagttcacagcaggaacgctcccaggctcccatcctgcgtccgcttggcaggcaggccaggaatgggagggaagccatccgtttttccctttccactggatgttcccttcgccttccccagggaggagtgatgaggctggggtgctggggagggcagtatgggggcaggcttgggaccaggcctgcagaagcagcagaccctccaagcccacctacctctctggcctggcatctgaggggcaggtcatgccatagtttttcccttaccctctctgcccccacactttcctccccaaagtggcagacttcccccaggagaagcactggcttttcacgctgctgtgagtctcagtcactattagagaaacacagtcagagccaggcctgcccaactgtcgcagggctgggtccacctcatggcctttgttctggaaaaatacttgggcattctgccctgcaatgcacttagccaaggccgggcacatggcaagtgctgagtcatggccggctagcactttactgcgattttaggagcactttcttgtggtgaggttctgactgcttgcttgggttgggggaggggagtctttgggcaggcggtagacctgccctttactttgtgtggccggatctgagtctgaccccatctttttagacccaaaaccctgatatttgtagtgcgcctaggatactggttctccagtcttctttggggtcagggggcgttatagtgcctcatgccacctactcagccctcttcctgcatcttatggtctgtctctaccaactaggctaagtaggttatatttattattcctcaaggggaattcagctcttcttgttcaaaagttctgattaattttctatgctctcattcaaagaatttttaaattcattcattcattcaacaaataattaagcttctactagaatgccaggcactgagagtccagatgggagccaaagcagacatggtcagtggcctacaggagcttccgtccagctgtcagtcacataatcaccctgacaaatgtgagctcgacraaggctaggactgagagatctgccttgctgggataggtcaggagaggctacccagaggagggacagtcagtctgaaatctgaaaggtggatagaagttagggaggtgggaaggggagggaatagcttttcgacagagggattcgccttcataaagccccacagtaagacagcatggtgagcacaaaactgaaagatcggggggcagcgtgagatcccagccctaaaactctcacttagctttcaagtaaactgtttctccataatattgataccagtagcactctgaggggctaggggagtggtgagatcacacaggccttgaaggccacactaacccaaggacaatgggaagctctttaagggtttcgcaggggatgggatatacatgatcagatttgcatttccaaaagatcactctggcctggctcatgcctgtaatccagctatttgggaggctaaagcaggaggatcacttgagcccaggagtttgagaccagcctgggcaatatagtgagaacctgtctccattaaaaaaaaaaaaaaaaaaaaggtttgtatggtggctcacgcctgtaatcccagcactttgggaggcggaggcgggcggatcacgaggtcaggagattgagaccatcctggccaatatggtgaaaccccatctctgctaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaatacaaaaattatctgggcatggtggcatgcgcctgtagtccccgctactcaggagactgaggcaggagacttgcttgaaccagggcggaggttgcagtgagccgagatcgtgccactgcactccagcctggggacagagagagactccatctaaaaaaaaaaaaaatgttttaaaaagattgctgtggcttcagagtggccattgtgttggaaggggtagagcagatgtgagtggaccgggcagggtagtagtccaggggagagccacaggaacctgggctgggttggagatggatttgagatgtactttggaagttcagctgccagaacttactgatatctgtggcggagtgaaggagaggggtttcaaggacgttgcctgggtttttggcttggcagtagcagggcgggtaatgtcagttactgagggagggaacaccaagagaagacaaagtttagggggacaggatcacagtgcgatttcagatgcactggagaaaattttgacacaaggtactgtctgggccccaggtggctctgctctaatacatttataactctttgtccgcacttaatcactctgtcatacttagctgccagggggccaagaaatgtcaagtgtttggctggtcttctccaactaaaattaaaaatcctttgctaaggaagaaggagagaacattgctagcagtctgcctcaacatcccaatctgatggcgtatttgccgcagccaccagctcatcaaggacagctgcggtgaacctttgagttctgagtaatctcctgtctgggccacctttcttcactcaaccacaaaatcctcacattcccaagtatattttctttctttcttttttttgtttttttgagacagagtcttgctgtgttccccaggctggagtgcagtggtgtgatcttggctcactgcaacctccgcctcctgggttcaagcaattctccctgcctcagcctcctgagtagctgggattacaggcatgcccggctaatttttgtatttttagtagagacggagtttcaccatgttggccaggctggtcttgaactcctgacctcaggtgatctgcccaccttggcctccaaagtgctgggattacaagcatgagccaccacgcctgtccccaagtatatttycttagctcactcttttcagcatgtaatttacagaagggtaatctgaattgtaaacacgatttctaagttaaaactcctgggtcagctcgtgatgaagtagcaatttataaaagagatagtatagtaataaatgagacaactacactcggaaatgtggaatcatcaactcttatgcgaaaatagcctatgagactcttgtgttttttcattcatgccatgcgcttcctcacttccatcccattccattccacatgctcttctttctgcctggattattcccattccaccattatttttctcctggtaaactcctattcatacttaaaaaccctgctcaatgaccccttctctgtgaaaactttgtggcaaaacctaaccacttctgcttgtgcacacttctcttccatctgtgtgcatatagtatgtgtctataactggaagggtgtttatctgttatccgtttgtctgccctgctaaagtgtgagctcctacagttacagggttgtgtgttagtcctggtgcctgcacagtacccagccagtagttacactcagtgttgctgaaccaacctctggtccaaaaacatgtttatacttgcttttccaaggcgccaatccaaatctcttatttactttaaaaaacaaataacttcttggcactttaaaaaccacattcaaataacagaaaaagagttcatttgaactttaagtatcaatcttaaaatgaattgtatgttttaaaacttgacttagtgacatcacttaagagaatttttaaaaagcaaacttttatttttaccccagtgtaacaaatattaagttccattaaattattaaactgatctaccttttcttttttttttgagatggagtcttgctctgttgcccaggctggagtctagtggggcaatctcggctcactgcaacctccgcctacccaggttcaagcgattcttctgcctcagcctcccgagtagctgggactacaagtgcacactaccacacccagctaatttttgtgtttttagtagagacggggtttcaccatgttggccaggctggtcacgaactcctgacctaaagtgatctgctcgccttggcctcccaaagtgctgggattacaggtgtgagccaccatacccagcctgtttttcattttttggttcttttttttttttttttttttttttgagacaggttcttcctctcaggctggagtgcagtgatcatagctcactgcagcctcaaccacctgggctcaagcaatcttcccacttcagcctcccgagtagctgggacctcaggcatgcaccaccatgcctggctaatttttttttattatttgtggagatggggttttgccatgttgcccaggctggtctcaaactcctgggctcaagtaatctacctgcgttggcctcccaaagtgctgggattacaggtgatttaccttttaactgtgccaaagaacaaagcacctactttatttgctctcctgtatttaaaatggtcctttatacctcagatccagaaagataaacacaagtaaactaacaagtactctacttgtatcatttgttgttttctaacagtttacatttagtccatctttgaagggtaaagaccattgattgctcatctaacttcttcaccttgaacttagtgagattttcttccacctttcacaaatgcatgcccaaaatttgacttcagtgtagaattggaattaaaatgtatgcaatcccatttcttacagtaggagccaaatgttcatcaagttcccctctgagctcagtatcttgtagctaaatgaccactatcttccagtcacgtttttaaaaaaaatcatgctggtttgcaacaaaaattgtattttctttactaggcaagtgaaccattttgttgggaagagtaccttggcttcgagaaaaaaatgatttcattctgaaaggcttcccctccaaccccctcctgcacaaactctcagcccagtaacttgtcagtattctggaaaagtgcattacaaaacaaaaactcgaatcagataaaatatatctctggaacttttgaggcagatcaatgaagctctgatttcaggtgctagcaaaataaagcaggcactctcattttgtattgttttacttctcagtttttcatggtgtctcctaaactttgatgttttgaagaagttctaatgtttgctacatcagcaggagctgaccacagggaagagataaatatagctctccttggaaaggtgaaggcttagccaccagaattctgccccttgatgctgagaatgcaccttctccgaacagatggaaaagaggggtggagattaccccagggacatatcttgcaaaatgctgatacccgaagatgtacatagccttgtgctttggtcatcctcccaaatcatgtccttggtgaaggcacatggagaggagagcagatgctgccagaccacggtgcctgacgccatgcactccctcacgtccagcctgtttatgtgcacacggctgcagcgggaccttggggtgtgggctaaataacaagaacaggggctcctctggggtctgttacaaggcagagatgctccacggtaattagggatttakgggaagaggaaggaacacacatgttgataataagtagttcaacattattatccccattttacagatgcagctactgagcttagagaggtttcataacttgcccagagcccctcaactagtaaacagtggagccgagatttgaacgacccaaagaggaaagcaaacaagcagcccctttattactttttttttttttaagatgagggtcttgctatgttgcccaggctgatattgaattcctggccacaagtgattcaccaccttggccccacgaagtactgggattacagtcatgagctaccacactgggccaaagccctcgtattgtaacctccaagatgttttcatttctaaagtcaaaggttgtcagagttgctgttttgcagggagccatgggatggggagtctccgggaaacccaggctggctccttaaatggcatcacccaagttggccatcaagcttccccagactcagtcactcggccccctctttccctggctgtagagcaggggtttggactcgaggctgctgagttcctctccagcttccatgcccagtggcagtgacttatcaactggcccacccggtggatgtaggggtgatgcagccctgctctgtcctcttgagtgctgggtggccatgagagagggaggccatgagagggaggggagggttctcatctgcttagtgccaccccctccccagcccaccccaggtcctctgccgccttgggttcctgcgtgagcagtccttctcactctgggcgatgttcgctttcaccagcccaaccccaagaagtccaccctggggaggacagagggagtctccacggctccacacccccatgctttgtcggagatctggccaggcagagtggtgccctcttgactgagcctcgagcctttgctttccccttactccacataaagccgcagccctggcgagggagcccagaggcctgaggacagcctgctgggtgcctggcactctctagatcctccctgcctgggcggtgggcatctgcaattctccctgtctcgaactgcagcagaatgtgtgggcagggttaggcagatagagagtgggtgcctggactcattggtcagactctaagaccgcccacccccgccgcccccgcagtccttcccaggactggctgacccaccagataggggagggtgttgtttcttattattacattttttgagaaaagctatgcaggcctgggagacgtctgtgccctaggagtcccttctggcctgaagactcaaggctgcaaacaggtgctgagagggaacaagaaggggagttggggtgcaacacacccagtgacagaccaggagtgagtgctgtggccacagattctaatcctcacaactgcagtgtgatttaggctaagccccttgcctactccgattcttgccttaaataagtgaaaaggaaagtcaagtttgatgagttgtggctctttagtgggtggatttgcatgtaccatggattacatttaccagggtctaggaattgtcaagcgcccagcaggctgccatcaggcctccgagctccttcgccaggcggctttatttggagtaagaggaaagcaaaggtttgaggctcagtcaagagggcgccactctgcctggccagctctccgacaaagcagacgggggggtgtggagccgtggtgaccccctccgtcctccccagggtgggctccttgggcttgggctggtggaagtgaatattgcctgcagcaagaagaaggactgttcatgtgggagcgcaaggcggcagcggggttggaaacccacccccacacagtcaacacctgctgtcacaccaggctaatcaagaacacytttctttggtgcattaaccacctgctattaaataaagggctgttactaggtggcaaagtaacacactgcagtagagcctatttgtaatctgaratcagtggctgtaagkcaccatccttgagccaagcaagtactaataytcttgttatcttaattagaatgcaagagatcgtgtttttaaaattctctttgaatctgycactttgccctcctcttcctgggtgatacacctggtagtgctggtgggggccatcataatgccccttgtcccagattcccttcttttagatgggactcgagcactgatcatttcagccctgtatctctcaggtcagcgtggttcagtttgctgtgcagagtccaggggagataaccacgctgtgcacacatgagattggctgacttggcaggactgtgcaattgtcagaaggccgtggggagtgggggccagtgcctgcagcctrccctgcctctctcacaggcccttagagcatcgccaggtgcagagctccacagctctctttcccaaggagtaatcagagggtgagaacrtggagcctggtggacaggtgaaagcactgggatctttctgcccagaaaggggaaagttgcacatttatatcctagagggaagcgacagcagtgcttctccctgtgctgaggtacaggtaaggagggtggtttgtaaagttcactggggagggtgatccctctttattgttctaatattatgctcgcagcctccttgacaacatcatgcaaaatgtgtcttactagyttctagtgcataaaatattggtggagctcttcgctgtgctgggccagtcaccagtgctgggcactgtgggtcaaggcagtgcccaggacgggcacagccctgccttcccaagctatggtttattgtggtaggatctgcctgcccagtgaagtgtgttcagctgctcctgttgctgggggaagctctgctctctgccttcggctgcctcccacacgctcccatgtgtctcccagtccctaacccctagtcctgctttcaataccgcaggggcttttagctgactttwctccatcttcttaaagggcaggatttcctggcagagacataacgtctttctggaaatgaaagaagctgatgcatgttttttcttttctgaattacttaaataagaggaactcatttccaggtattccctgccttgtttttattgtgggagtgtggtcccagctgcccatctgatcagctgacatagggtccttggggcccaggcactgttactgcttgggattgaaagatgaaagccacagggccaggcacagcagctcgtgcctctaatctcatcactttggaaagccgaggtgggcggatcgctggaggtcaggagtttgagaccagcctggccaacatggtgaaacgctgtctttactaaaaatacaaaaattagcaggaggtggtggtatgcacctgtaatcacagctactcaggagtctgaggcacgagaatctcttgaacccagggacagaagttgcagtgagccgagatcgcaccactgcactctttgagactctgtctcaaaaaaaaaaaaaaaaaaaaaaagggaaagcaatggcctggcttggctggagatggaacatgcatcaaygtgtcccacgtgtctccagcagggatagcgaaggcctgccccctggcacatggtagactgagtaaatgttgatcagtgagaccttgaggcactttagagtttcacaatccagagagggagatagaktggaagttcaagggtggacacctgggcatgattcccaggacgaaggctgcagtcggttctaagaagtatgctggtgactatgagagaagaggttgtgggtttcctctcttgaaagctgtctccataatcacatgtggggtgataagggctctggtccaggggagggggcgaggcacacagggggctgaatctgatggcatgaggacttggtgatgggctgtggggaaagaattggagatgactctagggcctgagggtgggaagctgggagttcactgggatcactgatagaaacgcggaggtggggggtgccaagctgattttcctgattagatttcctacagaactgcaggaataaggcgagagccatcgccctgggtggatttctgtttggagctctatcgctggaccactgtggacaagtatttcatagaacgacccccagtagcccaattctaggtttagaggggcagctcttgacaggagcaaactccagggcctctgcaaccccccagcagagtcccaaacatctgacatgtagccaatggaggacatgcaagtggtggggttcccagcagggaccacctcctgccttgggtttccaagacagagcgaggggygctgctggggcgtggtttgcaggggccttgtcagaactcgatgctttctcctccktctgggtcctaactgcagtgcatctagagaccctcctctgactcaggcataaggacggcccgcatattcatgcaggttactctgaacaagaacagtctrtgggttacttccctaggaatgaggaagatgaagagctagataacaatgctgggctggtatctgcctgatagtgctttgccaagactatggtttcttcctcttctgatcaaaaaagacacaggagtcagacaaatggggattaaaagacaactgagttgatgtgaaatgtaacaggcaacactatggacacagaaagtagattagaggctgcttaggacctaacgtggagggcagtaggggagygacagctgaagggtatggagtttctccgtgccgatgaaaatgttctacagttgactgtggctatggctgcacatgtctgtgaatatcctagaaaccactggagggttcactttaaatgggcgaattgtatggtatatgaattatgtttcaataaagctcttacacagctaagctgtgtggccatggctgggcttcctagcagtgtcccccaaccccaaattgaacttactctcccagcacttgggcctccccattaccccctgtctgccctgaggataagcctctctccaagaaggacagagcaggggctgtgggccaccattcaggaaaggtgctcctctcccctgggggagggaacccagaggtcatggacagaagccttctcagacatgcaaaaaacatgaggctgtcgggcgccgtggctcacacctgtaatcccagcactttgggaggccgaggcgggcggatcaygaggtcaagagattgagaccatcctggctaacatggtgaaaccccatctctactaaaaatacaaaaattagctgggtgtggtggcacgtgcctgtagtcccagctactcgggaggctgaggcaggagaatggtgggaacctgggaggcaaaggttgcaatgagctgagattgtgccactgcactccagcctggtgacacagtgaaactccatctcaaaaaaaaaaacaacatgaggcctcagaaatgtagctcccaaaaccccctacccagggctgtgcagaagccaaaccaggttcctattttcccaggatgatgaacagttttcaaagcttagtaggattgtgggtgattttgtctcattgtctgttgtttttccatttttctagatcatatatatataatatttatactatatataatatgtatatagtgtgtgtatatatatatataatatgtatatattaggtcaagtgtaaataaaatcagggacagggttggagcgcagcaggaaagagcctgctggggatcagagtctctgggctgtcagggccrggctgggcgggctccrttgttaatggcttcccctcatcttgcaggagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatcygccctttcaaggtggaaacgtcagatgaggagatccacgtaaggcaccttgggccggrccgggctgggcagtggagagggtggtgtgtcgaagacaggggttgggtcttaggccagatgcgggaggggacgggggcttgggaatggtccatcctacttgggagtgtgtttcagtctgcttttcctctgctgggcaggtgcaggttgctttggagagggatgcccagccctcccactttctctcttctcctttccctacccaaggcccagcagtgctcaggcaggagatggggtaacctgtatcaaaggtcacagaaagcagctgtcatcacctcctctatgccctgcctgaagccttgggagtgaggttgtgggagaaagtgagcaggttcccgtcagagacccaggaagcactgagaaggcagggatgctactggttaggcaccggctgtgtgtcagccattcctggtcacattcaatccctacggtgatcccgcggggtgaggattgttgttcccaaactgcagatgcagaagctgaagctcaggggcataaagcaactcgttcaaggcggcctagctaacatgcggaaggatttgaagtccaatctaatcctgaagctgctgcccctcctctgcacagggatagagtcaggaaggaggtgactgggcaggtggggtgaactgagaatgcattctcggggaggagcaaggcttgagtgggggacaggacggtaggcaggcctggcatggccctgccaatcctttctttcattccgtgggttttgagcacctactgtgtgcaggcccagtgagtgcttgggagaagagacagccccttccgtccaacagcatacagtccagtgaatgagaaaaggaatgtgcacaaagaaaagtagactaaaagataaataaagataggctaggtgcggtggctcacgcttttaatcccagcactttaggaggctgaggcggtggatcacctgaggtcaggagttcaagaccagcctggccaacatcrtgaaaccccgtctctactaaaaatacaaaaaattagccgggcatagtggcgggcacctataataatcccagctactcgggaggctgaggcaggagaatcccttgaacccaggaggcagaggctgcagtgagccaagatcacaccactgcactccagcctgggcaacaagagtgaaatgccatctcaaaaaaagaaacagatgcataagrataaatgtcacaaaaagcatggataaaagtcatgagagttccaaggaggaagagatttaaaagcagaagctgggctaaacccaagagcaaccaggctgaggctccctgggtaggacttgcttgctgcagccttgctatttagggccaaggctgagccctaaggaaagctcctttagggaattagactcctaagggagtctgagatttccaaaatctgtttgggggtaactgaaacacttgggaagaagcctgggaatggtgatgcttgagaggctctctaagctgacatgaacttcctccctctggggctggccttttagcctratacatgycaatgagacttgcaccctctctcctggtctgtaaattttttagtttttggagacagggtcttgctctgtcaccaggctggggtgcagtggtgcgatcttggctcactgcaacctccgcctcctgggttcaagcgattctcctgcctcagcctcccaagtagctggcattacaggcacctgtcaccatgcctggctaatttttgtatttttagtagagatggggtttcgccatgttggccaggctggtctcgaactcctgacttcaagtgatccacctgccttggcctcccaaagcactgggattacaggcgtgaaccaccgtgctgggcctggcctgtaatttttatcccaactcagttataatgtatcattcaatgttgtatatcaggggtcaggaaaccaggcccatagaccaaatgtagcctgctacctgttttagcacagcgcccatgccaagaatagtgtttacctctttaaatagttagggggaaaaaaatcaaaagaagaataatagtttgtgacgtgaaaattatatagcagtcagatttcagtgtccataaatttttattggaacacagccacccccattcatctgtgcattggctatggctgtccataaataaagttttattggaacacagccacccccattcatctgtgcattggctgtggctgctttcacactatgaagacagagtggagtcactgcagcctgcaaagcctagaatatttactatctggccctttacagaaaaagtttgccgactcccgctgtagagacgcctgggtaaattaaagatgagtatcgtgtatacacttaaagagtaaaagatgagctgggcgcagtggcttacacctgtaatcccaccactttgggaggccaaggcagacagatcacttgaagccaggagttcaagaccagcctggccaacatggcaaaaccccgtctctactaaaaatgcaaaaattagccggacatggtggctcacacctgtaatcccagctactctgggagctgaggcatgactggcttgaacctgggaggtgggggttgcagtgggccgagatcacgccactgccctccagcctgggcaacagagtgagaccctatctcaaaaaaaaaaaaagaaaaaagaaaaaagaaatgcgaagtctacagtgaagaaggaagaagtgaagaacacatccgctttgggagtagccagtgatgtgggaaactgccttgccactcccagagggcagtatcttgtggctgcagggtttgctgtgttttctggaaacagactttgctcttgtgctctgtccttcccatccctctcaacttggggtcctgaattttgctccaggacttacaccagaggatcgayaagttccgtttcaccccacctttggaggacagctgcttccactatggcttcaactccaactacctgaagaaagtcatctcctactrgcggaatgaattygactggaagaagcaggtggagattctcaacagayaccctcacttcaagactaarattgaaggtatgtttgcaaaacgccagccagagagggatgtatgtcatgagaacagccttcttccacaatgtgacttacagtcagataaagttggagagattcagaacccaattataggtsactgagatgtacttatacgttgtaaccttactaaatgcaaaaatattgcagtcacaacaaatctgtccatctttagagctaggcaggaacacatacatgcaatttaaaaaccaaagaaatgcaccatccagtccaatgatgtggcaatctttgagaggaaggatggagatgagatttagacccaggccaagtggggtggctcagaactgtaatcccagcactttgggaggctgaggtgggtagatcacgaggtcaagagttcaagcagcctggccaagatggtgaaatcccatctctactagaaatacaaaaaatagccaggtgtgttggcaggcagctgtaatcccagctactctggaggctgaagcagagaattgcttgaagccaggaggcggaggttgcagtgagccaagatcgcgccactgcactccagcctgggctccatctcaaagaaagaaaagactctgctctcagttcttttggatctatactcagaagtggacttgttggatcatacggtaattctgcgtttaattttctgaggaaccgccatactgcgttccgcagcagctgcaccattttactttcccacccaacaatgcctcagaatcccgattctccaaatccttgccaatatttttttcctttctttttttcggtaatggtcatcctaatgggtatgaaatggtatcacattgtggttttgagttgcattttcctaatgattactgatgttgagcattttttatgcggtacttattggattctttgtaatttctccgaagaaatgtctgttcatgtcttttgtccattttttgggtgttttattagggtttaggagttctctatatattctgaataaaatctcttatatttgcaaatgttttctcccactctgtgggttgccatacaattaatctttttcagagacaaggtcttgctgtgttgctcaggctggagtgcagcggctattcacaggcgtgatcatggctcaccacagcctcgaactcctgggctcaagcaatcctctcgcctcagacctcctgaatagctggtactataggcgagcaccactgtgcccagcttgttaattttttatattgaagaaattgtacatgttaggaatcttatttttaatgttttaagataatttggccttttcaaggaacagtgaagattttaatttgttaaaattctaggaattacttaaagtgtatgaaagacatgttggtcagtcagataaactaaagttcctaaaaaaaggaaattgaaattatagtgttaactgggtgtggtggcatgcacctgtagtcccagctactcaggaggctgaggcaggaggattgcttgagcccaggaattcaaggctgcagtgagctacaaggacaccactgcactgggtgacagatcaagaccccatctcttaaaaaaagagagagaggctgggcacggtggcgcacgcctgtaatcccagcactttgggaggctgaggcaggtggatcacgaggtcaggaggttgagaccatcgtagctaacacggtgaaatcctgtctctaataaaaatacaaaaaattagccaggtgtggtggcgggtgcctgtagtcccagctactcgggaggatgaggcaggagaatggcgtgaacccaggagatggagcttgtggtgagctgagatcacaccactgcactccagcctgggcgacagaatgagactctgtctttaaaaaaaaaaaaaaaaaacaggctgggcgccgtggctcacgcctgtaatcccagcactttgggaggtcaaggcgggcagatcacaaggtcaggagatcgagaccatcctggtctaacttggtgaaaccccgtctctactaaaaatacaaaaaattagccgggcgtggtggcaggcgcctgtggtcccagctacttgggaggctgaggcagaagaatagcgtgaacccggaaggcggagcttgcagtgagcccagattgcgccactgcactccagcctgggtgacagggcaagactctgtctcaaaaaaaaaaaaaagaaaaaaaaaaaaagccgggtgcggtggctcacacctgtaatcctagcactgtgggaggccgaggcgggtggatcccaaggtcaagagatcgagaccatcctggccaacatggtgaaaccccgtctctactaaaaatacaaaaattagctgggcatggtggcacgtgcctgtagttccagctactcgggaggctgaggcaaaagaattgcttgaaccagggaggcggaggttgcagtgagccgagatcgcgccactgcactccagcctggcaacagagcaagactccatctcaaaaaaaaagggagaaaggaaggatggacggaaacctcgacttggaggtgccagggcagcaaacatccttgttctgatgcaagcaggccaggcctgtgggagaatgagccagagaaaagctaagtcaaatcccagtggtgtgtgtcctggaactagagcccatcctggagctcagccaagaacactaaaaaaaaaaaaaaaaaaaaaatctggaatgattttttggatcaaatttggacttctcttgagtgttgctgtattctttacagtaatttgatatcttctattatgagcctaacaagaggatccaagccacttaatcccagccaaactgctgtatgcaattaccataggttcctgtttggattcctggcacgaaattgcctggcttccttgagtttgacttggatccctgtgttgtcccagctcttcagtgtccatccagcagaaactaacagggcgcctgctgtacccaggcattctgctggggctggggacgcatagagaggacagggtccctccttcacagctcataggctcttcaggggcaattccagcacatagtggcggtgttctgaaggaggaggctctgggagcttcatgagccccacaatcttcctttgaatgtgagggaaggcttcctggaggaggtggcatctaagctgaaatgagtgggactttgccaggtgtgtggggaaggtggtccaagaaaggggaacagcatgttcaaaggcccagaggcaggaggcagtaaagggccctttccatcctggcagctgccagccttaccccactggaccctttcagggttcttcatgagactgggttttttttagagacagggtctcactctgtcagccaggctggagtgcagtggtgtgatcacagttcattgcagcctcaatttcctgagctcaagcgatcctcccacctcagcctctcaagtagctgggaccacaggtatgcaccaccacactaggcttttttttttttttttttttttcttgagacggagtctcgctctgtcacccaggctggagtgcagtgacgcaatctcgactcactgcaagctccgcctcccaggttcacgccattctcctgcctcagcctcccgagtagctgggactacaggcgcccgccaccatgcccagctaattttttgtatttttagtagagacggggtttcaccgtgttagccaggatgatcttgatcgcctgacctcgtgatccacctgcctcagcctcccaaagtgctgggattacaggtatgagccacggcacccggcctttgttttttctttcctttttttttttttttacatttttagtagagacaaggtctcaccatgtcacccaggctgatcgcaaactcctgggctcaagcaattctcccaccttggcttcccaaagtatcaggattataggtgtgagccaccacacccagctgacattgggcatttatggtacaaaacctccctcaggtacaacggctccaaaagagccagtttccagcattgaattcatcgtggacttacccatgtgtggttctggcaccctgcccggggctggaggcctgttcttggccttggtcctttagaataggagtaaatttggcaacataggaggacacccaggatacattgttaagttaaaaaaaaagagattctaaaatagaatgtatgtatggttctatttttgttaaaagttatgttctctaagtctttttaaaaagtttgaactgtcacagccaagaagggtctaaagagacatgayagctcagtggtgtgtgagtcctggatgggatcctggaacagaaaatggatatcaggggaaaaactgaggaaatctggctcatattttgttgtgtgtagataccagcattatccaggttttaaaaaggagaaaatcctggccgggtgtggtggctcacgccagtaatcccaacactttgagaggccaaggtgggaggatggcttgagcccagtagtttgagaccagcctgggcaacatagcgagaccccttctctacaaaaaaaaataacaaaaataggctagacatggtgttgcccacctgtagtcccagctacttgagaggctgaggtgggaggatcacttgagcctgggaggttgaggctgcagtgagccgtgattgtgccactgcacttcagcctgggcaacacagtgagacctcatctctaaaagaagaagaaaaaaaaaggaaatcctgcaatgtgtgacaacatgaataaactctgaggaaataatgctaagtgaagtaagccagggacaggacaaataccgcatgattccacctatagaaggaatctgaaatagtcaaactcagcagaagcagagaggagaagggtggttgtcaggggctggggaataggggaaacggcattgctgatcgttgctgtgtaaagtttgagtcctgccagccgaatacatcctagagatgggctgtacagcagagcgccgtcagtgttggacacttacaatctgttaaaagggtaggacccatattaagtgttctcgccatataataaaaagtgtaaacactaaggaaatcaatggactttatagttaataatatctcagtctggttcgttaattgtaataaatgtaccatgctaacataaaatattaataatggaggaaacccggtgggtgtgaggtatatgggagttttctggactctttgcagtttttcagcaatctaaaactgttccaaaataaagtttagacagacaacaccatgttttctttagagagtgggattacatgtgagtcttccccctttggcttatctgtgttttctaagttttctacagtaaacatgtattatttgtataatatattaacgacagaacagaacattagctagaccatgctgactgcaccagccctggtggcagagagttccaagcatggcagccgccctcactgtgaatgccgtaaggccccaggtgctgtccagggcactggcctgggaaggggctgccttcttttgatatgcagaggccccaagtcagtccagaggagacaagaatccattcacctgcccttggctatgatgatgttttcagcattgcacttaaaaaaaaatcttccactttattttattttaattttttgagatggagtcttgctctgttgcccaggctrgagtgtggtggtgtgatctcrgctcagtgcaacctctgcttcccaggttcaagcgattctcttgcctcagcctcccgagtagctggaattgcaggcgcctgtcagcatgcccgggtaatttttttgtatttttagtagagacggggtttcaccatgttggccaggctggtcttgagctcctgaccttaggtgatccacccgcctcagcctyccaaagtgctgggrttacaggcgtgagccaccacaccaggcccaaaaatcctccactttaaagaaaatatcatttggtaatcagaaaaaggtgacattttgtcaatgtgtatgaaaaaaattatgcatttaatacctgttcattgtagaaaaattggaaagtacataaaactcaaagagaaattaaaagcactggaatctactgctcaggagaactgctttttacattcttggagtttatcctcccagacttttaaaattcaccaatacatggtataagtacagtataagcatagatgactttttataaaaactgggtcacacaatggatatgacttgatcatttgcttttacctcccagcaatatcttctgatcagttttctatgttaaataaatatacatctaccttgtcagtttagatgactgtactggactccagtatactgtcaaactatacttgattaatcctgtattgctggatacgtggggctttctccctaccctccagattttaaattattgaacaagtatttatggaggcctgctgtgagccaggagctgtcctgagccctggaaacccagcagtggctgtacagacctggcccagctgtcagggggcacctctaaggaaaccgggaggcaataatcgtagctcccttgcagggaggttgtgaaggctgagtgaggacatctgtgcacctggagcacagtgtgagtgtgaaaccagtgtcagcccttattactgtcaataccatgaaggggsggcgggggcactaagggtggcaggactcaatatctaggctctggggggtgccagagcctgaccgtgcagggtcttctctctccctccaccctgactgtgctctgtccccccagggctggacatccacttcatccacgtgaagcccccccagctgcccgcaggccrtaccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaagggtacggggctgctagaggttccataactgccccrtcctcgccaagggtgggcccggtgttcccaccaggctctccttccrgcggggtgagcagggagttggcccgaggaagctgggaaaggaggggcctgagaggccggccccagacacaccgccctccggggctggagatgccacccctatatttgggctccaggattccttcttgcctctgtgagcttttctgacctccacctgggggtaggcgggcctgagaaatttcatagaacaccagagggcccaaggagcaatctgcctgtgactccgtgactccatgcctttccccatcactgccagggttcaactcggtggccaccgccaggatcttttacaagctgatgctgcggctgggcttccaggaattctacattcaaggaggggactgggggtccctgatctgcactaatatggcccagctggtgcccaggtgaggtcactgttggggtggkgtgtgtgtgtgtgtgtgtgtgtgtgtgtgtgtgtcctctaagaagtggacctgtgtgcagggtgggccaaggaccccccaggggagaggagggagtgtgacctgtcactcagcagtgcctgaggcaygttgrcttggatcctcctgtctgtaacccagggttgcggctctgggtcaggttcccaggcagagaaggcctgtgataggaggggaaggtcaggcattagacctctctgctggaccaagctctgggacagccctgagcagaactccccagaaactgtatttttcccccaacctcccttctccaactcccatggcctccccagtggggccagtgctgaaagaggctggctctgtgctcgctcctcagccctgaggcctgttcctccgccatctctcctctctccctgtccttgacaccagcccagcctcaccccggcccctctctctgccttcagccacgtgaaaggcctgcayttgaacatggctttggttttragcaacttctctaccctgaccctcctcctgggacagcgtttcgggaggtttcttggcctcactgagagggatgtggagctgctgtacccygtcaaggagaaggtattytacagcctgatgagggagagcggctacatgcacatccagtgcaccaagcctgacaccgtaggtgagtgtgctcaggggtcctcgcccactgccggctccactggggcagggagacacccgcggggtaacctcaccaccccaccccaatgctgcccacagaaggaagcctcttgtaaggacctcccarctctttagatctttaaactgcattttcccatagaatcaagaggatggaccctcagcagattcccaggccaatttagcaactctgtttagccgactcagtattcatagtggctttcacccctgatctcccacccctgagtctatatcctacactgagaagcagagggatggagggggtgaggtaggaggaatcctgggagtgggcagctctggggctgcaggggagaggggagagggtgccctggggccttggggaagaggttcccaggcagtgagggagggcccagcaaccatgtctgccaccagggtcctgttaaaggacaatactttttcaaaaaggtaaatttataaaggaaccagtaaaattttaaaaagaaacaattcaaagacaaataagaacrctgaaattaatttgctaacagacasaaaacttgtcaacatccacagagtaatatcaattaaatctccatgggacaaaattcatttgcctctatgaacaagagtcattcgcattaccctcagttctttacaattcacagaactgtaaaatagctcaatgacaaggaaagatgggacccctgtagcatcacgtcagtccggaaggtctgctaggtaactccctagatcttgtccagaagacacccaggaattgtcttgcccatctcaaagttcttcatagttttcatggcaaacccatgcccacacacacgaggcagctcataatcataataatggcactttataaaagtcagcatttttctctgattataaaatacatgttgtcaaaaagcttaaaaatgcaaaaagtacaaaacattaaagacaatctcatataacctcttctccctccccacatcccctctccttcaaaagaacttgtgaacattttggtgagaattttcacaagtgaagtacgtccatatcaccaacatggccccaacactccagatgcccctcggggttctctcccaggtaccacgctctgacttctgactgagatggttttgattgtgcctgtttaagtcctatgaatagaatcacagagtatatacccttgagtctggcttcttttgctcaatattatgtttgtgagattcatttatgccattgtcccagctttatttatttattttttctcaagacccagtctggctctgttgcccagggtagagtgcagtggtgtgatctcagctcactgcaacctccgcctcccaggttcaagcaattctcctgcctcagcctcccaagtagctgggattacaggcacctgccaccatgcctggctaatgttttgtatttttagtagagacggggttttaccatgttggccaggctggtctcgaactcctgacctcaggtgatccacccgcctcggcctcccaaagtgctgggattacaggtgtgagccaccgcacccagcctgtcccactgtcccagccttttttttttttttttttgagacagagtcttgctctgttgcccaggctagagtgcagtggtacgatctcggctcactgcaacctccacctcccgggttcaagcaatttgcctgcctcagcctcccaagtagctgggattacaggcatgcaccaccatgccctgctaatttttttgtatttttaatagagatggggtttcaccatgtcagccaggatagtctcgaactccttaccgcaggtgatccacctttctcrccctcccaaagtgctgggattacaggcatgagccaatgcccccagcctgttccagccatttttaatgactgtacagtattttggcttatgagtatatcaatatttgtaactgatcccctattttagacttttttaggtggcttctcatttttcatgaatcagagcacatagactgaaaaaccccgcctttttaaaaacagcacttctcattgggaccccaccaaatgcagaggcgtaggcccttcagtttgaaggaagctgagcaggcagtgtgccaggccctgggagacagtgggaaggtatcgtccctgtttatcagatgaggatgccgaggcagagttaaggaagcgaggcatgtgagcacccaggagttaaggcaggcctgtgctcgaacgtggcttcctgcacacagccccgccctctgcggccagtgccacacatcacacctgaagctccagctctctggtccccaggcctgagtctctcccttgctccccgctccccgccaggctctgctctgaatgactctcctgtgggtctggctgcctatattctagagaagttttccacctggaccaatacggaattccgatacctggaggatggaggcctggaaaggtgaggccctggtttgcccctgcagtcatgaccctggtcccagcagccaacctcctcaccctcttcatccccttgtctggttgctctgcatggggcactcagcaaattctattgttggctttcttacaaatcctcaccctgtgaccaacgtagctgcattttttgggtgaggtggcctggtgggttgttcccagcctcacagtgcatggtcaagactaggatgcaggctcacctgcttgtgctccttttgctgaacaggcccctctggggattagggagcccacagggcagcaggcaccacattattgtcaagagcacctgggcttttcctcctgattccctggagagcctggcatcagggtcacgtgactgcgtgttccaggagggtggtcgcagaaagacaggaggctgttaatctctcagagccttagaggctgtatcctctacatgcctgactcccagctctgtggcctgactcaggcttcaccaaggtcagctctgacccaccctttccagggcccatccctttattccttcagtgacacacaggaccagacagtgctggggatgggaaagacagtaaaatgagactgaatcctgccttgggggtagggactctgtcttggccatgctgtagccccatcacctagaacaatgccgggtgaacagtgggagagcccagtacatagatgttgaatgaatgcgcaaaggactgtgagagtccagtggaaggaggattctttgtctaagcggcagagaggggaaatgaccaggagaatgtatctgatttgggccttggaggataagtaggagtttgctggatggaggagagaaacttaggcaaagagaaaagcaataaaaatgcaaggaaagggtgcttggaaagggtggcttgtccagaggctgaagcaggtacactggggccagatcaaaagcaaactcattcctgcaggcaggtcctcacctcctccaagagcctcagcagggccttcgtctgggatctgtttcccctgccctacattcagcaggacacaggggttgatggagcttctgcaagaccaccttggcagggggtctggcctgctccttgcacacggatacctggagcaagatgtgaggccccaccagactatcccactaggccactcctgcagctctggccccgggttacagggagcaccaaatccctgagcaggaggtagacaggatcagatctgtgttctagaaagaacaggaatacactagggtggaaatggtggtcgtggtcgttttcaagctgcgggcagagccgaaagggagatggaagcacttggccaacttgcagaaatccagttcacagaggtgatgtgtatactggaactagttttcattgaccagttttcattttgccaccaaaatcacattgaaaaggctgttccctttatctctgtccctgctccctgctgctgttgctagagattcagggtttgagtgaggaaggtagggttgggagggcgtgctctggggaaagtggaaggtggggtgggggctgtggagtatgcatcctggacccaagctggctaggtttggattctccacttaataagtaaaatggagataatagtacctatgtcccataggctgttgagaggaaaacatgaattaaaagaaggtaaggagcttagaacatgctgcctggtatgtggtcaccacagtagctggtgccctgagcagtttcacggtgcaggggttgaggggagggaggagaggtcagtggcaggagagaggggacaggtgtgtagaggcaaggtgggtggggggaggaccttggggtgataagagacacttcaactaaatccatgcgctccagtctagtgccctgggcgcagcctgcctgtgacacgaggataccacacacgttgcatgaggtctgaggagggaagccgcatgggcagggcctggcatttgtaggactttctggctgccctttgtcacacaactgcatgtggcactgagagtggggctttgtgttctgcgttcccaggaagttctccctggacgacctgctgaccaaygtcatgctctactggacaacaggcaccatcatctcctcccagcgcttctmcaaggagaacctgggacagggctggatgacccagaagcawgagcggtgagcctggctgagccgagaacaggggcctctgaggctggaggcagggggacggccagtcttgggctccacgaagggcacttggtggtgggataagtatagccttgcctgcargtgccccaggggcccttggatgggaacactaaaggtcgaggtgtttggagaaagccctcatggagggaccaggtgcctggctcccgggcggccctcagtaccgctccccagtctaggatgctggtctggagtggcactgatggttctgggatttccaagtctcacatggaaaccctcaaaggtggggatttagaggctgtcccatgcccctgcctgggtggccctcccagaaaagagaaggccctcagtgaggggagagcggttgagaccctggatttgtccttttctttatggctccttgtgggtgggccagctgatctcacccccaggcgctttaaccccctgctgtgcaggacggaggggcgcagggccacagcctcacccctccgtcggctctttcacttccaggatgaaggtctatgtgcccactggcttctctgccttcccttttgagctaytgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcrgcaatgacccacccctctccccccgcctgccacctccccccacaagtgccctccaggcttttcttggggaagataccccttttctgaggaatgagtttgcctccgtcccctgcccatgctgggagcccacgctcaccccctcacccctccaagctcactccccaacccccaactccgtgtggtaagcaacatggctttgatgataaacgactttactctaaaagcggctggaactcagtgacatgagcgtgcgctgaccccacatggggccccctgtgcaagcagagctggccggcccctccttgctggcagaggcacgggaggcctgctggggatgaggccactggccagggctatgctgcaccagaccaatggcaccgcccccacccctcccagcgcaggggcagcttggagcagaggcagcactggccaccrctgcgggggcaagtcagcgtcaagagagtccctgagtgagaaggcccagataagcccaggccccccaggccagcggacaggcacaggcagggcctacagaggtgccaaggccccaggccagttgtgctaggagcctggacctgctcttccacacccccatcccgcccctactgcacaggcttgtgccttggtgccccctggaggcagcagggaggaggcttctcaggcagaagtcttaagttgcatcccattccccagaatccccaggagggagaagagggatgggctgcccctccttcctgccagagccacagctcamgggcagtgggatggccctgcacccagcccaggtaccccttcctctgtgccgaccatgctgtcctttggctccgaggaggccctgagcactgcccacccccacaccttggagggagcagacggagggggtgagtactgcacagagcctgcctggaggtgcagactcatgcactcagccctgaagaggtgagagaggctggatcttaactgtggtccaatgggcatattatgagtggtccttgtccctgcctgctatggggtaaccctgacccagctagcgtccctgacaacatgatacaaaaacacagaactctagcgggatacagagatgtgtgcacagctggcaggagcactggccacctcccaacctgttccccatagcttactcctggatgtagcctggagggactgctgggctggggagggactggccatggagcagggagctggatgccagcgggacctcagacctggactgcagcatctctttggttatcggttgtgtgtgtgctcagaagggaggaggccttccccttgttacatctctctctccatatattctcccggactcatcagtttggggggcgaaaagtccaccacatggtcttggcgacaaaccactggggatgtcaccccagctgcagagctggaagcttgtgccggaggggaaactgggtgagcaagggaggggcgaggcctgcctgtgctctcctcaccactgctgggaccagaaaagatgggcacctgatagctcagctgggcagtcccaacgcattcccactcagccaagggcctgagccccaggccattctggttgtgtcttttcagagcagtgagacctaaaacagatgggaagaagtcatgaacttgggagtcaggccgcttcacctgtcttctcaccccacaggctcccctgagcctggcccagccagcagctcacccagcctcaggcctcctggggggcagcagccacactgcccgtggcgctctgcgccaagcactgtccagggatagtcccgctgatgttgtggatggcaccataggtctgctgctgctgctgctgcggagacagtgctgtcctctccgaggccaagccgttcagaatccgaggcacgtagggctgtcagcaaatggatttgtgcttggcctggacaggcatgagcttccacactgcatccctcccctcctgcccttctcccaacaggacacagacagtggccataaaggacatatgaagaaacaccgacatccatttaggacattaagaccgaaaatatgacacctgcagaatttcctagcagccagggcaaaagagaaagcacagttatacagttctcatgatcacagaaggaagcacaagagagcagttctcagaggaaactaaacttcctagccctggatcctaggaggatttctcactttgtagaagaaacaagtctacctatataggggggcttagaacgctgccctgggacccctgggatgctcaacatatctgtgtgagtctcattttgagtctcatttcctcccaatcccaggctccagccactgaccccaggcacagagccctgccatactcctcctgagaccctggctgtgagggcttgacatcatccacctgtcctgcatgttccctgcttggccagcatagccacaggtgtgtcgctgggtaatgagtccttctgaggccctcccttgtttggaacttgtccaaggacagacaccgataagagagcctgacacctgggaggcagccaccagaaagaaccctgcagatgaggtcggctctgtcctggccacggctgtcaggaaggctggtgactacagctctggaaccctggggctctgctttcccttcccagccccaccctaggagcaggaccctggaggctgtgtgcagagagaactaggaaggcaaggagccctgtgtctctctaccatggggtcttcctctgaagcaggtgcaatgttcatttcttgaattcaaagggaagtctgcctgacaccctcttggagcctagtggaggacctcgcacaggcaggtgcatcgctgatgacaaacctttgtcaaaccctagcgccttaccatgtgccttcactaaagccccaaactcaccaggcattaaatatgcagagaaggaaagagagcagggaactgaaaccaagggggatggccatgaatcgagacaagactctatctcctcaacagtttcaaatatgcaggttaaaatacccagggggaccaggattccttctctgccattaattcacaaacttgcctgccatgtgatcttagcaagagatgatcaaagatttgccggggcccatctggttgggactgttacaaccaaagcaaaaaaaagggcgacaagctcagaggctgaggggcacagcttactgtgaacggtgggggcatgtgggcctctgcctcacttcctttgtcacttgcaggctcttctgtctgcagataacagcaaaaacttgcgatgataaacaaaactgatctctgtgaacgaacaccctccaaacacacagactattaacacccggaataatagtaccagctggcaccaagctccccagcagcccgagagaggatggggtgggggagtgcagggatgaggggaggaagggaagctacacatggcacccaaccacccacgcctttcccatggagaagcagaatctggagaaggctgctgctgtgttgatacagacaagggtgggcggggttgacagcgagcccgtcccaccatctgttcctcccagggcttgaccgggcagtggggtcgggggcctttactttgtagttcagagggctgaggtgcttgaagcatccaaagcaggtgtgagccaggcagaccaggatggtgagcagcagcaccaggaaggtgaacagagtggcgggggccttcatacctggtgatagagggtggctagccttggggtgggcagggaggggccaccacctaccctcaccctgctgaggaaggggccgcacctggtgtggaaactgcccgtgacttctccctcaggcagaaaataaaggcaaggcctaaccccccacccccacccctcaactccagcagcaaggatggtgtcttcacagccaggaacacacagagggacccactgaatgactggcatcatccctggtcagatttcaggcactggggtgccaagtcaatggcaattcttcagcctccttgctggtccgttccctccagtctccagtgccctgggctagagaggatggaccctcccacacccccagtctgaccggggcagacgtgtctttcccccaggagtgtcagttttctctcctccacgtccccacctcttccatgccaggaggtacaaggagctgggcccaaccaccagcctcaaagggcaaatctggatcagcttccccatttcctctggttcagtccctgcacagctgataaaggcactatcttctctccagggatgtatgggacaattgaccaggccttcacaagggttacacctgcactcgggctagcttaggagccaggctgtcaacaccacacccaaccagcccctcaccctgggtatcatgttttgattggacacctaaccagtcctcactctgggcaccacattctgactagacatgtaaccaaccctcattctgggtaccacgttctgatgggacacctaaccagccctcactctgggcaccacattctgactggatgccatgctgatgctgtgaaagcaatgagggatctgactggctggtggggatgcagggctgggaggccaagggctggccccaggtcagaagggctgctcacccaggcgcaggaaggaaaagaagtagagccagaagaggcacaggatgggggctgccaaggcctggttcacagcggcaaagtggatccccttctccagcttggctgggaggtagacgaagtagaggttgtgccggtccaccatgtgcttgagcaggatgtagatgaggcctgcaggggatggggctgtgagctggagacctcgcagggccacacagacacctctgtcctcttcctctccggggcggctattttggcaaggagccagggctggggctgctgctctactgcctgaacacaaaatgaggcatcctgcacctctggctactagttttttttcactttctctctcctacccacttcctcacttatctgtgaccccaaggtgtaggggatcggtcagggtggtgggagaaaatttaagataaagttataggaaatagacacaaaccttcttggaaagccgagaggtttgcatagcttcagtaaagggtttggctgaaggcagctgaattctcttaaaagcttagggtgcagatacataggaatgtgggggagtttacctaaatagcttgtttactcatgtggtcctaagaccaacctttgatcatccactggtgcatgattgctcgctattcagggggtcggcaatgttaattaccctctagtggtgtttactcgagacctttgtcatttagtctgtactaaataaatgcgaacttcgcctggcattgaggactacactgcagactcaggctgcagagccccttagccgcactgacaggcaaaatatctgtcagtgtatgtctgtctgtctgtttttttgagacagagtctctgttgcccaggctggagtgcagtggtgcgatctcggctcactgcaagctccgcctcctgggttcatgccattcttctgcctcagcctctcaagtagctgggactacgggcgcctgacaccatgcccggctaattttttatatttttagtagagatagggtttcaccatgttaaccaggatggtctcgatctcctgacctcgtgatccgcccacctttgcctcccaaagtgctgggattacaggcgagagccaccgcacccggcagtgtatgtctttcatccgtcgctgggtcagggtctgtgggacagaccctgcaccaagggagtcacagtgtctgtgatcctgtccccacagaacactaacattccagaatcatcttggaaagaggctgtttcacagttggatgcctggcctcaattcctccccagcccttcccatgctgagcccctgtatgtcagtgctcccacacccctggccttctcccacccggctgatccctgccctcatcacagtcaacagagaatgaggcccaagggtcttaccccaggggtggcacaggagcacacaggggaccaacagaaagtgggtgctgccttttctattatgccaggttcttttgtttttttattttttattttttttgagatggagtctcgctcattggtcaggctggagtgcactggtgcaatcttggctcactgcaacctctgcctcctgagttcaagtgattctcctacctcagcctcccgagtagctgggattacaggcgcctgccaccatgcccagttaatttttgtatttttagtagggacagggtttcatcatattggccaggttgttcttgaacttttgacctcaggtgatgcactgcctaggcctcccaaagtgctgggattacaggcataagccatcgtgcccagccccaggttcttttttaaaaaataaattttgttttgaaagtgtaaatactgtagatttttaaaactacacaagaaagtatacagggaaaactaaaacaacttttccccctaaaactcagctatcactgccagcagtctcttgggttttttgtttccttctagagcctttcattaatctgccagttgcagatgttttatttcagtggccaggaccttggtctttaaacagtcctgagttcaaaggctggttctcctgcttactaacaacatacgaagttattttgtgtgaagggggaatagaaacaggaactgccttgtaggatgaggtgagaaatgtggtaatccacgtggaggcaggcatctgccagagtgaaagcagcacgagagctttgattgtgactctggcactgtcttacttgctgctaaagaaatcaaccatgaacgacatagtcagtgggcagagaacctcagaccagaaatactaagagaggtcctagctgagggccagtgggaggaattcatttaaaaatgaat

SEQ ID NO: 17669 - DNA, 43975 bp, Homo sapiens
tttcctactgcagagggaggaggcaagacttctacccgtagccagatggggaggcatgggcacaggaacggctcttgggtgaagtggagggaggaagaggaggactgaaggcgaaggccacrtcaggagtgatgggataccccacaaaggcctccctgagaagcgctagagacaaagatgagtgcctcctcatctggaagatgaaaagatgtctttgcctgcatgggctgcyrtcacaaagtcccaggggctagggggcttcaacaacagaaatttctttctttacaactctggaagctggaagtctgagattaaggcaccagcaggatttgttccttccaaggcccctctccttggctcacaggtggctgccttctccctgtcttcacctggtcttccctctgtgcatgtctctatcctgatctcctctttttaatttttgtgtaaggacgtagtcatattgggttggggcccactctagtgacctcattctaactcagtcccctctttaaaagccctatctccagatatagtcacattctggggtattgaaggtaaggacttcagtatatgcattttgggggcacaattcagccagaacaggaggacggtggggatgtccacatgaagaggttcaggcagaattcctttaggaggggaagatgtctctctgtgggacaagggtggcatggagcagcccctgggggaaggagaaggggacagtttgcatactggtattctgcctaccccagggtggacactcactcagcgtttgctgaatgaacagggcaaggccagcagtgctgatggtcccaggcatgtagctggtctgagttcatagaaggaccacagcgccctgccatgtgccaaaccaggacaccagagtgaaggccagaagctcacatggaagcagcttagttccctggtaacctcgagatgctgatgagacagagcagagcagagggaaccctctccctccatatcccatcctccaaaatgtgtcccttgatgtggatgggtagacaggattcctgccctggcagccagacccctgccttgggtctgcacctcctctccctccttcctctccccgtcatccctaaatcttgtcctcgagccactgccaccctgtgtaaaccctcatgcccagtcttgcgggtgccatcccttctctttgaagctgaatggaccaaacatacccattgagtgttgggtggggacatctctggaaagtcagcacctggaccagctccacccctctctgaggacaccttctttccctttcagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttaccttygacctctacagggycttggcttccgctgcccccagccagaryatcttcttctcccctgtgagcatctccatgagcctggccatgctctccctgggggctgggtccagcacaaagatgcagatcctggaggkcctgggcctcaacctccagaaaagctcagagraggagctgcacagaggctttcagcagctccytcaggaactcaaccagsccagagatggcttccagctgagcctcggcaatgcccttttcaccgacctggtggtagacctgcaggacaccttcgtaagtgccatgaagacgctgtacctggcagacactttcccyaccaactttagggactctgcaggggccatgaagcagatcaatgattatgtggcaaagcaaacgaagggcaagattgtggacttgcttaagaacctmgatagcaatgcggtcgtgatcatggtgaattacatcttctttaaaggtaaggcccttgggcccaaacctgcactttctttggcttttctgctgcttttatctaaagaatacccaattccctcacatacataaaagacggggagtacgttaagttcttttgggtgcctgttgagaaaaattaagtaaacaagcagccagagaaggtaagatgaatgccttcttgctgtggatgggattagtgaggctgagatgctgtttcctccacggaggaagagctggttgctgtcttcgggcccctggggacatctgaagccccagctttctacaggctctgaagtatgaacccattgtggccaccatggcaaagacaccaacaccttagccactcagggcaggacacagaccccagaagggcttaaagggcatttcccagtcccccgtatccctcagatcttggcccctctgccctcatagaggccaagactccctcagacaaatgcttgttcctctgaaatgcctcctcctgactcctcagcaagagctgacctctgcttatctccccgacactccttgtaagcattcctgctcgcctctgcagctcctgccagttgctgaccctggggaaagcaagagtggatagagaggagaagagaggagaggagagggtgggaagggttgcgaaggaaggtaaattgttaacacctccccttcctatggtcacagatcatgagtatctttggccatttgggtggctataacaaaataccataaactgggtggcttagcaacaacaaacatatatttctcatagttctggaggctgagaagtccaggatcaaggcactggcagatgcagtgcccattccttggttcatagagagtgccttcttagtatatccttgctggaaggaggaaggcagctctctgtggtctcttttgtaaggacaccgatcctgttcatgacagctccacccccatgacctaatcaactcccaaaggccccctgtcctaataccaccaccttgggggttaggtttcaacatatgaacaatgtggggacacaaacattgagaccacagcastgagtgtcgaacttggactctgagatttcctatcccctggtgcagggcagtccccattacaccagattgctgagggcagctgggaaataagctaaggacggtattgactggggtcttccttcgataacgattaagaagttggaaacaggccaggcatggtggctcacgcctataatcccaacattttaggaggccgagatgggcagatcacctgaggtcaggagttcgagatcagcctggccaacatagtgaaaccccgtctctactaaaaaatacagaaattagccaggcatggtggtgggcgcctgtaattccagctacttgggaggctgaggcaggagaatcacttgaacctgggaggtgggggctgtagtgagccaaaattgcgccactgcactccagcatgggtcacagagcgagactccatctcaaaaagaagaaaaaaagaaaaaaaagaaaaaaagaaataaaataaaataaaaagaagttggaaacaatcacttgtagcgttttgttcagaagttcccataggaaggtcagagaagggtcattgaagacttcccaatgggaaaaaccattcatttccaggatccatactaacttctttctaaaatttaaatcaaaatattggaatgaaagtgcaaacagagaagttcacccagatatcaggtagcattcacagccagccacatttttcaccctcttcacttggagatttggtcttgagtaaaacgttagagaatcagagaacatcaggggtccagggcctctgaagatgtgaaaaccaacctccttgttttgcaaatgtggaaggaaaagtcccacgaaaagtccaagaatgtgcccaatgttataaagagacttgccttcatattcaagaggttcaacagtcactgctctggggctgccataaagatggtctccgctggctatctttactgtcttcactccttttatttgcagctgagaatttctaattctgacacaaaattctttttcatttttcccttttttcatctttagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtsccctaccaaggcaatgccacggctttgttcattctccccagtgagggaaagatgcagcaggtggagaatggactgagtgagaaaacgctgaggaagtggcttaagatgttcaaaaagaggtactttcagactaccccagggccagcctaaacccacacagccccagggagacacacacgccctaccagggccacacagcactggtgggaaggactcacccagccaaggagctgcctccaggcccagaggcatcctgtgacatccaagtcctgggggcctagcccagttggagggacaagagctggaaactgggttccttagggtggtgccagagtgggcagagacctctgggcagcccacgtccaagtccagagcaaggggaggctcatcctagaaaagaggccagaggagccataaccaccattgttccttgggttaaggagtccttttttaaaaccatcaaaactaagaatccagtgcattatgaatccaaggggtgaggctcagtgtgccaatgccccagaacagtctaagaaagctccttttccctttccaggcagctcgagctttaccttcccaaattctccattgagggctcctatcagctggagaaagtcctccccagtctggggatcagtaacgtcttcacctcccatgctgatctgtccsgcatcagcaaccactcaaatatccaggtgtctgaggtgggttcagaagctcctatgcatctgcttcccaagatctattctgttctattctttctattctactctaccccatttcattccattccattccactcaactccactccactccactccactccagttcactctattcaattccactccactccactccagttcactttattcaattccactccactccactccagttcactctattcagttccactccactccactccactccagttcactctattccattccactccattccactcctccactcctctcatccactccactctactcctccactccacatctccactccactcctccactccactcctccactccactcatccactccactcctccactccactcctccactccactcctccactccactccactcatccactccactcttccattccactccattccactcctccactccactcttccactccactccattccactcctccactccactccactctattctattctattccattccattctactctattctattccattccattgcagtcaactccactccactctctactattctattccactcctctcccctccactccattccattgcagtccactccactgcactccactcctttattctgttctgttctattctattctattctattctattctattctattctattctattctattctattctattctctccctctccctctcttttcccacaagtagtgaaagtttcactttgtgtcttatccttcatgtaatgggaagccatatccaccactgttccttgagttaaggagtcctgttttaaacaatcaaaactaagaaggcacttcctagctatgtgatctccaaaaaatacttgactctctgagcttcctttctctcttctataaaattgaagaattacaccttgctcaaagatgccatgagaattcaatgacagacacatgcgaagtcaccccccagcacagtgcctggggcagagtagctgctccattgttccatttcctacttgctccatggctcagttgaacagatacttagaggttgatgcccataggcagaagctttgccatttgctatgatgacttcacctgcccctggtggcctggtgatgcctggtgtctcccctgcagatggtgcacaaagctgtggtggaggtggacgagtcgggaaccagagcagcggcagccacggggacaatmttcactttcaggtcrgcccgcctgaactctcagaggctagtgttcaacaggccctttctgatgttcattgtggataacaacatcctcttccttggcaaagtgaaccgcccctgaggtggggcttctcctgaaatctacaggcctcagggtgrgagatgaagggggctawgctatggcccwtctgtatgctggtagctagtgatttacacaggtttagttgactaatgaggyattacaaataatattactctatgatgattgcttccacccacacractgcaacatacaggtgccttggggaaatgtggagaacattcaatcttgccgtcactattcatcartgaagattarcactgagatccagagaggctggatgacttgctcaagttcaccagcatggtagtggcaaagagaggtccagagtcctggcccttgatgcccagctcagtgccacaaagctcartaggagggatgttccagtggatgagggccaccaggaagcacaggtccaaggctggtcccacacttatcagcagcaacaactstcagttcatcctgcatgggaaaaatgttggaatgggagtctgaaatggggctactgtttcagtcctaaygtgctgtgtgacattgggacaacactttccctctctggacctcagtttccctctgtatacaaggatcagattcttgctgtgacccaagaactcctgaaatcatatagaaargctggggtgggccctgtcattcrtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtrtcagttgcaggtgccaatgrctaactttttgaattctatgttggcattaacaataaagcattttgcaaacactggttataactgtctttatggaggcagctctgggaatggtgacattgatagcttaccatgctccaggccgggtgcctggcccttcacctggatggtcgcatttgcccctcataagactcccatgaagaaaggcaccactrttatcccatctgttattcacagatgggaaaggcaaggcttgaagtggttaggtggcttacccagtcacatatcttctaagtggtgcagccagaatttggcggggggagtgcgaccaagaaccctacactcagtcctgtgctctgtgctrtggaggagagatgaccaggagcagaaacttcattcagggrcatctcaggcaccagctcccccatgagccagctaagttccctccctcccttcaccaagcaccatgtgtttcctcatgtgccraatgaagaggattagatactcaagaatggaatgagtgggtgagtgagtccttcgctgcacccaagtctgattttctgtgcgcctgctcaccccaccctgcatgttctaagcatgcttccataaggctgtgccccaccctctgattctagagtctggactgtatcagaggtgagtgcctactagaggtaacaaggtcaggaccccaaaccttgtccatcccccraagtactgagcccccaccatgcaccagcccatgccagatgctttgcacttgtgatatcacccatcccttgacaacccagcaagttctattattgttcccattttacaggcaataacataagtgctttcccagggtcccacgctggtgacagtgagggcccagggtctgagagcccagatcgcacatgtgcgggctggtggcaggggagatggcagcaaccagactcagacatttctctgcagttgtgctgtgggctcagggtggctctttaygaaggggccccttcrtggggtcatgcactcctgtgtgytttcccttgcatcatgccttgcctgtcttggcaaatatttctctggagtttacccagccagtccaaggtcacagggaagccctgtctgtgtctcacacagaaggtyaacgtccagcactgtccaaactttactcagcaaacagtcacaaagcagctcctgtgtggggggtcaggggtgggctcactgtggtctctgctgcatgtcacacattgaagcactgtgctgggrgtcatcrcaggctgtttaactcaattgtcacatgagcctgggtrcacaaaatggtagagcagctcagagagagatggacagacagcatgaacctctgaggagtcaggttttcttggatgaagggacactaagatggctttggagcgtgagaaggacytcacctagcaaatgtgggaaaggagtgagacctccaggcagagggactggctggagacgagcgtgatgtggtgagccatggagtgtatgggtccccacagaacttcagtctgggcctgcacagggcatgtggaggagacaaggaggagggaggtggccgtgccggcggttcagtgacagagatcctaaatgggaggccaatcctaaatgggatgatctctttcatccyaatttcagggtagtttggtcatccrcgccacattccaagtgtcccctgggccctttctctccctcacccycctgtctgcacatgagtagatgcctccaygcagccctcccaggacgctcacctctatccacagatgcttctccaaaacccaccaggccctcccatggaacgagctcacctacagggtaaaatcaggtcacggtcacatatagcctgactactcccctcaggaccctcattcacagccactgtattaatttgctggggctgccaaaacaaagtgtcctcatctgggaggctgcagtagatttgctgaaattgatttgctagcgttgctgaaattgattcaagcttgattctggagcttgaatcgaagatcaaggcaagtgcagggctggtttccctgaggcctctccccttggtttgcaggtggctctcctctccctatgtcttcacatggtcctcctctgcatgtgcctgagttctaacttcctctcctctcctcatctmcaccagtcttatagaattagggccccccartgacctcattctaacttaataacctctttaaagkctctatctccaaatacagtcacattttgaaatattgagggttaggacttcagtgtatgaattttgggaggaygcaactcagccaggctcactcttatcattacagctgcactagtgccatgcctggttcccagtggacaccccaggaacagccatccatccagagtgatattctgtgacatcccctacactccacagctcatcacatcacactcgtctccagtcggtctgtctgcctggaagtcccacacctgttcccacatccactgtctgggaggtccttttcatgcttcaaagccagctcagtgtcctcctttgtacaaaaaaatgtcctgacctctcagaacttcattctttctctctttctgtcgatctttgtctgaactcctctatcattttgtgcacccaggaacgtgtgacaattgagttgaacaggctgcaaaaacgaaaaagaagaaagaaatgctgagttaaacaggctgcaatgacccccagcacggtgcttcaatgcatgaaacgcatcaatgacttgcagcagaggccacactcagcccccctctgccctttgagtttttgcagctcttgccaagatcattcttkttcttagaaagcccaccattattttcctytctagccatatggattctaaaagttcctcttgtgagctgtaatcagaatgcagagaagtaatacaaggttagggcccaggactcyttctcccacctctccctgcagagactcagatttttttaaaaaatgaccttggtcttcrggggaagaacttcccaccacagtgaacagccatgcccagcctacacttgactgtgcggcttacttagctcatccatccaaaggctattcctgggttgcctagtggaaatccaggcatggagctagtgcaagcacaatgataagagtgagcctggcagacactgaccccagcaataatcaggtaaacaaataaacagaactacaaactatgatgacaasaattcatccatccacagatattcactgaatggccactgtgtgcctggcactgttccaagtgctgaagaaaaatgaagaaaacaaaaatccctgcccttatagaggagacattataatgtgacaagataacataatgaaaaagaatgaagaataaaatagaaaagtaaaatggattgcatgtcacttgatgacaagtactgtggaatgaggcygtcatctaaayggagcacagaaagtggaacatggcgacatctcagccaaaagacccggcagacaccatcttggccaagggatcgaggttggcatcgccagctgtgagcagtgctgacatcttattatcttcgatatggcgtcatgagcaggctgcctcctcttggtgggatcttcccccaaacccagaacctcagtctaatcacaagaaaatgacagccaatcccaagttcagggacatttggcaaaatagcccaccactcctacttaaaagtgtcgaggtcttgaaaggcaagraaaccctgggaaatcgtctttggccrgaggaaactmagcagacatgacgactaaatgcaatgtagaatcctcggacagaaaaggacattagtrggacagctggtgaaacccaagtaagtccaggctgtaccaatgtccacttcccagttctgaggaacatgctgtggtctgtccacatttacattaggagaagcagggagagcgtatatgggacytctctgtattgtttttataacttttctgtaaatccaaaactgtcttaaaatagtttttttaaattatactttaagttctggggtacaggtgcagaatatgcaggtttgttacataggtatacatgtaccatggtggtttgctgcaccccctttttttaagaaaatgtttcaaaaagaaaaacagccaagtaggggagggcacacgagtggggttgggaattgcaaaggcagaagcaggagaccagttaaggaagaaaacggggcactaagagagacaatcaggaggacctgctgcagccagggccctgaggggctccctgaggtggtgccattgaagcggagttctgagggacaatcaggtgtagacactgtgagtctcagaagtgggaaaaggggagtgctgtgcacaaaattgagagacggtgcctgtggcagcagctgaggagggaaagagaaggtggggtgggaggcccatcccttccttggccacaaggacactgagtagggtgctgagatgggagtaacagtaataataacaggcagcacttggaggctgcgtcccgtgtgtctggcactcgcctaagccctttgtgcacattggctgagttaatgcagaggtgaactgagaggcacctggggtaggggctgggggacaggaagcaggtgacatctccagtcctctccagcgtccttagagcaggtctacagtactgatccttctctgccacccttctccaagaccaccttggtgggagtaaggggctctaaggtgacaacacacacaggagccacagacacaagacacaagacacttttgactcccaggagaacctagtatgggcatccacacacccttcctgatggtgactttttatgtagacatgcagagtgcagttaaccagctgttcctgcacacatctggattgctactcacacatctgtgcacacacacacacagcctcctggagcactgtggcttctgggtggctaacacagctaccacctctggttgtgctgagctgagcacccattgcctgctggggtggggagagggcaggcactttccctgcgcgaccccgtttaaccctctctgccccactgatgtggtccctgttgtccccgatgcacagaggaagaacctgtgtcaggacccccagagcggtgtctccactaagcagaagtctctgtttctctcctggcctctcccagaggggctgctctgaagcatgtggatttgatcaggataatcaaggtaaatgatccttatcttgatccatcacaaatgttaaggtacaaggctgtggagatggagagtgggtggagtctctgctgcccggtatcctaagctgggtgatcgcaagcagacacacacatgaccacctcttgggccatgcagggggaatgaatgtaatgaggccgatgttacagggttattgaaggctcaggggagaccaggccaaaaaaaaaaaaaaaaaaaaagctatgacctgagacctccctatagcagtgtttctcaaactctgattaacgttacttgaggagcttgttaaaaatacatactcctggccctgatcagataaatcagaatatttgacacagagtctttaagctccccctcgggattcaaatgcacacagatttttggtgctttgccgcctacagtacaagagagggcaggactgtcctgttcagtgcactgtgaccyggacgctcaggcccacggaactcccctactccccctgctccctgcggtgccacccacctagctttcrtgcctgagggtggtcctcagactcctcctagaacaggcccagaggctcttagctatgtaagtattcattcctccaatcactgcagagcactcaccaggtaacaagcacgcacacccaggcgagttccccatgctcgtccccacgttgatatctcagactctacaagtcttcagctgctgcctaggactctgtaagtccttgagcttgggacccctaccacacacaagcgctgggcgtgccccacaggcggggaagtgctggccatatacacccagtgaagtgggaattccagataatgagtaactttttagcaaagtacccatgccctttgaattgtgaggtgtttttgtttgctaaatctgacaattctacctgtagggaacagggatgattgagaagcagctgctccgatggccagaagccaacagccttccctgcagagatgcgggaagtcccagggacagcaggaaagtccaggcactgcactggcagtgggattggggcttgggtcagaagagggtcagggccacaaggaaggaccctgggaggcttcctgctacataatatgagggccgggagcataacaaaggattgccttatccatgattgcatcatcaaactgaagcctgagacagaacattctgtgaggtggccttgttcactgcagaggagctgactcacacagttttgtctgggaagttgcaacctgtgccaggagtagccagcctgggagtaacaaagaggcttttctactgcaggttttcctagagctcctctccctccctcccctggccaaaggtgagctctgcagggagggtccggctctaggggactttgctcctgggcatcctagctgcagagattggtggggcttgtccagaaaggggggtcttctggacctggggatgatgcagttgggcctcagggtactgggaggccagtaggggtgcttcaaactggccagtaacctgaaggactcatattcttaaggatatcctggtggccacgtagaaaacagtcaggtggggtgagggtggaagtaaggaccagctcagaggtcactgagggtgcagccagacaggctgggacccacgtgggcagcagaggtggagagtagggatgtggagggggagacccagccccacgctgggggccctgaggggaggtggaggctgagccaggagaagaggcaccacccactcacttcctgcttgctgaatgactgtgaggagcaggagaaggagcaaaagagcaagtgaggaagtcaagggggttatttgggggcaatgctccatgtgagggtagctaaggacaggtgccaaggaggcccctgtgtcaaaatcccaggtcaaaatgttagttaccagagacctctgataaagacagagccacaggtaaaacgcagcggcacaacccctcgaccctaaaatcagaagcctatctgtgtcctggcaaggagagaagcacgagtgatcatccacaccgccaggacgcaagcccgttatttctgatgcaaaacccaggctccctccagggctggcacagaggactgccagaggagtcagggggcctccaccttccccagctgcgcaacctcagagggtgtctccttatctctggggtcactgtgtcttcatggccaggctgggcacaggtcagctgggagtggagctgtgtttgcagggaaggaacgagggtggacgtcgaagccaacctgcctggttcagaatcctggctcagcttggcacttaccagcagtggtggtgaggccttgggaatgagctccgcctccctgtacttccgtttcctcatatctaaaattgagggagtaatgggacccgcctcagtgggtgttcatgtggattccatgtgctcttaagcataaagaacagagcagctatgatgaccatcatctatgtcactgggcctccggaagtgagggaaggagaggcagatttgcttaagtagaaggaaggcggaggaaggtagtaaggcgtcagccatgtggcacagattgtattatgagatttactggttttcttacttcgtcctcaaatttccctccttacccacttcccatgattcctgagagtcaagaggacgggagctgtggaatgtgttagtcatctactgctgcagagtaaatagcccatgattatctcacggagttcctgagggtcaggaatccaggattgctgttggccagggcaatcccagaaggctcacttgtggggctgttggtagaaggtctcagttcctccctatgtgggctactcacagggctgctcaaatgtgacttrgagagagagagagagagagagagagagagagagagaggcttgtttgtttagtgtccaggaccgagagaggatatagagagaaagcacaaaagagagagagaaaaaaagagaaaggcagagagagagatagagacagagacacagacagttgttgaatgtccaggaccaagagagagacaaaagacagaaagcacaaaatagaggggaaaagagaaagacagagagagtaagggacagagagagggggacacagagagagaacccatggcagaagcagcagtcttttttttttgagacagagtctcactctgtcgcccaggctggagtgcagtggcgtgatctcggctcactgcaagctctgcctcccaggttcacaccattctcctgcctcagcctcccaagtagctgggactacaggcgcccgccaacacgcccagctaattttttgtatttttagtagagacggggtttcactgtgttagccaggatggtctcgatctcctgacctcgtgatctgcccgcctcggcctcccaaagtgctgagattacaggtctgagccaccacgcctggccagaagcatcagtctttttataacccaatctcggaaatgacaccccaccccttctgccttagaaagaagtcactaagtccagtccaatgtgagagaaagtaattaagctctatctcttcaaggaagtggtatcagacatttgtggacacatttgtaaaatgaccagagcgttagaacctcagaatccagcagactaattgccctcatagtagattattaatgttttaaaaaatggatggactagctgaaggaataaatgaacgagtgagtgagcaggatatttctgtctcatttcacatgcagaaaaggcactgaggctcagaggaattaggacatgtgtgaggttctctaggcagtaaggggtgggggctggcctggtttgccagaactcggagatgcagcatgcagcgtgcagcagttctgaaatggaagccagggatggcaagctacagcagccactccctcccggagggagaacggacccaacaccaaggaggaagggatgactcagcagccctcaaaacagagtcaggagttctccctgcttttgccaaaccctctgcaggcacctcttatccatacagggacgcagccaaaggcctagctgtgctgaaggaaatttgcaaatcctgcctcaaatctgcagccagtatctcccccagcagcctccaaaccaggccagcacgaacccagccagagagcagcataggtgttgggcaaaaacaggctattgactccatccttttctaacagagaccagagtcctctggccttccacagagaaggtggggccttctcagggttctctggatctgctggtgtcagtcagtatctatttcttcttcctaagaattcttttttttttttttgagatggagtttttgctctgttgcccaggctggaatgcaatggcacaatctcagctcactgaaacctctgcctgccgggttcaagggattctcctgcctcaacctcccgagtaactgggattacaggcacccaccaccacacagggctaatttttgtatttttagtagagacaaggtttcaccatgttggccaggctggtctcaaactcttgatctcaggtgatccacctgcctcagcctcccaaagtgctagaattacaggcatgagccactgagcccagcctcctaagaattcttaaaggagctacggttgacaaaagagtttcagagaggtaaagttatggccctaaagtcacccagcaagtagatgtggcaaagccatgttgcaaaagaagccctggtgggtgacactcwttggatggcccctgcctctccggaaggcaccagcgttggtttctctcygcctcaccttcccatgcaggtgggymcgtttgtgcttgggctcctgctggttatgccccagaagcacactcttccctatctgcagtcccagcccatgtgtggacacaacccatttcctagggtgttccttagcccactgcaccaagtcagcatttaggaatcaagagtggcaccacaaaggcaatagctgtgaagaccacaagcagcatcacagtgatcaagcttgcagaattccattgtctgatggactctgtgtgtaccaaggtgactgcaatccagggacagtgagagtcactaggccttggactaagcatctgcttgtcccaggtcccaggctgaacatttgatgtgaatctttagtctcttcacttttgagacaggcactacagccacactcacacaggtcccaaaggccagtgccacccactacctctgccatctccactcctgcattccaccagattccctgacctttagaaatagtctcctggaggccaggcctgctggctcaagcctgtaattccagctctttgagaggctgaggtgggcggattacctgaggtcaaaagtttgagatcagcctggccaatatggtgaaaccccgtctctaccaaaaatacaaaaattagccaggtgtggtggcagtcacctgtaatcccagctactcaggaggctgaggcaggagaattgcttgaacccaggaagtagagatagtagagattggagtgaactgagatcatgccattgcactccagcctgggcaacagagtgagactccatctcaaaaagaaaaaaaaaagaaaagaaatagtcccctggagcccctggccctgacctcccaaaagccagagtgaactttcaatctcaccgtaggctgaccccctgtgtccattttaagycagaggactatacccatccacagtcaaagaagagggtggtgaccratgtggacaaagctcccattcagctgagaccccaatcagtaaagaaaatctttccctacacagatctacagacaaccaaagccttaaaaaggcatcaaccctaaagcctgtgaaaatgtgattttctctcctgtgttcaagaatggaaatgccttccttcatttttaaagaaggagcaggggatggtggtgagagtctggatttggcattggattggtctttcctaaactccaacagctcctgcatttaacagctaggggtatgtgggcaaatcacatgattagacataggaagctttttcctccttcctactccccttcctggaggttgacacagaccaaagcttggtaagaaaacttaggataaaagaaggggcagaggccgggcaaggtggctcatgcctgtagtcccagcactttgagtggccaaggtgcgtggatcaattgagcccaggtgattgagaccagcctgggcaacatggtgaaaccatgtctctgcaaaaaattacaaaaattagctgggcatggtggtgtgcacctgtaatcccaactactcgggaggctgaagggggaggatcacttgagcccaggatgttgaagctgcacatgaggtgagattgcaccactgcactccagcttgggctacagagtgagtccctatctcaaaaaaaaaaagagggcagagatttttttcaacatcatcagagatgggagctatacaagatatacaaagagaggagacagtcagccatggcaatgtcaaaatactcgttagccagcacatgttctgcctagggaattttctgcacctactgggaggtatggggaaaggacacagggtttagcaggatcaagaggttgtgggggatgcagagtacaggacagcaatccccagatggccttggccttggctctccttcctccaactcttagctctcaggataactgtagaatatgctaagaatgcagtgccctgagacaaggagaaaatatcaggaacaatctgagctttgtcttcattcctcctaaaacttgtttcagccatccaagtgacttctgagatataaaacccagggaggggtgtttttgaggccccttagctgtggtgcaaagtgaggcacatgcaaacaagaccccatctgccggggcagctttcctgagccttgggggactggttcaccatggatcctaggcgtctgttgattcttgctgcctatatctgtaatgaagttggtttgcgtggcttgcatagtattctgtcacatcaaactcatactctagcaactgggtttgtgtaaaacctcctcccacatccaggaaattaagcagaaattagcaagatgcttagagtcctctctgaggagcgaggcaggtgcacagtgttggggacatgttgggagtcctccccccagattgataaccattgcatgggactctgcttcccagagagaagaaagagaagatttcaatcaggaaggggctccctgcaatttcaagtagggcaggatggagttgagaggtgggatggaagcaatgaaattaacttgcatttcaaacctctgggggcaacgcataggcttgaagctataatgtgagcctgagctaaaacagtaagggtgtttattcagtattctggactccatatgtatctgatcacttcacagctgcttaaggagattgtccaggggtcggctaactagacccactggccaaacccaggcccaaaacagacagcttttaaatatttcacaagctaagcttcatacatttttaaaagattatgaggaagaaggaagaaaaggagaaagacaaagaggagtcrggggagaagaggagacagagatcatatgcgaccatcaaagtctaaagcacttactatttggcccattacagaaaaaagtttgcagatccctggaatgtagtccctgctcccttccattaaggccactgccccaaaactgcagagacagtgtcaccctgagagtgggagcattatttgttttgctcgttgctggatgcccagtgcctaggatcatgcctggcacataaaatcactctgtaaatatttgtggaataaaggaaaaaataaatgaatgaacaatgtatagaaaagcacttggtaacctataaagtccaagtataggacaaataaaaatacatactttatttatttattttaatttttttttgagatggactcttgctctgttgcccagcctggagtacagtggtacgatctcagcccactgccacctctgcctctcgggttcaagagattctcctgcctcagcctcctgagtagctgggactacaggcatgtgccatcatgcctggctaatttttttgtatttttattagagatggggttttgccatgttggctgggctggtcttgaagccctgacctcaggtgatccrcctgccttggcctcccaaagtgctgggattacaggcatgagccactgcccccrgcctacatactattttaaatccactgcacctgttcttattctggagtggatgctgaattctgcccttggacaaggccctcagtgtgttctgggagagcctggcttgaagccacattatgaagaggcagggcagatcccaacccaggaagctggagacagaggaaatctaaaggcaggaacctcctacagaggttgctcttctgcttagcctaagaagcagagcttctcaggctttctggtgcacacagatcaccttggggttattattagtatccaaattctaaattagcatgcctgggctgggccccaagaattagcatttctaacaagctcttctgtgttgctgcagctactggtccctgaatcacatgtgctgtacagcaaggatgtcaaagctctcttcctcaaaggcaggagcatctcctcagaccctagtatcctcctcatttcctctttgcttccttttgtcgggttccaaaaaacagtagaagtgccctggattctgatgagagaacattctcaagggattgctgactcgggaggcaaacaggctccagcgatcctgcagcccacgggctggtggggagatgacccacagggggctgttccaaaaaggaagagcagtgggcctggaagagtatgatttggccttagtgttgcttcacttttctgtcttaattgccctgtggtttcatctggtcatgggagtccacgatgacatgtgccatcyttgtatgaatggtgcttgcagaaccgaaggaagggcctgtaccaatgcctggggaaaagcagaccaatgaagacttgtaagagcccagaaaagaggctgggagaaggtcaggaatggggtaaacgtggccttggggcatcygcctggagctccaggtgaccagtggcacccagaacaattcttgaccctctgcaggtcctccaaagcatcctcagtaggacctgcagaaggtcaaaaattttctgctttcacgttggatggaggtcaagactaagtcagctcaactgtaaagaaaatgatgcttttccctttgaaaactggtacaagacaaggatgtcctctctcaccactcctattcaacatagtatgggaagttctggccagggcaatcaggcaagagaaagaaataaagggtattcaattaggaaaaaaggaagtcaagtctctatttgcagatgacatgattgtatatttagaaatccccattgtctcagcccaaaatctccttaagccaataagcaacttcatcaaaatcttaggatacaaaatcaatgtgcaaaaatcacacgcattcctatacaacaataacagacaaacagagagccaaatcatgagtgagctcccattcacaattgctacaaagagaataaaatacctaggaatccaacttacaagggatgtgaaggacctcttcaaggagaactacaaaccactactcaacgaaataaaagaggacacaaacaaatggaagaacattccatgctcatggataataagaatcaatatcatgaaaatggccatactgcccaaagtaatttatagatgcaatgctatctccatcaagctaccactgactttcttcacagaattggaaaaaactactttaaatttcatatggaaccaaaaaagagcctgcatagccaagacaatcctaagccaaaagaaccaagctggaggtataacactacctgacttcaaactatattacaaggcttcagtaaccaaaacagtatggtactggtaccaaaacagatatatagaacaatggaacagaacagaggcctcagaaataacaccacacatctacaaccatctgatctttgacaaacctgacaaaaacaagaaatgggaaaaggattccctatttaataaatggtgctgggaaaactggctagccatatgtagaaagctgaagctggatcccttccttacaccttatacaaaaattaactcaagatggattaaagacttaaatgtaagacctaaaaccataaaaaccctagaagaaaacttaggcaataccattcaggacataggcataggcaaagacttcatgactaaaacaccaaaagcaatggcaacaaaagccaaaattgacaaatgggatctaattaaactaaagagcttctgcacagcaaaagaaactatcatcagagtgaacaggtaacctacagaatgggagaaaatttttgcaatctatccatctgacaaagggctaatatccagaatctacaaggaacttaagcaaatttacaagaaaaaaacaaacaatcccatcaaaaagtgggcgaaggagatgaacagacacttctcaaatgaagacatttatgaagccaacagacatatgaaaaaatgctcatcatcactggtccttagagaaatgcaaatcaaaaccacaatgagataccatctcataccagttagaatggggatcattaaaaagtcaggaaacaacagatgctggagagtatgcagagaaatagaaatgcttttacactgttggtgggtctgtaaattagttcaacctttgtggaagacagtgtggcaattcctcaaggatgtagaactagaaatacaatttgacccagcaatcccattactggatatatacccaaaggattatacatcatgctactataaagacacatgcacacatatgtttattgtggcaccattcacaatagcaaagacttggaaccaacccaaatgtccaccaataatagactggataaagaaaatatggcacatatamaccatggaatactatgcagccataaaaaaggatgagttcrtgtccttttcagggacatggatgaagctggaaaccatcattctcagcaaactaatacaggaacaggaaaccaaacaccacatgttctcactcataagtgggagctgaacaacgaaaacatatggacacagggaggggactatcacacattggggcctgttggggggttgggkgctggcagagggatagcattaggagaaatacctaatgtaaatgacaagttgatgggtgcagcaaaccaatatggcacatgtatacctatgtaaaaaacctgcacgttgtgcacatgtaccccacaacttaaagtataatttaagaaaagaaagaaagaaggaaaatgatgctctgaggccggagaacttgagaacactcagataatgctctgaggcaagatgactagtcatccccaatgtccactctctttgtctctctcatggtaatggaactctgaatttttagctgggaggtggctacctagaatcttgactgcactgcacagcctcctttgtagctaggtatggccatgggacaaaactccaggcaacacaacacaagtgggaatgacaggcaatgttcaaggcattcctttcaaaagaaagggtgtgcccttcccttcccctgtggccctttctatggactggaaggtggacatagcagtgagccatcttagcctagacaaacagacgtggaggggcagctgagcaaccasacaggaggacgtggtttctgacaacgtggaggcaccatatcaacccactgcctccagctggacctgcaggagagggaaatgaacttcagtctcattttagcaactatttctttaggattctgtgtaacttaaacatatgtattggccaggtacagtggctcacacctgtaattccagcactttgggaggctgaggtgggaggatcccttgaggccaggatttcaagactagcctggacaacacaatgaaaccctgcctctacaaaaaaataaaaatttaaaaattagccaggcatggcgttgtgcacctatggttccagctactcagaaggctgaggcggcaggatatcttgagtcgaggcggcaggatatcttgagtccaggagtcagagtcttcagtaagcaaygagcaatgattgcgccactacattccagcctgggtgacaaagcgagyctctctctctctctctctctctctctmwatatatatatatatatataatatatatataaaaatatataatatattatatatgtgtatacgtatatatgtatatatatacacacacacacatagagagagatatatatataaagacacacacacmcacacacacacacacacacacacacacacattcaattccaaaactgggagcctgaaagtcatttaagaaagatgggcccagacagttattggtcatcttagtgccttacagtcaacaaatatgtaagtcctctaaagatgcagcactatcgcaacagacaaacaaaaaatcctgtcctcgtagagtgtacatttaatatcatttcatttcatcttgattaccactctgtcagggaatattgccttgcatcttagacatgaggaaattaagctgtagagatttcccatgatttgtttgaagtgagtcagttggtgagtcagacatcagagattcaagccaggtcagctcatgccagagctagaacctcgccactggtctggtggcctccaaagcatgccctctagagaggcctgtcagggctaccccggatggggactgtgaccatgaggaatcaagaggaaggatttttttttttttgagacagagtctctctgtgttgcccaggctggagtgcagtggcgtgatcttggctcactgcaacctctgcctcctgggttcaagcgattctcctgcctcagcctcgcctcccaagtagctgggttacaggcatgcgccatgatgccctgctagtttgtttgttttttttttttttgtatttttagtaaagatggggtttcgccatgttggccaagctggtcatggactcctgacctcaggtggtctgcccacgtcagcctcccaagatgctgggattaccagcatgagccactagtcccgcccaggattttttttttcctttttcatgagccaaagaaagaccccagactagctaagagagaggcccaaggatacctgaaggccggggaggagggacaaccacttgttggggtgaaccaatcgcagaggctcagcaggacagaggccaaggctgaggaggcccccacagagaaacagagcctgaggacaaggggttcctcacaacacctgtgctccccgaaagctcccctccacacccctctctaggtgccctactctctggggttggtgaaggggtgccaaaaatgcaaactgatccacagaaaaatagagtcctgtattttaaaaatatatctaggtttgtatatggacattcacatcacacagacacacagacacacatgcagccacacacacacacacacacagagacaccaaagaaaagtgctttagaaatacaccaaaatgtggctgggtgcggtggctcatgcctgtaatcccagcactttgggaggctgaggtgggcagatcacgaggtcaggagttcragaccagtccgaccaacaaggtgaaaccctgtctctacgaaaaatacaaaaattagctgggcgtggtggtgtgtgcctgtagtcccagctactcgggaggctgaggcagaaagttgcttgaacccgggagtcagaggttgcagtgagctgagatcacgccactgcactccagcctgggcaacaaagcaagactctgtctcaaaataaaaataaaaaataaaaagaaataaaaaagaaatataccaaaatgttagctggggtcttctctgggtagtaaagtgctgggggatattttccaaagtccttctttacattctctgagtttttccatgttcttcaatgagtatttaataagcagataaaaactaatacaacaaaggattttttctgtgtgcttttttgacctttggaggaagagattagagctagtcccataaccaggttatttgagtaggtctaacaagcccgtattaccagaaattatcatctggtcatttccagtccgagaacagaacacttggttgtcctggcatttcccaagcagkgggaggagttctctgcaggaataaataagcctcagcattcatgaaaatccactactccagacagacggctttggaatccaccagctacatccagctccctgaggcaggtaatccatgatgttttacatcctgggagcggaggaatctgtttttccaggagagttttaggcagcagcctggagtgtgtggagtgtgaggggtaagcagaggccaggaggaggtgtactcaggtgttaggggccaggggtctgttcttggctgccactgattccctgtgccttttttagaggcatcctctgtgtctgggttttcacacctgcaaagggtggaggtgccctggggcctctatggtcatttctgccttgatacttacagattcggattygagtcagctgtgcatctgaccctcagggaagaggtgctgtccccttgcctggagcagggtgcagctctcagaacatgtggcagatgtgattattgcagcaggtccctctgagcagaggccacaggcctcaccatgatttcagggtctccatggggctgcctcgggagctccacttccccaaaaggacccctggccaagtcgacagatgggctgtgtctctgtccagcaacagaaaagacaaactgctgggaaacagccagccctccaacttgcccaaacagaaaagacaagcctttgcccctgaaataattctggagaaaaatattgtctaacatttatccagagaaatgattgcatcagcctgagagtgaacagttgaagcaaacaaggtgcctctgtccctgggcttggccaaaggcatttccactggcctcccctccttcccctccttcccctccttcccctccttcccttcctttccttccttcccttccttccactctctcttccccttttcttctcctctctctacccctctcccctcccctcccttccaatcgcctctcttccccactcttctccccagcacccaagctgccccttttctcttctgaattctaggactgagtgggcggaggctgaaggtgaataatcttgtttgctgcggtcaccggcttggaactcagcccttccagggtctcttgtgcagtagctcatggctcttctctggcttgtagtttcaggaaaggggtagtatgggaggtggtgactgctcggtacgtctaatatgaaccaggtgccttcatcatttatctcacctgagccacttaacaggttgtgcagagacggaaacaggttgagagatgtacagtcacctgcttgccagtacacagcaatcaaaagtggccaaaataaaatcccagtccaagtctgggagactccaaagccctctctgccttctccccactaagaggcccttccaggcttatggtggacacagacaccacgtggcaacctggcaggggcagagaagaacatttgcctttctttggtcttgctgccaaccattatcagggccatcgaggctccagacactgtaccagggactttcatttccctctctcagtcgaccctcactgccacccagcatcacatcgtggaggcctgtggaggccacaccacgtgacatctagaggctgggagagtcactgtggcctctatctctgcccagggctccttcatccctgggttctactttggtggcagttgggagaatgaaggaagggagcccctgctttctaatcccctaggatgagatctgctcaccaagcaggagaggagcaggcattctgattggactgaacctcggaccccccatcagcttacagaccgaggagccaggcaaacctggctgcccactgggctcctttacctgtttgctgtatgatcttgggcaagccccctcaccgctctgtgcccggcttttccactgcaagaaaatggcaacaattatggtacctacctcaaagggtgaaatgaagcagagtgatgtgtgtcgggtgccccagagagyacctacctgagggaggctccaaarctagcaagaggcagcaggacagggaccaggacgcaggctgggtggagggcagtgggaggtggtcggggctccatctggccctctgagacttaaaggagctttgcttttcagagttgagaatggagaraatgttacctctcctgrctctggggctcttrgcggctgggttctgccctgctgtcctctgccaccctaacagcccacttgacgaggagaatctgacccaggagaaccaagaccgagggacacacgtggacctcggattagcctccgccaacgtggacttcgctttcagyctgtacaagcagttagtcctgaaggcccctgataagaatgtcatcttctccccacygagcatctccaccgccttggccttyctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcrcagacaatgatggtcctggtgaattacatcttctttaaaggtgagtgtgcctggcttggggttcagaagaggtggatctcagggccatttctgtcctgactcaacaatggtgttattaggcaaaccactgtagaggagagtgcccacagcatgggggcagcataagcatcaaggccccaccctgcccataggcatcgccgtctcctgtggggtttttccaaattacagtttgtccttggaagacataattcagtggagcccatcagcctctggtctgagtcagtgtggtgcttttcactctgatttaaacttgtccggcaaacagaaagaaggagctctcctttcaaaccactccagggcgcrtaggagctagagctccctccttgcaggggtgctgctagactaggccaggaagtccctctgtctggatgcacctggggctcctgccctgcacatgtgggaggagcacattccagccaggggccttggtgtctggaggtggccaggtggggctggggccatcttcacagggcaagataatccccaaggagcctggccacttccaagattctatgattctactctgctatcatctttaattattttaaaaaatatgtcactgacacataacaaatgagggcagaaatggcattgttcccatctggggaagagcctcaagggtgggcagtatacaaaacatgaccctttgccagattctaactggtccagtgmccaatcccattgatagaaactcaaccaatgcaaacctcagcctgcaagctccgaaggggcagagtgcaagccggtagcttttgcctcctggagcccayagtccagatggggacaaaaaaagagatagggacacaaagagtgatcactgagccagagggtggaaaggtgcttaggagacatgagctgcttggaggcagagtcctgcttggaagctgttggttgattcctgggcaagccacttcccctcctgggcctgggttttcatctgtaaatgaaggcgtggatccagatctccctctaagactactccaygcctcacgtgccatttgttctctgagtttcccatgttctcgcctcctactacctagccctatgctaggactctcccctccaggacacagtagccagcctagctttcccctccccacctgcctctaacaatgggaaacaggcaggtggtaaacaggtgggcagtggaggtggccccatgtctccagcctcccctggaagctcccacccccctcattgttcagtgctctggtcctcctggagtggagacctgcagggcccctccccttcctctgttgacctctcctcactctccaggtgccagttttgctccctgcctcagcctggtttacatacagtgtatgtgacggggcttggtcactgctggggcagccctgtggaaggtggaggggaccgagcatgcatgagcttcaggctgagacagtcccagctcagaaccctggagtgcttgttccctccctttctgctcttcctcttccattgcacccactggacccaagagcatgcaaggattgactcacccagtgatgctagaactatgtattcagctgaaagtaagggggtgggggcatccaaccaggggcagaagatgggaattcaagaaaggaaggtttcccctagaaaacggttttcgtcttttctcttaaatccagatagaataagaagcgaaggccgttacagcagagagaaagtygagtcaagcagagatcagatactaaagacactagactaaccagacattcgggccctcagttgaacagctgaggatgtcagaagatgttaaggaggcaaaattggaaaacttggtggctggcagacagaaatggggggagatgggagcagatgtgagaagatttaaaggcttgtagagcttgggtggtgatttcatccaccaaacctatctctctccccattctggcatacaaggcagcagtcagggtccccagaggcagcccrtctttctggcagggacccatgctggagatctggccagctgaaaggccccaaaggagctcggtgccctgggtaatatgggaaggtgctccatggcactgccctcacatggaggccacagaagcccctgaatggctgctgcaattggtaacggggacacctgttcaactgaaatatctcctaccctgagatgggtcctttctccaagggatctttacaattacatttgtccccagtcattccatgttgggaggctgcagggaccagagaagctgagatggtctttggggaggggaaaggaaagatggacagttattttggtcctagaaagcccaaaggtggggaagtgtcaagaaggaagatgagggcacaagagaatgtagggccacccagaagctggctctcattgcaattacagaaagaaaaaccaaaataaagaaagaaaggaaagaagctcccatttattgagcagctactctcaccagccattcacatgcaatacctcgtttaattctcgcagcggctctgaaaggtggatggtggtattgccatttgttaggtaggagacatgccgtccagaaaagcaaataattaaacattcaaagttgacctgggcccatttgaaaattccttttgctccctcattttaacccctaaagtaaagccgtttgtgactttatgagcttttaccaagcatctcctaaaaccaagaatggaggtgaaagattgtggagcccacaacctagagaaaggattgacaattttttttccataaagggcctagtagtatgtattttaggctgtgtggtccacatgagggcagattcttctttttgacttcctcctctgcatcttcttcatcttctctttcctcttcattttttttacaacstttgaaaaatataagcaccattcttagctttaggtacacacaaaaataagctatggctgtattggcttacaggctatagtttcctgacccctgttctaggggaggaaaataattgtacccaactaaatgcgtgcgaatcatgggcctatgtcatgattcccaaagaatgagtttcatggaattttcaacattttaaatattttactccattcttcccttgcttgcatagtttctgatgagaagtctgctgtcattttcatccttattcctttttagataaggtggagttttcctccctctgcctctacctctacctctttcaagattttctctttctctttactatggtaaataggcctttagtgagaggagttatgtcagcctggctaggagtcaggctgcatttcaggtttgtgatagctagaggtaccagaggcagtttcatggaattttacctttgcaacactgagagcctaggcagcctcagagtcagaacacccacagttgaatcctcagcctgacagacactgaatccagggcaaatcttagctgaatattcatggtctgtagaggtggacatgagctagatatgagctaaggaccatagccagctcatggcttttgtgatgtccaacaccgctatcctctaagatgtcacaagtgtccctaggcttttattcccatggtctctcctggctctgagttctatcttccattaaggttcttcctgttcctcccctcattcacactgattggcatctcttctgtctgccctcaccaactcacatacagaacccagtctctttcctcttatttccacccaaagccctcccacaagccactgttatatgttcacatccctgtaataccagtgagtaataattgctaatgagacatttttccttttatggaacaaaggctgtcccatttctcctcaggcaccagcctcccacatgttgtcatgcctctttcccccactttccctaaaccttctttctctcttgcactccttattccctggttcctattgatttctcatttagcacaaggaactaggtctttcttttgtggcccttttcccaatccaagcctgctgggctctccctcacccccaataacttttactcttgccaagctacttctctaaaccaaagcagggtccctcctatgagggactctgggcacttccactgctgsggaagcagggtcgagcagggcgacccttgcactcacaccttctccaactgcttgctccaccttcagccaaatgggagatgccctttgacccccaagatactcatcagtcaaggttctacttgagcaagaaaaagtgggtaatggtgcccatgatgagtttgcatcacctgactatascttacttccgggacgaggagctgtcctgcaccgtggtggagctgaagtacacaggcaatgccagygcactcttcatcctccctgatcaagacaagatggaggaagtggaagccatgctgctcccagagaccctgaagcggtggagagactctctggagttcaggtgattcttcctggcccccaaagaccccacatctctccacgtcaaggtctcaccaatgtccagggacaagggcatggtggtgggagaactcatacagggacaggtggaatttacacttactttgccctatgctgcctacatggctttgggcttgatttttctttttcttctttaagacaatgacatcagacaggacaaggggctgaggcttcctctgactccagcatgttctaagtcatgagaaatcttctgcacagtcccaaacactcatgcatggtttctcctggtctcaatctcttgaagggagagagaaacagaaggaattgtgatcagttgagggctgcagtgagatggactctgagaatcagttctgcactggtgaaccactgtatttattcattctctcagcatttgctgcatgattaattgagcacctactatgtgtcagacactaatttgcaccctgagagtaaatcagcaaataaaacacaagattccctgccctcctggagcttaatttgtaattggagaggggacaggcaataaataaatataacaaataagttacgtgatatattagaaggtgagaaattgagtaaggggatagaaattgagtagaggaggatgaaaggatcaggaaaactggaactcgtgttagtttgtgattttagatagagtagccattaggtgatgtttgagcatccatataacagaggggargggtggagtcatgttggtatattagggaaaagcattcctggcagagggaacagtcagtgcaaggcctctgaggtggaagtgagcttgatgtggtcaaagaagagtcaggccagagcagctgggcttccacttcctccatcttgtcttgatcagggaggatgaagagtgcgctggcattgcctgtgtacttcagctccaccacggtgcaggagcagagagagtgaggagagagttgagagaggtcaggagtccccaaaggggtggagcagcttaggtagggccacgtagacccctagaaaaccttgcccttcctcctgtgtgtgaaatggagagccatcaggaggtttggaggagtgctgcgatccgagtgttgttttaaaagactaatcctggctgctgagaggagaataactgtagagcaggtatggagtcagtgacacccgcaggaaccaggcacagacatgaggtgggagcccactgtggctgggatccaggagggagccatgcatgtgagaagtcattgagttctggataaatctgagggtagaggaacttgctgggacacacggaattgagctgaccratttcatggggacacagtgaggaggagcagtagttccgggcccagaccctgcagtgggcccagggagtgcatgtgggcagctgtgtggggtagagaggaaggagcaccagccttgggttcagaccgtggtggctggtgtgacctggagcaggtcgctgctcttctctggagctcagctacctcctgaagagaaaggaatgtcctttccccrccacccctgttttcactgggtgattgtgagaatccggtgaggtattgtatgttgaagccataataaaccactaagggcaagggagctgcttcaacactaacctgaggctgcaacccctgccccaaccactgtccagaaggccggacacctctcgggattgcctgaccctcagcccctcctcactctagatcccaggagaccccagaacgtgggggtcctacccaacccatccgtttactcccagactccttcctcctttagcacctaatagccaccagggagcaggggctcagcagataattttgagtggaaagaattctccaaacacttttgatttacaaaatgctgaggaaacatgtgtccacacactcctggcccacagagaatgctcaatagatacttgttgaatgaaggatggaatgaacggacaaacacatgaatgaatgaataaaaatagaaataggacaccttcctccttcakgggactcagagtttaatggaagacacagcctcctgtataattgtaagaccaggcagacagtgacargcatcttaagagggctataaactaagggagggggagtttgcaggtggcrggtgtgacctgggcctctaggagcttgctacctgctctatgccagcccacacctggcttgagggacagtgcccactggtgaggcaagatgggaacctccaattgattgtttcaggatccccaaagctcttctaacacaatcagactcttcagagrcccccaggccctttttgacctgcctctggctcctggcccacctcatccctcactaccctcctccctgaaacactgagatcacccaccgccccgtggagcaactcctcctgctcccaccttcttccaggttcttccacctgcctcctgcccacctcttcacctagctagctcctttcctgcctttgggactcagcctcaacaccacctcctacaggaagccctcctggtgcccccgtgaagcaggctgccatgcagccactgcagctggcccagcccaggctctcaacacactcaggggtccctgctggtgtgaaggtgcttcaactgcattgcaagctkcagggaaaggrcagggccaggctcgagcagggccacaactccaggcttggtgtgctgcctggagactttcacacttgcagatctgaatgaataattaatgaataagaagagtaaagacaggggttaagaaattgaggaacagattatttattttccaatcagaagggggtgactgtagaggaaaccagggaagaccatgctgcgaggtgggaggcasgtaggtactgatcagcagaggttcagatactttttttttctcgttttctagagagataggtgagctctacctgccaaagttttccatctcgagggactataacctgaacgacatacttctccagctgggcattgaggaagccttcaccagcaaggctgacctgtcagggatcacrggggccaggaacctagcagtctcccaggtgagtctttagacttggrtcaattcatcctttgtatccgaacttgaattggtgaaggccagatgkacttttgggtactcttgaacttgggttaatrcacgtgcatttctcattatatactcaccctgcttgggacacccccaagccaagaagagctaggttacagcccagctcctcctgccgtgttaggggttgagcctctacaacataatgtcatccaggcttggaatcagagagccatggacaccattccacactataccatttactatccatgggggcaaacaattaaagtcctccacccccagctttccatgtgtcaaatggtagtgatagttcttggctagtatccagtgcctggctggacagggaatgccaataggtaataacaatgattatctggcaattgtaatgaaaatatgctcggagtatgagagaagactacttgggacactcagcctgtgttactaaaagcagaggcgccaaggcagggtggccatgcagccttttgctcttgtctgccctctgtgctcacacagcactgggttgaggtctgcactccacctttcaaacagcaaagtaagagagggttgtgtgtagaggagcagacccgtatggttcaggaattcaaggccatgaaaagtacttgaaagccccaaggatgtttaagctagagcaggagagatgctgaaagccatgctggcttggctgaggaggtttctgcagcagctgcttgtggtcaagagctgccgggatgttgcttagaagaaaaatgctttacattgttcttgctcttcctcccaacagtagtggctgttttgggggcaaaatagactctcaactcagacacaaagggatgcatatgaggtgctccattctttacctcgatggctctgggcaaatcatactcagcatctgggtctccatttgcacatctaggcatcaggactgtgcaaaactagttgrcaggggagttgggaggagcaaacattcaacagcacaaagacaggccagcactaggtgctcaatgcacattagwccccttagtggcacacaggcaggtcgctgaactcctgcgcatctgtgtttcccgtgtgtaatgttctgctgtccccacaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagrcacccagaacatcttcttcrtgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactyttcagtytggagggtcctgggcctcctgacagcaataaataatttcgttggamacgttgcttgtgcctttccatgctgactatcagactctgcgcccctgaggctacctgtgccccaaagacaagccccttgagctcccatgcaggctcagctccaccccaagatctgggctccttctgccttcagctgcagcagcctgcccaggactacctaagcttgtggccaagctcacccagacctcaggcccagggttgggaggggaccctgctgctctaaggccaattcctgccccccaggcttctgggtgcccactttcagtttctctccttccacccccagggcccaggctccacctggctctttccagagctcctagccctgaccacatctggcacagcccccggactccttgctcctgcagctgtgcagggctttatcatgcgacatccttcttctgccctttagcacccccaatttgggggaagtagctactttctgggtttccagatggagcccctcaactgcctcaccagttcctagccctggctctgtgaatgatctccctcaacaaccagaatgcagggctgaggacaaatgagccatcagcgcacaactgcaataaagcaatcgtgtagtcaggcatttaaccgaggctcccaggcaccttgcaatctctatcacaaaggcaacaatgatactgttgacaacagctcagtacttgaggttttgatgccagacaacctgccaagatctctccctgaaatagccaattgaatcctcctcacgtccctatgagataaatgctctcagcagtcccattctatggatgaggaaactgaggtgcagagaggcttagtaattttcccaaggctacagagctagtaattattgcctgtagaatgttatcccaaccctcctgacaccacaggcgccctcttaaccacaaagtgatttccgtagggattgccttcatggaacgtacaacccgatggcaaatagatggtgaaacaagtctgtggaagctgagggagagcaccaaattcagtttgggaagtcagggaaggcttcttggaggaggcaacttctgtgctgaggtcagggaaagagaaggtggtcaagtgaacagagaggacaatgcttcagatgggaaaaagagcaatggtagcattcaagaaaccaaaagaagttgggtggctctggggcaaagagcagagaggctgaggggctacagagaggaaggtgccatgacagagctggtgggctgcagaagggctggccgctggcaaggattcccaagtgattccttagagccacagggagctctaagcgagtttaaacacagaggtgatggaagcagctttacacactagagaaggaccctggctgctgagtagaaaagtgattcatagcccaggacaaggatgtgggttggacatcgagggggctctgtgggaactggggcaaaataggtcagagctggggagggagagcgggatgattctgttggaaggctttgaggagaatgggtgtgaatttatgattgcaggtggggtggaagggagaataactatttgggtttgggtgcctgggtgatccccagttctctgaataggaaacccagcagggacttgctggcaagggaagtcgatacattcagatttgaacctcccatgtctgaggttcctgggagacaccccaggggtttgttcaggaagcagctaggctgaggtcaggagagaaatctgggctggagggaagcattcaggatcctcccctgggatgggcaagtgagtattgagggtgtcccctcaaatgagtgccatggagtgaaaagaaaagggaaacctcaatgactggctaagaaagggcagcccaccgaggaaagtcaccagcgtggggcaggagacaagaggacaggacgaaagctgtcgccgcaggaacaagaggagatacttatccgggggagaggggagaaaacctagagacaaatgatgaatgaatggaatgaatgggtctgtgggatttagtgatctaaaaccactcggggatcacaagtgcaatgttagcagaattaagggaggaccacagtgggctggagagtgagcaggagagggagagagggaaggcaagacagcgtgtagggaaaaaagagatcagactgttactgtgtctatgtagaaaggaaagacataaaagactccattttgaaaaagacctgtactttgaacaattgctttgctgagatgttgttaatttgtagctttgccccagccactttgccccaaccttgagctcacaaaaacatgtgttgtatgaaatcaaggtctaagggatctagggctgtgcaggatgtgtcttgttaacaaaatgtttacaggcagtgtgcttggtaaaagtcatcgccattctctagtctcaataaaccaggggcacaatgcactgcggaaagctgcagggacctctgcccttgaaagcagggtattgtccaaggtttctccccatgtgatagtctgaaatatggcctcatgggatgggaaagacctgaccgtcccccagcccgacacccgtaaagggtctgtgctgaggtggattagtaaaagaggaaagcctcttgcagttgagatagaggaaggccactgtctcctgcctgcccctgggaactgaatgtctcggtataaaacctgattgtacatttgttcaattctgagataggacaaaaaccgccctatggtgggaggcgagacatgtttgcagcaatgctgccttgttattctttactccactgagatgtttgggtggagagaaacataaatctggcctacgtgcacatccaggcatagtaccttcccttaaacttaattatgacgtagattctattgctcacatgtttgttgctgaccttctccttattatcaccctgccctcctactacattcctttttgctgaaataatgaagataataatcaataaaaactgagggaactcagtgccggtgcaggttcttggtgtgctgagcaccggtcccctgggcccactgttgtttctctatactttgtctctgtgtcttatttctctttcccggtctctcgtcccacctgactagaaatacccataggtgtggaggggcaggccaccccttcacagtgtgcaaatgcctatttagagactggcctttaggggaggtgagagagagggtggtgggtagtgagtgctaggctgaagttagctgcagtgcttgacagatgtgagagccttgaacaagctttcataaccatagaaaggattcaggaggcagggtgacaagcaaccagggtcgcagagtggcacaactcctcaggttacaattcacaggtggtttgacaccatcctaagttacagttcacaggtggtttgacatcgccttcaactcggagttgcagaattagcagttggccaggctgcatgaagcatccctggaaagggaacaggtggagggctggagggccaggatcaaggatcaaggattccactgtgatgggaatgcaggcagggcctggcgagggggctggtgagggagtgtgtttcttggtaggatcaggtgggacctcctctcctccaatgactctgatgattcctagtataggaggcaaagtcacctgcttagtgatatttgccacaggttggggcaggaaaaggcacaaaatgggacacagagtgggccacggtgtcacggcagttcagccaggctcactgatgagcgccttggagatccagctgcaggaattcttggtggttccaggctttacagacagttgtggaatcccccatcttgtggaatatttctccattcttaccagcccctttgtgggcttcaagaaggccaactgctgatcagaaggacaggagtcaagggggctggaggtacagactacagaagggttgacatcatggacttgagaccagcactggggggtacagatgagggcagagggagctgatcactgaggaagactgaggatggggagatggggtccctaggaggtccaagaatgacctgttagaagtgccatatgaactataaaggctacttttcccccccaaagaggattttttcacattgactctcagttttctcaactgtaaagtggaaaccatgacagtgtgtgcatgcctgtgtcatccgtgtgtaagaagtcagcaagtcactgaaatgcttgctcctgagtctgaacgttcccttgacagcaatttaaaaactcctgagatgatcttttccatgtgaactaactcctcatccaggctggcatggcttctcgtcactcagctggggctggatggcattgcactggacaaggctctgacctgcccacctgcccagctcctgcccccggtccctcctgaccccagtccaggtgtctaaggagccttaccacagcccagcattcattcccttctgtgacttaggtctggaaattgctggctgaaaactgagttcctcccttaagggagcgtctgggccccagatctgtgagggtggggcttagtttcattcttccgcctcccctgggggctgagggcccatccacctgctggtcactagctattgcccttaaatggcttcctgacgctagctgcagggacaagacagcacctgtcctgatttactacctccctcactaaccagaagtgaagtccaagcctgagaggcactgacaccaataaaagacacctacttactctctcattcagcccacgcaaattgccaaccctccaaatgcaggccctgagctggccctggagattccgaggttaagaaagtggacctggaatttgccctcatagaatgttcaatttgttgagcaagacagaaaactgagcatggatgtgacagcagccctcgggagtggggtacgtgatgcccagagagggcaggaataaaccccagactagaagagtcaagtttggtctcctagaagagctgtcctcaaatgcaaaatccagtacagtgaagaggagacaccagggagatgtaccagcagaaaaggagagggagtgcagtgtgtccatggagctagaagaagatcctatgttctggataactgatgtttgagggaaccatggtcatctgtggagctaaagagaaaaacatgaacaagaccatgctttgtaaatcatgttaaggatctcagagtttattcaaagagtgatgagccacagtgaatattatacacggggagctgttttgattaagtttcattagaaagatcaccgtggctgagcagggaaggatggatacagtattgagtgtggatttggtgaaaagaagagaagcagaatgaccaagaggttcagccttagctaggaattgggagaggacagagaggaaaggagactaattggagagatatttattagacagaattgatgagacttcatggttgattgtgtgggggacagaaaggaagcaaagttgctgggtcgggaacttggggaactgaaatccacatgccattctatgagctaagcattacagaatgaataacgttttgtgcaggaagcagataagtcctcatgtgggcatgtggagttggagatgtctgtaggccatctaagaagagaagtccaatagagaatgggctctatggatctgaacttcaatagggaaatttgggcaggagggatggatttcaggatttcttcttgtcaaaaatgtgaggacacccctggcaaatgacttctatttttccctgtgccatacaaagagatgttatctgctgagtccaccatggggaagcataaaacccagaagtctggaggaggggagacgaggacacatcaggaaacctcgatgttctagcagtcactaataagggtcccttgggggctggagactactgtgtcactagcctgtacagttgtgtggttctaggtatactcggtagttcagacatagacaaaaaggggatagactgcaagtggctactggagccaaagtttcccctggctacaggacggagggaccatcagtggctgacacaaggaaaaataaatatatctgaaaatattgaccagagagtca

SEQ ID NO: 17670 - DNA, 42794 bp, Homo sapiens
aaaaaatgcacacttagataattctccagtctctggtatttctcaatataaaactgttttttcaaacctttggtttcttgatcatcttgtaacaccaggccaatgtacatttatttccatctgcaattgtttattgcattttttgaaataaagtcatttaatttttcatcaacagaatcagcagaatctgccaaaataggaggaataattactgtgtttttgatagcattggtcttgacaagcaccatagtgacactgaaatggattggttatatatgcttaagaaatagcctccccaaagtcttggtaggtagtttttttgttttgttttgttttttctatctttgttttttattttaacttaagaatttgtatttatataaatattttcacagaagaaaatctcattttctataaacaccaaaatgctttctcactctgagttcttttccatatctataaatgtatattttgcagggtttttgttttgtttttgtttttattatacttttaagttttagggtacatgtgcacagtgtgcaggttagttacatatatatacatgtgcagttgtaagtgtatctgtgcatctgtgcattttatgttttctttcctttttttttttttttttttttgagacagtctcactctgtcacccaggctggagtacagtggcgtgatctcagctgactgtaacctctgcctcctaggctcaagcaattctcgtgcctcagcctctcaagtagctgggactacaggcgtgtgctaccacacctggctaatttttgcatttttagtagagatggggttttgctatgttggccaggctggtcttgaactcctgacttcaagtgatccacctgccttggcctcccaaagttctgggattacaggtgtgagccactgcactcagcaatgttttgttttgttttgtttttatacttcatcacataatttataatgatcaggtagaatttcattattattaacataccatttttcatttaaccatttctcagctaaagggcatttggatttcttttccttttcttttctttggtgatgatgaatagtacaataaacatttttatatggatcgtctttttgttttggattatgtcagtggaacatatacacaaagtggatttatcctataaaaagatttaaaaaggactaggcacagtggctcacgcctgtaatctcagcactttgggaggctgaggcgggtggatcatttgagcccaggagtttgagaccagcctgggcaatataaggaaaccttgtcttagagaaaataaaaataaattagccaggcatgctggcacatgcctgtggtctcagctactcaggaggatgtggtgagaggattgcttgagcccaggaggtggaggctgcagtgagctgtgattgcgccactgcactccagcctcggttacagagtgagaccctagctctaaaaatatataaatatcttaaaaatataaagaagcagccaaaggagaggaagttaagaggagtaagtcagaacatagtctatgtggccagcagcctgcctggtttgaaaggcagctgctcccactcactagtcacaaaccttgagcaagtttcttaacttctgcacctcattttctcatctgtaaagtgggcataagaatagtaagcctggccaggcgcggtggccacgcctataaacccagcacttcgggaggccaaggcaggtagatcacgaggtcgggagttcaagaccagcctggccaacatggtgaaaccccttctctactaaaaatacaaaaatttgccgggcatagtggcgggcgcctgtaatcccagctactcaggaggctgaggcagagaattgcttgaacctgggaggtggaggttgcagtgagccaagaccgcactactgcactccagcctgggcaacagagcgagactcccgtctcaaaaaaaaaaaaaaaaaaaaatagtaagcatacctcatagagcagttgcaagggaaaggtaaattatatataaagcaccaagagtcatgcccagcatatagtaagcatggtgtaactgttagctgttattattgctgtcatcatcatcaactgcatcatcattcaatctcattaagtttattttttatttttttagaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctgatacggactctctctctctttttttttttttttaagaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttttgagacagagtctcgttctgtcgcccaagctggagcgcaatggtgtgatcttggctcactgcaacatccgcctcccaggttcaagtgattctcctgcctcagcctccctcgcaagtagctgggattacaggcgcctgccaccatgcctagcaaatttttgtatttttagtagagacaggattttaccatgttggccaggctggtctcaaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttgggatgcctaaacaggcgtatcgcttgaggccagtaattcgagaccagcctgggcaacatggcaaatctgtctctacaaaacaaaattagaaaaattaactgggcgtagtggcatgtgcctgttgtcccagctacttgggaggctgaggtgggagaatggcttgagcccaggaagcggaggttgcagtgagccaagatcatgtcactgcacttcagcctgggtgacagaaccagaccctgtctttaaaaagggagttggtggggagaggttctagaatgtcatgtagcaaccagtttaaggactgggactcagggatccaactcccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaacttggtgtggtcttgagttgtcttccattggagagcgtacgtgtgccacagattggtgcacctgccggcatctctaggattgcaccaactccctctagctcttcttggtggcctgcaggggcctagggcgcattcacttccctctgcttgactttacgtggtgttctagcgtcagacatcaggcgatgccgtgcattacccaagacactggacagctccggatcttcccgtctaaccactaatcaagttaaaaagaggaaattaacgctttcttagtagtctctgaaagaaactagttatttgcgtaaagatgacttggttttgtgttgtttatccctggggagaagggtaaagaagaccctcaaactggatttgctgctgaagtgcttttaactcacctgtgcggagagcggacttcaagagagggcgtgccggtgctccggacaaaacctggggaatactgaaagccaccaccaccaccgtcattccagcatgcagatctcagtcctgggttggtgttgtagggcatttatttatttgacttgacggcgcctttcaaagcttgcgaggatcccttcctcttcctcgtgtgcatctgccaagcctgtgccccgcgcctcgcgggtggacccgggctggtgggcggggcctgcagcggggtgggagcccggtcgcccggcccctccccaccccgccccgcccatctccgctggttcccggaagccgccgcggacaagctctcccgggcgcgggcgggggtcgtgtgcttggaggaagccgcggaacccccagcgtccgtccatggcgtggagccttgggagctggctgggtggctgcctgctggtgtcaggtgaggggtccgcggggagggggcgcgcttgggaaccggraggccccgcgagatgccgcccctgatcccatccctgggcgccctgcaagtgacttaagagccttcggggcctcgggagagaagatgcaaacgccacggccggctgctgagacgcaactaggctgctgctgccgtcgattctgtaacaggagaaagccccatccgcgcccggattacagaccgtctgggccctaaactcagggggagactcccggcgtcttttgattccctgtcctcctgcagctctctgctggcgggcgtctaaataaagtagcttccccaaaagacccaagatcccaccgtggctgtcatctgacccttctggagactatcagttcaagtggaggcccccaccagtccccgagtgccctgacagccctccctgaccccaagtctgccccctcagtgccagccctccctacagatgtgcctcccatcacccgctgcacctcccctccttscggttcaggcccgagcaccctgaaatctggattctgtcccccagcgccccagctccatggcttctaaacctaaatccattgaaaccttttctgtsctctaaattgactgcctaggttccaataacaccatggtcacctccttcctttctcatgaactcttccctggccttccgggatacccctccggtttcccgccctgtcaggcwgwctctgcttgggaccctcctgctctgtcaggtttctatgtagctaattgtgatgcccaaggccttttctctccttccctggcactgttcctttgggggatttcagccaaaccctggcattaaacacgggctataggcccatgactcgcacatttatatctctcttggtaccagttgggtgatgggtggtggtttattatagtcttctacttttctacttgcatgtaggtttcaaattttcttttctttctttcttcttccgtttttttttttgtttgtttgtttttttgtttttttktttttttttgagacagggttttgctctgttgctgtggcccaggctggagtgcagtggcttgatcttgcctcactgccacctccgcctcccgggttcaagcgattttcctccctcagcctcccgagtagctggaattacaggtgtgtgccactacgcctggctaatttttgtatttttattggagatggggtttcgccatgttggccaggctggtctcgaactcctgacctcaggtgattcaccttcctcagcctcccaaagagctgggattacaggcgcgagccaccatgcctggccaggtttcgaattttctattaaaaggtttgaaaataatttctgtctctagcccacatctcttcttggtgtgacctctgggctcattcatctggctgtctccctgacattcctacttcagcctctctccagcatctccaacctaatgcagctcaaatgggactcgtgagttccccagctgagctccaatcggggcaccagctgcttaagcccaaaatggacattgacctcagcttttatgcatcaaatgtatcaggaagtctccagtttgtttttacgtctggaaatatatctgaaatccatgtgcccaccctaccccctcatagctttctgccaccagacaaatccaaggctcctttgtctgtccccattttactcctgcccctccagaaatttctcctcacggctgttcaaagaaaatctagactcctcagcacagccaacctgtctctccctccctcacccacgtggcctttgaagacatggagccatagaggagaaccaagtgctrgatgtgggctttttcatgggcatctgttttgaggagaaaagttgtaaatgtttttgtcttattttcatagcattgggaatggtaccacctcccgaaaatgtcagaatgaattctgttaatttcaagaacattctacagtgggagtcacctgcttttgccraagggaacctgactttcacagctcagtacctaaggtgggtctggcctcactattggcaggaacgcaccggaggagccagccctgggctggtcactgggttgggccacaggaggaagggagtcwgactacrgtcaccgtgtgactgtgacaaccctcagggagcctccctgccagccttttkctgtctgggaaattctcgtggccaccttttctcttttaggttttctagttgtgatggttgacgatttgactgttaatcacagggctgctggcagatacagacattttatcatgcgtatgtagatataatcagccatagtggtaacctcatgctgtgcccatcccagcttgtttgtcacagttgatatattttaaaagaaaaataccactgctgtcatctctaggtatsastagtattgctggaagtcagcaatgttgagtggatgctacccaagaaactgagatatgcaaagcggtcaggaagccccttgctaccatatatcacctgttcccctccaatggattataacatcatgccccagtgccatgcgcgatgcacataatttgcataatgagtgctcagtttctccgtggttccatcctgaaattaaaagtaagacagctactgactgttaaaaaccccattctcggacaacagcaggggctgtgaaggaagagtgagtgtcaccctagacggtcatctcagtggtgatctgaacgccctctacctctcctgcctgtcagtgtttccctacgcctggtgaaggaagtcagtgccagcactcccttggcagcctgccaccatacgccacatgctggactgcaggtgacacacctttaggccaggcgcaaacagcagcaggaggcccaaggctgacaagccaacacacctgctttctgtgtgactcagaaacatacgaagatagacaagtccttcagtgaggcaggaggaaatttcttcccagatccagctgtcatttcacaaaaatccccaaggcctgctacatcagagaagaagtagaaaggtgaataagatagtcctcgtctgtgcattgctggcttttgttttttaacttttagttcaaaataattccagactaacagaacatttcaaaattttaagtagaatacaaagaatttccaaatagcctacaatcagattcaccaatttttttttttttttttttttttatgagacggagtctcgctctgtcacccaggctggagtgcagtggcgcgatctcggctcactgcaacctctgcctctcgggttcacgccattctcctgcctcagcctcccgagtagatgggagtacaggctcccaccaccatgcccagctaattttttgtatttttagtagagacggggtttcaccgtgttagccaggatggtcactatctcctgacctcatgatccacccacctcggcttcccgaagtgctgggattacaggcgtgagccaccacgcccggcccaggttcaccaatttttaatgttggtcacattctctcccttcctctctctctctcatgccctttgtgctgtaatatttcactgtgtatttcacaagaacaaggataatctcttacatcacatagtacagtgagaagctcaggaacttttacattcataaaatacttgtatctaatttacagtccatagtccagtactgtcagctgtcccaaggattgaaggagggcatactctataattaatttttttcctgatgtgcattttctagtactgattggctttatcatttgctttctgtgctgtctctactcagtctgaatagccacggagattttactgtggaaaattaaatttcttctctgtctgtctgtctccctgtagtttttcttgttctgtgctgtgcttttgggtttgttkgtttgtttttcttttttttttttttgagacggagtctcgctctgttgcccaggctggagtgcagtagcgcgatctcakctcactgcaacctccgcctcccgggttcacgccattctcctgcctcagcctcccgagtagctgggactacaggcgcccgccaccacgcccggctaattttttttagtagagacactgtttcaccgtgttacccaggatggtcttgatctcctgacctcgtgatccacccgccttggcttcccaaagtgctgggattacaggcgtgagccaccgcgcccagcctttttttttttttttctttgagacagggtctcactctgtcaccaaggctggagtgcagtggtacgacctctgctcactgcagcctccacctcctgggttcaagcgattctcctgcctcagcctcctgagtagctgggactacaagcacatgccaccgtgcccaactgatttttgtacttctagcagagatggggtttcaccatgttggccgagctggtcttgaactcctggcctcaagtgatccacctgcctcagtctcccaaagagctgggattacaggcgtgagctaccacacccagcccatgccatgcctttttgccattatagtcgaggcacttggctttgcatgtttatcttttatgttagcgatcccaatgacttcatgaagtgacttcatgagggtatccacacctgggttccaggtctcccccgcgtggaactacagagtgagtatggcatgtgctggagaaaacaaaatatgtgctggccgtgtccttggggaagatatttgatccctaaagatgtgattgcctcatgtggctctacaaaagagttgtttagagtttagcatgagcaattgcacagcacaaactctctgttgtttgcgtgcattggggcagggcgtccagagccgggggcacttcagaggatgtactggtgattttaatataaaaacatccaaaacaattagatgtaaatatgaggaatgggtcatattacctatttaatgcggggagaagtatttgtacatgcaataaaaataacctagtgaaggccaggcgcggtggctcatgcccgtaatcccagcactttgggaggccgaggtgggtggatcacctgagatcaggagttcgagaccagccttaccaacatggcaaaaccccatctttactaaaaatacaaaattagccgggtatggtggtgcayacctgtagtcccagctactcagaaggctgaggcaggagaatcacttgaacccaggaggcagagattgcagcaagctgagattgcaccattgcactccagcctgggtgacagagtgagactccatctcaaaaaaaaaaaaaacctagtgaaaaagatgttattgcaaaacaacttttkaaatactgcacatgctggacaattgatgcattagtttaaaagaaggaaatgggccagtaatcccagtactttggggggccaaggtaggataatcatttgaggccaggagttcaagaccagcctgggcaacatagcagccycttgtctctacaatttttttttttaattagctggacttgagttggaaagaaggaaggcggaagggaagaaagaaggtagggaggaaaaaaaatatggccacatgtgagaaaacccccttaatgaaatgaccgctggattttccaaatgatgggatgttaagcagccgtgaagaaatggttgattgacaaatatttgtggtatattaagtgaaaaaatagcatgatcccaatgatctctatctactttttgcaagggatttttctaggtatcactaagaatgctgtgagatgtgatgtgctaccttagactatgaagtcaaacagatctgagttcagttgggcagatttcttaggctctccacgcctgacccctgtgtacttaataaatgttggctgttgttatttttatcaccatcactttcatcatcacttctgggagcaaccaaattggttttggcaccagaagatgtcttgggggaccaatcagatagctcctcacttttttattttattttataaatttttaaattaaattaaattaaattttttgagacagtgtcactctgttgcccaggctggagtgcagtggtgcaatcacgtctcactgcagcctccacctcccaggctcaagcgagcttccctccttagcctactgagtagctgggactacaggcgcatgccaccatacccaaataatttttttattttttgtagagacaaggactcaccacgttgtccaggctgttctcaaactcctgggctcaagtgatcctctgcctcggcctcccagagtgctgggattataggcgtgagccactgagccgggccagctcctcactttttgcaggatgagagcctgggcttcctttgatcacgtggagccaattacacctccttggctgttgcgagcttagattcaggagattgtatttccctagcatccaacaggcatgtccaaatgtcatctcttttcttccacttcactttctgtcatgttccctttagcggttgctgtcggggctggtgttctgactgagactgatgaattgttttataatttttccagagtaattgcaatgatagtcatttataggacaggacagtcacgggtcacttaacaactggggtagattctgagaaatgcatcattagacagttttgctgtgtgaacgtcatgcagtgtacttgcacaaacctagatggtgtagcctcgtatacacctaggctatgtggtttagcctattgccccaggctgtaaacctgtacagcatgttactgtactgagtgctgtaggcaatcgtaacacaatggtatttgtatacaggcatatcacagagataaggcagttttggttccagactaacacaataaagctaaaaccacaatagagtgagtcacatgaattttttwgtttcccggtgcatctaaaaattatgtttatactgtagtccattaagtgtgtgatagcgttatgtctaaaaaaatgtgcacagcttaattttaaaatatttacttgcggaaaaatggtagcaatcatcagagccttcagcaagtcataatccttttgctcgtggagcatcttgccytkatatggatggctgctgactgatcagggtagtggttgctgagttgcagtgactgtgacaatttcttgaaataagatgacaatgaagtctgctgcatcaactaactcttcctttcatgacagatttctctgtagcatgagatgctgttcggtagcattttactcacagaagaacttctttcaaaattggaatcctttcaaaccctgctatcaactaagtttatgtaatattctaaatcctttgttgtcatttcaacaatgttcatagcatcttcaccaggaataaattccatctcaagaaaccactttctttgctcactcattagaaacaactcttcatctgttcaacttttatcatgagattggagcaattcagtcgcatcttcgggttccgcttctaattctagttatcttgctgttttcaccacatctgcagttacttcctccactgaagtcttgaaccccttaaagtcatctatgagggttggaatcagcttcttccaaacccctgttaatgttatattttgacctcctcctatgaatcaccagtgttcttaatggcattttgaatggtgaatcctttctgggaggttttcaatttaccttgcccagatccatcagagaaatcactatctatggcagctataactttacaaaatatatttctttattttattttatttcattttattttattttttaagatggagtctcactctgttgcccaggctgaagtgcagtggtatgatctcagatcactgctgcctccacctcccaggttcaagtgattctcctgcctcagcttcccaagtagtgacaccacaccaggctaatttttgtattttttttttagtaaagtcagggtttcaccatgttggccaggctggtctcgaactcctgacctcaagtgatttgcccgccttggcctcccaaagtgctcagattacaggcatgagccactgtgcscagcttcaaaatatatttcttaaataataagatttgaaagtcgaaataactccttgacccatgggctacagaatggatgttgtgttagcaggcatgaaaacagcattaatttccttttaaatctccatcagagttcttggggaaccaggtacattgtcaatgagaggtaatattttgagagaaaactttttatcctgagcagtaggtcttaatactgggcttaaaatattcagtaaaccatgctgtaaacagatgtgccgtcctccaggctttgttgctccatttgtagagcacaggcagagtagatttggcataattcttaagagctctctgattttcaaaatggtaatccagtgttggcttcaacttaaagtcaccagctacattagcccttaacaagagtcagcctgttctttgaagctttgaagccaggcattgacttctcctctgtaactatgaaagtcctagatgacatcttaatagaaggttgtttcatctacattaaaaatctgttgtttagagtatccaccttcatcattttagctagattttagctagatcttctggataacttgctgcagcttctacatgggcacttgctgcttcaccttgcacttttatattatggagatggcttctgtccttaaaccttatgaaccaacctctgctaacttccaacttttctttttttttttttttttttttgagatggagtctcgctctgttgcccaagctggaatacagtgacacaatctcrgcttattgcaacctctgcctcccgggttcaagtgattctcctgcctcaacctcctgagtagctgagattacaggtgcatgccaccatgcccggctaatttttttgtatttttagtagaggtggggtttcaccatgttggtcaggctggtcttgaactcctgacctgatgatccgcccacctcagactcacaaagtgctgggattacaggcgtgagccaccacacccagccccaacttttcttctgcagtttcctcacctctttaagccttcacagaattggagtgttagggtcttgctgtggattagactttggcttaagggaatggtgtggctggtttgatcttctatccagaccactgagactttctgcatattttcaataaggctgttttactttcttattattaatgtgttcactggagtagcactttaaatttccttcaacaacttttcctttgcattcacaacttggctaactgtttggcccaaggggcctgttgtggcctgcaatatgccttcctcactaagcttaatcctttgcagcttttggaatagggatgcccgaggagaaggagagaggcaggagagtggmcagtgggtggagaagtcagaacactcacaacatctattgattaatttcactgtcttatataggtgtggttcatggtaccccaaaacaattacaacagtaacatcaaagatcactgatcacagatcaccataacacatataatcatgatgaaaagttttgaaatattgcgagaattaccaaaatgtgacataaagacatgaagtgagcatgtgctgttggaaaaatggcaccaatagacttgctcaatgcagggttgctgcagaccttcgatttgtaaaatgcaatatctgtgaagtacagtaaagcaaatcacaataaaatgaggtatgtctacatctaaatgtatttaaacatagaaaaggtacagtaaaaatacagtatcattatcttaggrcatcamcgttgtatatgtggtctgtcatctaccgaaatgtcattatgcagcacatgactttattgaaaatcattgtaatatctttattttggtaaatttttgtaaatcaatgtctcataaatcacatgcccctgttttcaaaaatacgtaatcaaggaagcaagctttcttggtcaagtatgctgaatactcaamcccttggagaggcacgtagtcattaagatgttcaagtctctgagaagttctgttttgaagacacgtatttctatgtttaacacagtttccactccygcgccgcccccccctccaaattaagtaccagtcagcctcagggagactgaagccagaactctcctgattgacctatctktttgattgtgtagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacagtaagccattttgttttccctttttttgtaatgtcatcatcttgccttgtttttttccacattgrttggtccatcaacaagaattctttgagggcccacaaatggatggccttgcacaaggagcttaaggaatataataaagagagttgtatccctaaagaattcatgggagagacagaaaaagataggcatatcatcaatgcaacaattaaatataaatctaacaccttcagtgcctcaaggatgtgactatgttggggcccgtgctgttgaggagaagttctggaaggattcttgtggtgaattttctgggagaaagtcagtatggaattatgacttaaacaaagaaacataacgtgataggcaaaagaatgaaggcagatgtagagatggaaaatatgatgcggacagccggcttgcccagagcgaaggacagagggagggatagggctgatggcaggtgggttgggtcagactggttggtcagcatcaaaaattgttcccaggttaggtggagattgcagtgagccgagatcacgccactgcactccagcctgggcaatagagtgasacttggtctcaaaaaaaaaaaaaatattgttcccagrttagatttggagggtcatggtgaccaccagagtcccctaaatatgagatgagcatatttagaatatcaggaattgaaaactaattaaaccatatattagcaattgagagagtaaagaagattagaggttaaaagaacctrattcacaaaattcacatacagcccttcaaaactcacatagagaaaagcactaaaagaattgtctctggctaggcatggtggctcacgtctatgatcccaacactttgggaggctgaggtggtggatcacttgagyccaggaattttctttttttctttctttctttctttttttttttttttttttttgagacaaagtctcactctgacacccaggctgaagtgcagtggcgcgatctcagatcactgcaaactgcctccagggttcaaatgattctcgtgcctcagcctcctgagtagctgggacttcaagtgcctgtcactatgcccagctaaatttttttgtatttttagtagagacggggtctcaccatgttggccaggctggtcttgaactcctgaccttaagtgatccacctgcctcagcctcccaaagtgctgggattacagacatgaaccaccacacttgtccttgagcccaggaatttaagaccagcctrggcaacatggtgaaaccctgtctctacaaaaaacaaaaaaaataccaaaaaaaaaaaaaaaaaaaaattagccaggcatggtggagtgtgcttgtagtcccagctacttgggaggctgaggtgggagagtcatctgagcctgggaagtcaaggctgcagtgagccattatcacaccactgcactccagcagcctgggtgaccagagtgaagtcttatctcaaaaaaagaagtgtctctatatggggagtggtctttatgccggtccctgctctggacccccatgacccctacagttacatcctccctggtagagaatgatgctaggatgcctttcttccctttcccaattccatcccaagcctgggtaaaaacgtcttacttttggaatcataaattatcaaagttagattatattttctaatggtacctttacaaaaacaaaggaaagatgaacagaaaagtaagtttcacaatagttaaaagtrcaagtttttgctcctataattgctaactggcttaccaggtcctaacttgtcccaaatyctgttagctcccatccatggaagttccctttagagcctaggtacaacacggttaagcagcttgtcaaaaagtcatacaggtcatgagtggctgagcaaggattcagacccaggctcttgcttctgtgctcttagcaactactacccaatattggagatttgcctcttgaagtctatgtattttagtgataggaaagtgtttccaggcatcatgcataacctatttatacttgctttggcaaagtattccaacarkttttcttgtctggttttcagacgwgcactttagaatgatggaagcaggtccattaacagccctgaaaaagtaacagcagccaaagargaatacaggacataactcaaacaccatgattgcctggaaccatttatgaatcattctatagctattattgagtacatctgtgtaacagctgcattctgagcactgaagctacaacaatgaacgagacaaaatacctcatggagcatatatgtgctaatcaggaatacagataataaataaatagatacatattacatgacaggtagtgactatggttcttaagaagactgaagcaaggcaataggacagaaagtaatgggagctgcacttctacatagaatggtaagatacagtctctctgaggaagtagcatttgagcagagacccatatgaagtgaaggagccagccacatgaatatctagtaaaagagcattcagaagggaaacagctttagacattgttggaaatatatatggttaattatatatgttaaacatgtaaaggtggccactaaaaataatagagatgccatctgtagcttccatcctgaaaaaggaaataaaattcaagccaacaaaaagcaggaataaaagaggagaagacaccaaaaacataaaatagaaatttaaaaagaaatccttatagaaaatacaaaatagcgtagctggaataattccaaatgtatcagaaaccacaataaacataagtggactaaacttcattaagaaagacaaagattatcagattttttaaaagaaactaaatccaactacccttcttagccatgtcaatcaatgtcatgacaatagtatatcaaagcagtgtacttccgtggactaattgttctgcatggttatgaaaaattaatgttgaagtttttaaaatgtgatttttgattgtcattttgcttgttcttctgcttagccattattggaccccctggaatgcaagtagaagtacttgmtgattctttacatatgcgtttcttagcccctaaaattgagaatgaatacgaaacttggactatgaagaatgtgtataactcatggacttataatgtgcaatactggaaaaayggtactgatgaaaaggtaaggttggctaattgcatttcagaggtagtaggctttcatattctttgcagaatcttgcaaggtggcagcaccttatggactggtcctctgtaagccaagagcttcccagactgaggggttactggtatctctggctyaagcttcccagactcctaagggatatgtgtagagcagactttcaggacaaagtctgcacagtgacagcagacctttccctccctgaagggcagytgcaggggaaggcacagttgagtcagagttagctaagggaacttggagctggctgaattaggtgatcagcaaattgacaactgtcccatgacatcaacccctgtgtcccacacacaccgcaaatcagggacgtccgtggtcaagacagccccttgttgctctattcttcaggggacaatttctttaaaaacatgggcttggagtcaaaagatctgatyggaatatcacccgtgccaccatgtgccattggtcactttcttgaccccagcctcctcaagtctgcaaaatgggcataataacttactttattaataaaacaaggataataacctacttcgtaagattgttggggaatttaatgaaataatagaaaatataaactcatcccaktgcctggaatgatgtatatatggtcagtacatcagtacatgaggtttccttcctctttgctagacatgttaagkttatttttattcatccttggtcaaggtttattctgayacctaatgcttctgagctgaatgccattcatggtcctaaactgacatatatatgttatgtatgtcatattacatatatgttatcccttccacattaaatgttgattttaccacttaattctcaaagtgtttgggaagaagggatcacccatgtttattatcttaggaatgatgtagttaaatttatatacacacactgcatagcccaaaaaatctcaagttaatttttttccccaaaaaatgttccattaaatgatgcagtgtcttagtccwttcctgctgccacaacaaaataccacagactaggtaacttataaacactagaaatttatttctcacagttctgcaggctgggaagtccaagatcaaggcaccagcagattcagtgtctggtgagcactggcgtgctctgcctcctagatggtggaaggcaaagggcaaggatgtaaacagctcccttgctgctcttttctaaggtcaccaatggcattcaggaaggctctgccctcattatttaatcacttctgaaaacctccacctctgagtcctatcatagtgacagttaagtttcagcatatgaattctgatactcacaatcactgatcaaatgcaggcatctctgctaagccctggggtataaagataagagcagattgctcccctccgggagctagcaacagacctcaattaaggatctagttttacagtragcagggtcaggtgcctcctgaggcaagtgtgaatgcaaactccacttactgtttagcttcttttctcacacatgcccacaacatgggcatctggttacacatttgtcctctctcttcggccagttgtgtggcaaccttctgtgtgacttaccgagtgtggaaaggctgcctgctgcactgctmctctcacaggtgcctgtgatgccaccaatacaggttttttgggggtttttttgaggcagagtcacagtctgtcgttgcccaggctggaaagcagcggtgcgatctcagcttactgcaacctccgcctcctgggttcaagcaattctcctgcctcagcctcccaagtagctgygattacaggcayctgccaccacacccygctaatttttctatcaatacaggcttatatggttcccctctagaatgtagagattcctgaggcggtgccagactaggtccctaaactcacagcatgaagggcttttgagaattctttcttcctgttgggagaaagtgagaagataaaaccagaagttgcccagacgtgaaagggcagaaaaagccccagcagggattgagaaggtccctctactactatgccaccaccttacctgcttgcctctgagtttaatctttgaaaaaatttgcattgtaaggttttagaggcactggacttctggaactgcaagcccgccatttttttcagttgttgctttgatttgcttttggtcttttaatttacttattagaagttaaaccattttcttcatatattccataagtctaatccaattattgacctccatgggcttagctcctcatgcagtaraggcatataggcatgctgtcaacgaccccaaccccaaaaaagaactaaccaattgcgactgggtgtggtggctcacacctgtaatcccarcactttgagaggccaaggtgggcaratcacctgaggtcaggagttcaagacaagcctggccaacatggcaaaaccccgtctctacaaaaatacaaaaaaaaattagctgagtgtggtagtgtgcacctgtattctcagctactcgggaggctgaggcaggagaattgcttgagcctggcaacggaggttgcagtgagccatgatcgtgccactgcactccagcctggacgacaagagtgaaactccatctcaaaaaaaataataattaaaagaccagtttattttatttatttatttacttttttctttatttctgagacaaagtctcgctctgtcaccgaggctggagtgcagtgtggggtgatcctggctcactgcaacttccacctcccaagttcaagcgattctcgtgcgccaccacgcccggctaattttttgtatatttagtagagatggggttttgccatgttgactaggctggtctcaaactcctcagtcccccaaagtgctgtgattacaggcacgagccaacacacccggcctgctttatcttttttaaaaaagaagtgatggcttgtgtgtcatttaagctggagaattcaggaaccaaaatggtttgtgggcaccactgtcagtccttgatgcaccccctgagtggcctcagggtccctgaactgagaggagcacctgctacctgctccttcctattttaagtctaaaacggctattatcactgataaatgtgaaaaaaaaaaaggtggtgcccttccactgcttagtcatgttcttatttttgtctccattactagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacggtaagccctgagatgcacctccgctaagcatcctaaacagctttatagacacctgccctagacatgattgcatccarctcaaattccagctcagttcagaaatctatcgccctgacattatctctcagccctgactgctcagcttcatgctaggaaggagaccacacccgcttctgaggcagctcattcactcttagatcaaaggagttgctagaaaccttttctgtctggtggagcgaggtctgcctccatgagccccccttggcagtacttattctaccatcccaggctccctaaagcaaggctcatcagtcctcccaagaccaccagcagagctcaagccctgtcacataccccaaaggtctttcctccccaggcggcacatctccagccactgccgacatgtgatgggaagcaagtgtcaggaaatctgaccacggtcctcagccagtgctgcctgattcagggccccttatatgcaggaatccaggatgtcaacacagtccttcacacaccatatggaycacttctagcttggaggaaggaacgggagaaggaaagagagaaggttcccatgggcctaaacactgcatatttatgtgcagacacattgcagttgcatgttggtgaaaactgaggcccaggtgtctgcatacaaacagcaggccttcctataatttaaagatgttggtgaagggttcagcaagctcagacaatggaaggatgaaacatggcatgcggcatgcagtttgatcaaaaagaaaaacatgtctgccggacgtggtggctcaygcctgtaatccyaacactttgagaggccgaggcgggcggatcacctgaggtcaggagtttgagaccagcctggccaaaatggcaaaaccctgtctctaccaaaaatgcaaaatttagccaggtgtggtggcgcacacctgtaatcccagctacttgggaggctgaggtgggagaatcgtttgaacccaggaggcagaggctgcagtgagctgaggtcatgccactgcactccagcctaagcaataagagtgagaccctgcctcaaaaaaaaaaaaaaaagaaaagaaaacatttcaaatagcttgcaaataccartaatcacccatgaactgacaaaatccaaacattttacaaaacaaaagggtatgagccattgaaaacctgctttcatcaaacaccattttcattttttcttaaaacacacctatcccatttaaatcccacaagttttcaatgagagcattagaaggatcttctcccattttacaaactagaacatgaaggttcagagagtgatgcactttggatgttgccctcatccagatctcacgctgaaatgtaatccccagtgctggaggtggcgcctggtgggaggtgacgggatcatgggggcccatttctcatgaatggcttatcaccatccccttggtgctgtcctcccgagagtgagtgacttcctgmgagacctggcggtttaaaagtatgtggcatcttgctctctcttgcccccacttagctttccaccatgattgggagcttctagaggcttccccagaaacagataccrctatgcttcctgtacagcctgcagawtcatgagctaattcatcctcttttctttataaattacccagttttagttatttgtttatttgttttttggatggagtctcactctgttgcctaggctggagtgcagtggctcgatcttggcacaacctccgcctcctgggttcaagcaattctactgcctcagcctcctgaatagctgggattacagtgcccaccaccacacccagctaatttttttatttttagtagagagtggggtttcgccatattggccaggctggtctcraactcctgacctcaagtgatccacccacctcagcctcccaaagtgctggggttacaggtatgagccaccatgcccagccatccagttttagttatttctttatagcagtgcaaaaacagcctaaaacagagaggttaagtaacttgcccaaatgctagtaaatgaaaaggatcaaccagaacacaggctcattcatctaagcccaggttatgtttcctgtaacttactacctatagattaattccataggtaaactgaggcaccgtgtccytgtggataaaacaggaaagagtagtctgcctcatggtgtggtcagatgaatctgaaacaagttagagaactttacacggaggatgtagattagtagattctcccacagttcacaacctrtgcagagcagggtcctctctcctkccccctgtggaactctccatctggggtgagtaacaaaagcattccttgaatcatgtcaccatcacccagatgtgtccttgtttaagatgctaagatgccccagtttgagacaccaggagacccaagcactgccccagaggttcattacccaaaataaaataacagggcggggcccatggatccctgtttgaatgagtctccgggcgccaaattagagaactaccgaaatattaatggaaggatggatggatgagtaggagcctggaactttctcaagacctgggatgtcaaatcccaaggagacctcacgtgtccagctgtggtgtggactgggggccgctccagccagctcactgccgtatgaccctggaatcaccaagagcagactcacatgtttgagctgaacatgctggaagtgtgggccagacggcaccgcttctgggctccggtgcatgaaacaaacaagaaccaagaactgggataaggagtgctgaaacccgcaaggacaggagctggggagatgggaggccgcctgcgggaatgaaagcacaagagaacgagggccatggggttgggggcggcacaagtgctcaggtccttccagccgcttccctcayacagatgccacttccatccctcagacgtttaaggagtgtgcactgtgagccacgcactgtgacaagcaccatgtcgtgccagcaggtgactgcacttgctgtagctccagggtcatgtgctgtgtcagggctctttgatccctgtgtccctttaaaacgacatgatcttcatgggcagtgtttgttctcttggcccctctcagagccaaatgctgtgctcgtgagggcggtgctggttggcaggggatgggcacagagaaatcaggtggccagggcagctggaggagggacctggagccgaacaaggggagctgggaccacgagcaacccaggtgacatcctggactctgtcaaagataagcaaagcaggacgctaattaaagcagtcaaaacattttattcagtaatgactggagttgggwaaagggccgagttccatttactcagaggtgttttaaagggagaacgagggccggggcaggaggatcgcttgaacccaggagttcgagaccagcctggccaaaatagtgggacccccatctctataaaatattttaaaaattagctgggcatggtgacacatgcctgtcgtcccagctacccaggaggctgaggtgggaggatcacttgagtcctggaagtcaaggctgcagtgagctgtgtttgcactactgtactccagcctggacaacagaacaagactctatctcaaaaatgaaaataaataaaaggagaatgagggagtagaaagaaagaatgcgtggggagttgagcagaatcagggaagtgaaaaaaattttaaatcagctaaggggatgggtcagtgccgtgaggccctctgtgtctgtgaaccggtgtttatcaaggctaggcttctaccctcccacagagacagggagacagaggccctgtacttcctgatgatttcaaaagaatggctcgcagatcrttgagaaaaatatccctgcgttgtgggagatacatacatgtctcaaagggacasaggaaggattcaccactataagccctttttaataaatgctctccgaaagagaggtcaaggcctcgcatcaggggctgggaagaacaaatggtaagttccttaggcagccttgggtttttccagacaggaattcaagggtgtggccttggcctgctagaagctatgctggggtttggccaagtctcttagtgcaggggtttgtttkttttggctttggttttggtttttsaggcggggtttcactctgtcgcccagtttggagtgcagtggtacaatcatagctcactatcacagcctcgacctcccaggctcaagcgaccctcccacctcagcctttcaaattgctgggactacaggtgtctgccatcatacccagctaatttttaaaaaattttttttgttgtagagaaggggtctyactatgttgcccagactggtctcaaactcctgggctcaagtgatcctcccacctcggcctcccaaagtgctggggttacaggtgtgagccaccacacctggcttagtgcaggggtttggatagagttgttcaygcagagtttctgtttttctcaatatagaacgagatggtgcctgtgtttaactcaggctcaggtgtccaggggagtatcacttgctgtgtcaaggcagaagtggtatatccagacctgggaggcccattgctacactgccagtagtaggtacagtggatcagaattcttgcttgttattcttttgatgtatrtcagcaataattccagaaaccaaactttggagaagataggaaaagggtgaaactcttcaaaaacctctgggtcctccaaccagttgctgtttctgagacgtcccccaagataaacgtacaggctctgttttcagggattgtgatggttaaaatgctcttgggatcactgtgacccgacctgtgacaagaatgtaacatgcccattacccctggcagaaacggtcccctcctggatggtggccgtcatcctcatggcctcggtcttcatggtctgcctggcactcctcggctgcttckccttgctgtggtgcgtttacaagaagacaaagtacgccttctcccctaggaattctcttccacagcacctgaaagaggtaggtaggatggagtgagatgtggatttgaaaaccttgatcggaaagagctttcctttctagttagggctgcccaattccagacaacatgttttccaggaaaacacacacgcgcgcgcrcacacacacacacacacacacacasacacgcctcttgtgtgctggtccattctcttgtaaccatgtcaggtgaaggaacagccccgaggaaaggggcgcggggttgtccagtakccctcyctgcacctagggcatcgctccttctccagccttcactgcccaaagccccaggtccctgaggagcaaaggtgatggttctagggcaggaggggaaraacagagctcagtgtggaagaaagagaaaactggaggctaaatgccaggaaatcaccagagggagagaatgggaggaaagaaaggaacatttccagttttggaatatacgagagcgattgaaattctgggtagtgtttcctggactttaggaaggctatttgtaaaagggttaggaagaagaaacaatgcacctgactaatgataacaggactgaagaagccctaagawatgamactctggatrgtcactgacactagagaatgaaaagatkccaagcccggacccaaaggaactatctttggtctcatttcccaggaagcagactctaagatagagatttgtattcaaaaggcttgatggggmacatccttgggaataataccctaaaggagtgaaggtagccagatgtggcagagagaggttgagctgtcacacagccacaacagaggcctcagccaatcccatgtggcctctcgagctggggtggccctttagagatgtcctaagctgaggcaagagggatgggcgtgtgaactccacattggccatgcgctggatgtgggctactcccaggaaggggccctaagctagggtgagaggtgagacagcagcagccaggagctaggagcacgagtgcctcattcctgaaggcaccacagcctccattacagtcacccctgggaccacttggatctactggaagcagctcctccaggatctgagttgatctcgtttcctggggagggttacaggaggaagatgagtggaatgcactccagcccccaccgctgctgctggtgtcgggaccacaaaggaatgcttgtgggctggctccttcctccgctggccctgagggccygctctcctctcccgggaggagyctgtgctgtaggggctgctgacctgattgggtgacccagccctcatcccagaaagcactgagcctccggtccccaagcccatctcaggcaatggcctgtccctgcacttgtcaatttgctgtcaaaatcgggcaggggagtcccaggrggtgcccagtgactctggcgggtacccactgtgatacagtggtgacttctctcttgcctgccagtctcttggcctgaggaggtggcttaaagtttatcgggccttgtttcatgtcccctggtagaaatgctcccactctgggaaccttctagaccaggtgtcagcaaactttttcttaaagggccaggtaaaaaatattttagaaggccaggcacagtggcttatgcctgtaagcctagcactttgggaggctgaagtgggtggatcacctaaggtcaggagatcgagaccatcctggctaacatggtgaaaccccgtctctactaaaaatacaaaaaattagccaggcgtrgtggcgggcgcctgtagtcccagctcctcgggaggctgaggcaggagaatggcgtgaacccgggaggcggasstggcagtgagccaagatcgcgccactgcactctaacctgggcaacagagcgagactccgtctcaaaaaaaaaaaatacaaaaatacaaaaattaacccggcatgctggygcatgcctgtaatcccagctactcgggagactgaggcaggagaatcgcttgaactcgggaggtggaagttgcagtgwwccctcacaccactgcactccaccctgagcaacagagcgagactccatctcaaaatttaaaaaattttaaaatttatatatatatatttgaggttctgttggcaagaaataaaaatcaaaattatgtagtcacttatataaccacttaaatataatcatttaaaaatccraaagccatgtgaaaaaacaagtggtaggccggatctgccccgtgggcctttgtttgctggccctgccctagacccacagagcctcaaatcacaaggccagggagcagcggtttccccagtaggtcactgggcatgatgagggtgaacagggccactcctgccctgcgcttgcttcctgacgcrggtgttccacctgctggggacacagccccacatgattgttggtcttgggtgcatgccaggggctggaggacaatgccytgccctcaccaggtgtcatctccaasstggcgcctcccctgcactttcaacaggccgctccgtccttcttccagtctggcagctgctgggtggtgcagggtgggatacgaccaggggggtcccgccttcactgtcagtgggcccrttggtctggcaccatgtgatacggcgtctctactagtttgtcggggctgctgtagcaaagtagcactcgttgcgcasstgtaacaacgggaattgattctctcacggttctcgaggccagacgtccaaaatcaaggtgtcactaggatggtttccttggaggctgtgagggaggatctgtcccaggcctctaccctaacttctgagggttgctggcgatctttggcgttccttggcttctagaggcatcacccagtctctgccttgatcttcacaagccttctccctatgtgagtgtctgtgtccacattgcccctcctttatacagacaccagtcacgggaggagggctcaccctgctccactataccctcattctaacttaactgatcccctctgcagcaaccctatctccaaatacagtcacattctgaggtagagggattaggacatatgaatttcttttttttttggagacggagtctcactctgtcacccaggctggagtggagtggcatgatttcggctcagtgcaagctccgcctcctgggttcaagtgattctcctgcctcagcctcccaagtagctgggattacaggygccctccaccacgcccggctaatttttgtgtttttagtagagacagggtttccccatgttggccaggctggtctcaaactcctgacctcaagtgatctgcccgccctggcctcccaaagtgctgggattacaggygtgagccacagcgcctggcccagaacatgaattttgtaggaacagaattcaacacctaacaggatcctctaccaggagagaaaacacctgtgaraccttgggaatcctgacaggccctgcaggacacgaacagcaaatcactcctaaactaaaggttagctccagccaggatgcaccactgccccttcyagagtggtgcaagagtcgacgtcatcagcttgctaccaggtggctggtcagtctcctcggggaatgccgtcatatcaggggctcagcattgatctctgtcgcaggcaggttggacattccacagcagtggtggctacccagccgtgggagtgggagccccttctttcaggcccacgcgcagcctccatccctgccaccacggctgctgtgttcatgagccctgtgccatgtacaggtgaccagtggcagaggctggctgacatccactggctgtgtcatcatgtctccctggctgtctgctgtctatgatacatgctctcagtgggagttaatatgggatgcagaaatctccacgctccagctactccctcaggtccatccttcttcccaaacgtccttgtccctaaccttccagtcttccttccccagggcccctgaccaccaggcttgtcactaacccctgcctgggatcccacagctggcctgatcttgggctgcttttctttccacataaaggtgatgatcagacccacggcccaaagctctgcccrtggggacactttctccctggttggggctgaagtgcagcagcgggccactttcggtgtgtgcccacataccatgctaaccttgccatgaaaccaggccggcctttcctcctacttctgctaggcataattacccatccccctttatggtcatcatgtgagcagacacagacacggtgckacaggggtagaggggacaggagtccgagccacctgcatgtggccaacatgcaccctctgaccccatctcaggacctactgggtctcaggcctcatgatggtcacttctgggcagcaccatcacctcgcgtccctcgtcagaagctctgtctctgccgggaccccatagcgtcccaggagctgctttttcaaacagagtayaattatctgctgcagatggccccgcctgaccccagaactctcgtatctatgttgtgactttcctcttgggatttgccataaactccacccagcatcttttcccaccccagacacttcaaggatatgcgaagtcacacattccccaggttggattcacaggccgtccctggtgggtaatgtaccagtcctgaggtgtgcatagggctgcaggctgcacrgcccataccttctgcagggccctttcctgcctggrgcccctccgtgccagcagcctcctgtgtggtttgataaacatattggaacagtcagtattcctaggcgtggaacatgctgcctccagaaccctgaggcctccacagcacaatgcttccttcctagtggtgggaggggcaagatacaataattggtcctttaaagaggatgtcctggcatgccccactgcaagggtcccctcaaatatcacagatgtggcaggtccctgratctctacagggtgagtttctcaccctctgcagtgtgtgtgcctcaccaatgccttgccacttcttggcgtgtctggtcctattaatgtattgttgtgatagctaatatcaggcccttgtccccgcaccaccagtcagctgatgcaggctgcctctggcaagggcacagagccttgaccgaggcaactgccttctgggaagggcacagcctagaaagggactcagctgtgagccatttcagcctccgatattcctggaggctgggggaacaagcgcctcctccacaaaagggatctgggcaacatagcactgcatctaccctcgatggcaagtggggcacaggaccataggcaagtgtttcagagcgactagaaccccctacagagagtgccaggccgagcatggtggctcacacctataatcccagcactttgggaagccaaggctggcagatcacttgaggtctgaagttcgagaccagcctggccaacatggtgaaaccctgtctctactaaaaatacaaaaattagccacgcctgtaatcccagctactcaggaggctgaggcacaagaatctcttgaacccgggaggctgaggttgcagtgagcagagatcgcgccacygcactccagcctgggcgacagagtgagactcgatctcaaaaaaaaaaaaaaagtaccaaggagactgcagcaccagcatgaactargaatcctctatgagcttttgagaagccacagctgcagcaggaagaacaaagaatgagggtgggccctttgcttgggtaaaaggtgttgtgttaactgagaaccaaaaggaaacaaaattattcacctgctatttttgcttctggcttcaccatcagagaaactggtcagacaggaaagaacagacggaatgaacggtagaggggcctgctggcatragctctcacctccraggctagaagactttgcagacttgaccgtggagccagcccctgtaagatctgagaaatcagagatgggagtggagggtgctggagaagggccaggcaactayggagcagttcgaggtcctcacatcacgactttctccagcttgactcataatgatagaatccattaaccaggatccagaggatcatttcgagttcagggagatttgctaggaatggagactttgagttaaaaaagcactagggaggttcatcctacactgatctattgagccagccaccagtttgtgtgtgtgtgtgtgtgtgcgtgtgtgtgtgtgtgtgtccaaccgggagactcagctgatactgcttccttgagatttaatacaccttcctttgatctctcctgtccccattatcccaggaaaatccagagtagcttccagtccattctcattaatccactggatccaaagtttagagaggttccccttccctccagcctccttcctggcccaacagaggagcaccccaccaccctccatcagctgctcaaaacccacaagggaaaaatccctacaggtccatgccaggaggtagtggagctaccctcaggttccattaagtcataccagaaggctgagtgtagaaatgacattaagaggggttccatctgtagggaaagggttcaagatgcaaagctttacagaaggttctccgtctaattgtgaagattaagagcactggtggacctaggaakatgaagaatggagagtgggaaaccagcagagatttcaggaaatgtataggggcatcttcatcgttcaaagcaccggakakacaaagattattagactgtggtccctgcccttaaggagccctggctacaggtgacacaaactgagaagagttggtgtctattaaaagtgagaaggcagctctgtctgatagagcatattgcaagccatgtgtgttttagatttgctagtagccacatttttaaaaagtccaaagattgggccgggtgckgtggctcacgcctgtaatcccagcattttgggaggccaaggtgggcagatcacgaggtcaggagatcgagaccatcctagctaacgctgtgaaaccctgtctctactaaaaatattagccaggcaaggtggtgggcgcctatagtcccagctactcgggaggctgaggcaggggagtggcgtgaacccgagaggtggaggttccagtgagctgagatcgcaccactgcactccagcctgggtgacagagcaagactccgtctgaaaaaaaaaaaaaaaaaaaaagtccaaagattggccgggcatggtggctcacacctgtaatcctgacactttgggaggctgagacaggttgatcacctgagatcaggagttcaagaccagcctggccagcgtggtgaaaccccatctctactaaaaatacaaaaattagccaggcatggtggcgggcacctgtagtcccagctactcaggaggctgagggaggagaatctctggaacctgggaggcaaaggttgcagtgagccaaaactgtgccactgcactccagcccagacgacagagmgagactccatctcaaaaaaaaaaaaaaaaaaatcttcgtttgtatagcagtgagtatccccacttgtaaaaaaataaaataaaaataaataataaatcaaaagatgccagaggccgtggctcacgcctgtaatcccagcactttgggaggccaaggtgggtggatcagctgaggtcaggagttcaagaccagcctggccaacatggtgaaatcccatctgtactaaaaatacaaaaattagctggcgtggtagcacatgcctgtaatctcagctacttgggaggctgaggcaggagaattgcttgaacctgagaggtggaggttgcagtgagctgagatcgtgccactgcactccagmctgggtgacagagcaagactctgtctcaaaaaaataaaataaacattaaaaataaataaataaaataaaatagattttccagccaggagttctgtgaaaaaatctttgtaaacccagaaaaagaaatggagaaaattgatcattaactgtcctctttccctccacagtttttgggccatcctcatcataacacacttctgtttttctcctttccattgtcggatgagaatgatgtttttgacaagctaagtgtcattgcagaagactctgagagcggcaagcagaatcctggtgacagctgcagcctcgggaccccgcctgggcaggggccccaaagctaggcyctgagaaggaaacacactcggctgggcacagtgacgtactccatctcacatctgcctcagtgagggatcagggcagcaaacragggccaagaccatctgagccagccccacatctagaactcccagaccctggacttagccaccagagagctacattttaaaggctgtcttggcaaaaatactccatttgggaactcactgccttataaaggctttcatgatgttttcagaagttggccactgagagtgtaattttcagccttttatatcactaaaataagatcatgttttaattgtgagaaacagggccragcacagtggctcacgcctgtaataccagcaccttagaggtcgaggcaggcggatcacttgaggtcaggagttcaagaccagcctggccaatatggtgaaacccagtctctactaaaaatacaaaaattagctaggcatgatggcgcatgcctataatcccagctactcgagtgcctgaggcaggagaattgcatgaacccgggaggaggaggaggaggttgcagtgagccgagatagcggcactgcactccagcctgggtgacaaagtgagactccatctcaaaaaaaaaaaaaaaaaaaattgtgagaaacagaaatacttaaaatgaggaataagaatggagatgttacatctggtagatgtaacattctaccagattatggatggactgatctgaaaatcracctcaactcaagggtggtcagctcaatgctacacagagcacggacttttggattctttgcagtactttgaatttatttttctacctatatatgttttatatgctgctggtgctccattaaagttttactctgtgttgcactatatgtgttcatgatactacctgtgtgtcattgttagatactgaaaaaggctctagtttgccatcttgatgtccactcattccacaagtacttcctagaccctgcctgctgttgaccaggcactgtgttaggtactaggtctcagtcatctgggagctctcagtctaaagcttcaaaaactagaattgcagtcaagggccagatccgttattaaaaaaaaaaaaacctagaaataaaaagtatagttgtggaagtttaaaaagccaggggacaggcttaacaacagattagacacagaactgagcaaaaaagggagtctccaggtacaatggctcacttctgtaatcccagaactttgggaggctgaagtgggaggatcacttgggcccaggagttgagaccattccaggcaacatggtgagaccccttctctacaaaaagttttaaaattaggcatggtggcatgtgtctgtagtcccagctactcaggaggctgaggtgggaggatagcttgagcccaggaggtcaagactgcagtgagctatgttcatgccattgccctccggccctgcctgggtgatggaatgagaccctgtcaaaaaaaaagaaagaaagaaaggaaagaaaaaaaagaaaagaaagagaaaaggaagggtattagggttctccagagaaacagaaccaatagaatgaacatagagatttatttgaaggaactgtggaggctggcaagttcaaaaactgcagggcagaccaacaggctagagacccaggtaagagtggatgtttcagcttgagcaaaagcagtctggaggcagaattaactcctcctcaagggacctcaggcttcttttctcttaaggccttccttcaagtgatagaagtgaaactcacccacattatggagggtaatctgctttactcaaaaatctatggatttaaatgttaatctcatctttaaaaataccttcacaccaacatcaagactcgcattttacctaatcagtctagctggttgacacataaaattaaccatcatagggagggtagatctgtgattgcttttttgaaacttttttcaatgtttgctgcatgtatatagaaataaaatttggccgggtgtggtggctcacatctgtaatcccagcactttcggaggctgaggcaggtggatcacctgaggtcaggagttcgagaccagcctggacaacatggtgaaaccccgtctctactaaacatacaaaaattagccaggcgtggtggtgcacacctgtaatcccagctatttgggaagctgagacaggagaatcacttgaacccaggaggtggaggctgcaatgagccaagatcgtgccactgcactccagcctgggtgacagagcgagactccatctctaaataaataaataaataataaaataaaaaattatttttgaaattgaattttaagatcttgttacacttttttaaagaaaaaagaagttattatccagggcacagtacagagaaacaaaagaatggaaaatatgagtggttaggatacaagcctgaaaaatcaagctgcaagcgtagattagcaagctggaagcttgcacaggtgaatgcggcagctgtgccaatagaaaagggatacctggaagccaagtacatccaatatggaggttcctcctcccttctctttgtcgtcatgtgtgcaggtgtcatggtgctggccaggtagagaccccatctgcagaataaaagattagggtgggatggccagcctctttgtgggctatgtaaatggcacagctggcccaaccaatccactatgccctatataaatcaaacactgcctcttcaagctcatctgtaaaaccaaccgtatcttgccccaaacccggaaacccactcggacccactcgcaccccctccctctgcacaaggaagctctctcttctttctttcaactattgaacttccactgttaaacccagtttttgtgtgtccatgtcttcgatttcctgtgtctgtgacttcaatttccttagcataagacaatgaatcttgggtatttccccagacaaaggatgccacttcaccaggaagtgactaagggaagaacacctgtgggaaaatgtccaagaattctgggaccagaaggggtttcagcagagcatctgtgggccaccaatcagacattctagcagaaaacatatgtccagttggtttgaaagattccctgaggggaagacagtgtaagccatcctcacccccttccacccttcctcctcgctctttctggctgcctcgccttgttgaaaatatctcacttccttttggggctcctgcccctcccctaacatacctcccacacccatccccagactggtttagcctccagggcacctttgttccttcctctcacaaccatgggtctcagccgtagctgcacactgtggccgccaggagagctttagaaatgtggatgcccaggccttaccatgaccaatgaatttcagctctctgcagagggatttttgcatcagcattttttaaagctcctaggtgattccagtttgcagtcaaggtggagaacagctgctgtagcagagcagttatgatagattgaaaggacgtgcttacctgcacttctgtgtgaccttatgttatctggctttcaaaggggtcgctttcttttaatacccagctaactgactccactcattaccttgtgcttccacaggaagatttctttcctgaggggttgtgagtgtctctgggaaacatgccccaggaatgcatccttcccatgcacttcagccttctcggctgctcaccactgaccacctgggaagcaattctccaagttgctacccctttctttgtgcctaataagataatcctaagtagctggtacaaagaaatatttgttgaattaatggataataaataatgatggctaggtgcggtggctcacccctgtaatcccagcactttgggaggccgaggtgggtggatcacctgaggtcaggagtttgagaccagcctggttaacatggtgataccccgtctctactaaaaatacaaaaaattagccaggcgtggtggcaggtgcctgtaatcccagctactcaggaggctgaggcagaagaattgtttgaacccgggaggcggaggttgcagtgagccgagatcgtgccactgcactccagcctgggtgacaagagggaaactccatctcaaaaaaaaaaaaaaaggtaaacaaaagccttcttgggatacatgacaattatacatgcagattaaacagagagctgtaagttaacaaatcaccataaaacatatgcaagcgaaaaacaaaaataaaacaaatatgcaaagtgaaagaaaacagttatgttctgtacaggatatccagatgctacagtctggatgtttgtgcctctccaaaattcgtatgtagaaatctttaggaggtggtgaatgggattaatgacctcataaaagaggagctgcccatctcttccaccatgtgaggacacagagaaggtgccacctatgaggacaggccctcaccagacactcaatctgctgatgccgttctcagaggtgtttgaaccagagcgactccatcttgaagaggggctgggtaaagtaaggctgaaacctactgggctacattccttggacaatttctgttgttttaaaccacccagcttgcgatcatttgttacttctgccgcaggaaacttaatccagcacggaaagactctgttgttttaccctgaccagttctaatatcttcttagtatctaaaatggggaagaagatgggcagagggtcattcagatttattttacgggaacttagtatcttactcttctcagcaagggagttagctgagaatgactgggcatgctgcctcactgtcccatttcctgaactctctagttcagaaaatgctgttgcaaatcaacttccttaaaaaacaaacgggaagtaaaaaacaaagtctattttatgaactagagactcagagactcaacatgatttttctccctgagtcaggtccatggttctgtctcctgaccacctcaccactcctgtttgaatcaagcagacaccaaacaatgtctttgtttccatgcccatgagaactcttaattaaacagccactgactattgggctggcactttacgaggtcaaatttattgctgttggattgtgataaaaaagataaccggaaggttaaagctgtgggagtaatatctctgagcaggaggagtcatggcaaggacagactttaaattgggttaaacaattcaatataaacaggaaacacaagccagctgcagttcccctcctcttggcctctgcctggggcctgcctgctactgggctgcccctgagggtcgcattgcacacctgccctatggagctgatggggtgggagcgatagccaacccttacttactgcttcctatgtgcaggtcttgttctaagcacttttacattttcatttaattcccacagcaacccagttaagcagatactattatctgcctcatttttcagataaagaaactatggcacagagaggttcaatcacttacctaagatcacacaggcaagaagtgacagagccaggacttgaacccaagtggtctggctccagactcaatcatctaagatagccacccatgatccccacctcctggtagccacacccttgagtaatcccttcctcttgagtgtggacagtgccaatgacctgcttctacccatggaaagcgacacaggtgacaggatgctgtcttagattccataggattgtaattctcatcttgccagcagactctctctgttgccttcttggacagcacacttgcatgaagcaagctgccatattggagaagtcacatggctaggacctgaggatgcctcctccagccaacaacgaacagggaatcgaggttctcaatccaacagcaacagggtgaggcactgttctaaaaacaagaggctggagctcaaggtggactttcagcgattccctgctcctcatccagggagctgccaatcaggcataagtcacgccccttctgccaggcaggagacttctttcatttctagggaaatggaagctgggggttccccgatgactgctccatgcgggagtgccaaggctgggcccccttgcgttaacttcaggcaactctgaatcatcatccatctccaacttctccctctgcccaatcctactttcctcactccttacaagtgttgtccccaagagcatttccagatgaatttcccacatgcaaattttccttccagagtgtgtttccagggaacccagcctaatctagagatcttgggaagacctgttgccgcagagtgatgacaataaagtctagacttcatggtattgaggagtgaacaggagggtgtggagaagctgggacagcaggtgtagccaactcctttgagaaggacggcttttgggctcagaagaagtgtgacagtgtctggaaggggcaagaagaaagtcgagggggggatatttcaggtgagtgatattacaccaccatggtatactgtcgcctgaggcctgtagacaggaaatgaggagtccggctcctagttagaatcccagggctggtttttcaggactgaccctgggcaactttaaggctgtaccaaggaggcctcacagggaggctccctctccagaccagaactggcatagccagtgcactgcagtccctggagggagctgcggtcaaggtctcaggcccctgctggccatgctcttatgcacacctgtgttcccagccttgcacgtgtgcccaaggccttcttcaggcacctcaactaaggcctccttattctcagggagtagggaagggggagccacgaagacattgttatcctctctgactcagttctttcctactcctggccctgtcctctctccctcccgctagttcccgggtccataaaactacagaag

SEQ ID NO: 17671 - DNA, 15510 bp, Homo sapiens
attctcctcccagtggcttgtgggtgaggtggggcccagaccccatgcttcctgtgctcccaggatctgggcacgggtggagaaggggccccacggggtcttcagtgcaggtccctgctgaatgccaaggccctgggtgcacgtcctccttgaacttgctgtggagttcgtcaacagagctgcgtgccttgttggtagagggtctcagggcagggctggagcagagaggcccctatgtggcagccggccttcagtcttgttcctccaagcaagtggggtggagatgttggggtcctttggctggatgccactatctgttgaatctgacaaaataattttcttttttttttttgagacaagagtctcactgtgtcgcgcaggctggagtgcagtggcgcagtctcggctcactgcaagctccgcctcccgggttcacgccattctcctgcctcagcctcccgagtagctggggctacaggcacccgccaccacgcctggctaatgtttgtatttttagtagagacggggttccaccatgttggccaggatggtctcaatctcttgacctcatgatccgcccgccttggccccccacagtgctggggttacagctgtgagccaccgcgcctggctctgccaaaataattttattagagaacttgagggcagtgcccagaattgaaggcgaagccccagaagcatgttttgcagagaagtgcccagggaagctctgagggcccatgtagcaaagatcaggggatagtcggtctgagggtgaatgggccactcggaccaagaccccagtcttgggggagggcttagctggagcaggtcctggcacagttgactgatggtgcacagaacccgtgcatcccacggccccacggtgctgcagctgcaggaggggcggaggctgcagccagacagcatcagaagccagcgtggttctggaaggatcgagaacaccaaggtgttagggctgcagcaggggtcctgtcccctggcacccctcaccgccctaatcttttacccttaggaggcagcagacacgaggggctgcccgaggctctagggcggccagtgaggcaggaaacatgttccagccccagctaggtactggtccgtggacccacctcccagaaagcccatcactgtgtaatcgtctaacctggggctcgccgaggcctgtgagttcatccttttggcagttcctggtgtctccttactctgctcagcatttcctgggcgggagcttagggtgcaggaccctccccaggacgacgagggcccagtgtccatgacaagagttggcccgagggctgagccacgtgtgcccatctcagacgtgggcctgagggtgcagccctggccctgtgctggccatttctaggagcggtgccctgaggtcccagctgtgatagccccacgctctgcaggaagagatcatgggggcggggagttggtgctgcggcctcgttcctctctgcagtgagtgaacgatgtttgtggtcagcaggagcctgtggggagcacaggctggtcctcctggtgtcccacccacccctttttccatgggggatctgcactcatctccagggaagatggttgggagataaccccagtctgccctaggtccccaccctccacagccagggtggtccgtggtgagcttcagccatcgagatgcgggagtctgctagagtcttcagggtcttttctctgaaaatgacaggctagcaaggagacctgggtcccctgcctcttccattccagatgccttgagtccacccaaataggggatgtgatgtttggagctgcagcagccgccctacggttgggagtcagagaagagccggtgttccagggacaatgcagcagaggctgagcccaggcctgctgtcctgagaggtggctggatcactgacactttggcagtggtgctggggtttatgtcatgacctgcagctgagcctacttccaatgaccgtgagatctgaaagactgttttgagggcgtagcctctgccatgattgtggggaatgctgtcctgtttcctcccttggccctgctcagcccagcgagaggctgaggcacacgtggctccccgggtgcccacaggcagcgtggctcaccagccgggcccttttccactgagccagaaccccccaaagccttcaatgcaggcaccacggtgagcccacgagaaaccctgcttgccacctcccacacccccacccccaagttcaaaggaaatggtccctgaaccaagggctgagatcagctgtgggtccagctgtcctggggagctgtactggagcccaccacggtgggactgttggtccggcggtgacccccacctccatgtctgtggccgcagctggacaggccactccctgggccacagagatgttttacctctcgcagccctcgggcacacattgagcagatgtgtgtgtgtgtgcgtgtgtgggtgggtgcgcatttgtgtgtgcctgtgtgtgtgcgcatgtggtgtgggtgcacgtgtgtgcacgtgtgtgggtaaacattgtgtgtgcgcatacgtgtgtgggtaaacatttgtatgtgcacgcgtgtgtgggtaaacgtgtgtgcgcacgtatgtatgtgtgtacatttgtatgtgtgtacatttgtatgcatgtgtgcctgtgtgtgtgtgcctgtgtgtgtgggtgcacatttgtgtgtgtgtgtgtgcctgtgtgtgtgtgtgcacgtatgtatgtgtgcacacttgtatgcatgtgtgcctgtgtgtgtgggtgcacatttgtgtgtgtgtgcctgtgtgtgtgggtgcacatttgtgtgtgtgggtgcacatttgtgtgtgtgtgcgcctgtgtgggtgcacatttgtgtgtgtgtgtgcctgtgtgtgtgcctgtgtgtgtgggtgcctgtgtgtgtggggcacatttgtgtgtgtgtgtgcctgtgtgtgggtgcacatttgtgtgtgtgcctctgtgtgtgtgcctgtgtgtgggggtgcacatttgtgtgtgcgcctgtgtgtgggggtgcacatttgtgtgtgcgcctgtgtgtgtgggtgcacatttgtgtgtgtgtgcgcctgtgtgtgtgggtgcctgtgtgtgtgtggggcacatttgtgtgtgtgtgtgtgcctgtgtgtgggtgcacatttgtgtgtgtgcctgtgtgtgtgtgcctgtgtgtgggggtgcacatttgtgtgtgtgtgtgcctgtgtgtgggggtgcacatttgtgtgtgtgtgtgcctgtgtgtgtgggtgcacatttgtgtgtgtgtgtgcctgtgtgtgtgggtgcacatttgtgtgtgtgtgcctgtgtgtgtgggtgcacatttgtgtgtgtgtgtgcctgtgtgtgtgggtgcacatttgtgtgtgtgcctgtgtgtgggtgcacatttgtgtgtgtgtgcctgtgtgtgtgtgcctgtgtgtgtgggtgcacatttgtgtgtgtgtgtgcctgtgtgtgtgggtgcacatttgtgtgtgtgtgtgtgcctgtgtgtgtgttgcaggccctggatgccagccacagagataaacgcaggaagacgtctgtcttcattctcctcgtgggtcgctggtccagaaacacctggatggaaagtgctctgcaggaacggtgcctctgcctgtggcggggaccctggtgagcggatgggccagccccacgtgtcttccggccactcagcatgcagtgtttccaggggcactaagagaccaaaatcgagatatgattagctgtaggatgtcatctaatcacagatcatcccgaggctaatttatctcccccatgaccataacacatcaaaaagttgactttttgcagctcggctgtgcctcatcttcccacgaagccccgacaggcacatccagtgaggaaccacagtgggagtcctgtggcagggtcaccccacttccgatgccctccagctgcatcttggcacgaaaaaggctgcccagttctcatgccctttcaagtcccgggctggggggtagcagtggaggctggggttaaccgccgtccgtctcaaaggcctcattgtggagctgcaaacacgaacgtccttgaaatgtgaggggacagtgctctggggcaggggctgctcactggttcatggccagaggtgagcgggctctgggtctgggtctgtgaggtgctgtggacgtcgggggtgctcctggggcagggacacagccacggccctcacaccagtggagccgtcttccttcccgaggcagaggcttggccttctcacaccttgggacccttctctcccctgtgctcatgctggaagcacagcgtgagggggcaaaggtcatgggaggcaaaaggctgggctgaggccgaggctctgtggctgtggccggacaccaggtcctgtggtggtgtgggcagggcgcgctctctcctctgagcagcctggggctgcgtgtgtgaacagaaacaggcctgccgatttgaagatggtttgaccaagtctcccaaagctgaagagaggtccctgcccatgtcccccgggtggcaatccacagacgcacctgtgtccatcagacggtatcgttgatagggagtctgaagccacccagacgtggtctgttcacgccgtggacaccacggtctgaggcagacggttacagccaccggcataggcgaatctcagccagagagagtgaactgggacaccattcacgtgatgggccagatgggctggcagcggctcgctggagccgtccgggtgggaacgctgtgtctgttggtctggtgctgcttatgtggctggttcaggtctgtcatccgtcaacctgcatatttatcactggtgcattttcatgtatgttgtacctcaattaaaacattttagggccgggcgcggtggctcacgcctgtaatcccagcactgtgggaggcggaggcgggaggatcatgaggtcaggagatcaagaccgtcctggccaacatggtgaaaccccatctctactaaaaaaaatacaaaaatttgccgggtgtggcggcacgcgcctgtagttccagctactcaggaggctgaggtatgagaattacttgaacccagtaggcagaggctaccgtgagccaagatcatgccactgcactccagcctgggtgacagtgagacttcgtctcaaaaaaaaaaaaaaaaaattaaagcagatggggtgtgggggctcatccctgtaatctcagcattttgggaggctgaggcggaccgatcacctgaggtcaggagttcaagaccagcctggtcaacatggtgaaacctcatctctacaaaaaatacaaaaaatagccaggtgtggtagtgggtgccgtagtcccagctagttgggaggctgaggcataagtattgcttgaatccagaaggtggaggttgcagtgagccaagaatgcaccactacactccagcctgcgcgacagagtgaaactgtctcaaaataaataaatacataaaattatatgtatatatatatatatatatatttttttttttttgagactgtatctctgtttcccaggctggagtgcagtggtgtgatctcggctcactgcaacctccgcctcctgggttcaagcaattctgcctcagcctcccaagtagctgggattataggcgtgcgccaccacgcctggctgatttttgtatttttagtagagatggagtttcaccatattacccaagctggtcttgaactcctgacctcatgatccgcctgcctcagcctcccaaagtgctgagattataggggtgagccactgtgcccggcaataataatttttttttttttgagacagagttttgctcttgttgcccaggctggagtgcaatggtgcaatctcggctcacggcaacctccgcctctcatgttcaagctattatcctgactcagctgggattacaggcacccaccaccacacctggctgattttggtatttttagtagagacggggtttctccatgtcggccaggctggtctcgaactcctgacctcaggtgatccmcccgccttgggctcccaaagtgctgggattacagccctgagccaccatggctgacaataataaaaaattttaaagcaaaactaaagatttataaattgtaaaatgcggttgtaacaagtatttactgtaccagtaaatatgaaaaatattaatgtcctcacacacatggaggtggcttgtgagtggtgtgagcatttcatggtcagagtttggcagttgggcgagagacaggatggattttaactcgaacatcgcagacacaaaactgaaaaccctgatgcggtgcctgcaccgttgcctcctttcctgcagctgtaaatgggacgagtaattccatccccctcccgcttccacccttcagcacagacgcagtcttcagcaaggaagtgctgggaacgccctggagtgaacccaggaagatgcctgcagtgggtgccagggcccctcyccaccgtccctgctgggcttcggggccacgcccgactgctgtgaacggcctgcggagcaccacgtgcgacggctggaggcgagaggtctgcctttgatgtggctgttggtgcagggcctgtggtgccttccgcagcggaaatggcgcgccgcccggggagggcgggagcagcgtcccgggtgcccctgtgaggatgagcgacgagatgactggagggtccctgaagacctcacyagggtgcccccagccggtccgctcccaggaagcgacacccccacagccccagggctgcagctgagggggtcgccactctggctgggcgaggctgggcccttgggggcaggcgccagagtggcctcaggctctacgagatgcctgaaaacaccaacctctccagggctcactagcattggacgctttcacgctctgccctggccggaagccccctcaccccgcgcgatgtgcaaactcctgcagggctcactcagtttccagaactttaattattggaaagttctccctggtccagcccccaaatctgccgtgaacgttgacagctgagttgctgctccatgcgtgctttggctgagagcagaggggacccctgtcctccctgagctgctgacgaggggaggggtgaagggtggggcctctggagagggcaggtcccggggaagctccggactcctagaggggcggccaggtgggggccctggtgaccaggacagactgtggtgttttttaacgtaaaggagatccgcggtgtgagggaccccctgggtcctgcacgccgcctggtggcaggcygggccatggtgggtgctcacgcccccggcatgtggccgccctcartgggaggggctctgagaacgactttttaaaacgcagagaaaagctccattcttcccaggacctcagcgcagccctggcccaggaaggcrggagacagaggccaggacggtccagaggtgtcgaaatgtcctggggacctgagcagcagccaccagggaagaggcagggagggagctgaggaccaggcttggttgtgagaatccctgagcccaggcggtwgatgccaggaggtgtctggactggctgggccatgcctgggctgacctgtccagccagggagagggtgtgagggcagatctgggggtgcccagatggaaggaggcaggcatgggggacacccaaggccccctggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatcccccagctggggctggctgccaaccagacaggagcccggtgcctggaggtgtccatctctgacgggctcytcctcagcctggggctggtgagcttggtggagaacgcgctggtgktggccaccatcgccaagaaccggaacctgcactcacccatgtactgcttcatctgctgcctggccttgycggamctgctggtgagcgggagcracrtgctggagacggccgtcatcctcctgctggaggccrgtgcactggtggcccgggctgcggtgctgcagcagctggacaatgtcattgacgtgatcacctgcagctccatgctgtccagcctctgcttcctgggcgccatcgccgtggaccrctacatctccatcttctacgcactgygctamcacagcaycgtgaccctgccgygggcgcggcragccgttgcggccatytgggtgkmcagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggygctgtcaccctcaccatcctgctgggcattttcttcctctgctggggcyccttcttcctgcmtctcacactcatcgtcctctgccccgagcaccccacgtgcggctgcatcttcaagaacttcaacctctttctcgccctcatcatctgcaatgccatcatcsaccccctcatctacgccttycacagccaggagctccgcaggacgctcaaggaggtgctgacrtgctcctggtgagcgcggtgcacrcggctttaagtgtgctgggcagagggaggtggtgatattgtgtggtctggttcctgtgtgaccctgggcagttccttacctccctggtccccgtttgtcaaagaggatggactaaatgatctctgaargtgttgaagcgcggacccttctgggtccagggaggggtccctgcaaaactccaggcaggacttctcaccagcagtcgtggggaacggaggaggacatggggaggttgtggggcctcaggctccgggcaccaggggccaacctcaggctcctaaagagacattttccgcccactcctgggacactccgtctgctccartgactgagcagcatccaccccaccccatctttgctgccagctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggaggtgaaatccctgcctcaggccaagggaccaggtttgcaggagcccccctagtggtrtggggctgagccctcctgagggccggttctaaggctcagactgggcactggggcctcagcctgctttcctgcagcagtcgcccaagcagacagccctggcaaatgcctgactcagtgaccagtgcctgtgagcatggggccaggaaagtctggtaataaatgtgactcagcatcacccaccttagccccttccagaaagtgcttgaagtttgcgggtggagggatgggggaggggaaggtgggcaggggtgagagtcgagagggaagaaaggagtcccggaaaacgtggctgcctccccaggtgaggaagccacagccccagaggccccaaatgcctggggagtgtggaggtcccaaccaggcttgcgctgaccctgcttctcggttttctctccgtgctgacaaaccccagcctagaggaaggacgagcaggtgcagcagggccccagtcccctccactcttgacgctgtcctagctgcagaagaggcgggttcccagccttccctgtgaccacatgtgacctcagccgggacacatccctttgctggccctggccctgagtccctccagccatgatgagccgtgaatgggaccatccctgtccactctgagatgcctggaagggggctcagtgcaggtgggctgggggctgggtctgctgtctgcccagcactgccattctgggagtaggcaggtggggaaggggtcgggggtggagggtctgtgttcagccagtcctgggaaatgcttgatgtgaggcttctgaagatggcagtgaggcagaggcccagccggcggagaagtccctgggagtgagtacctggggatgaactatgctgcctggtgctggggagcagtggcgcccctgggccatccctctgctgaaacctgggcgtctcgctgaagagaccacctccatttcctctgcagagactgagcactcagtcagcccccttcctgggacaggctcaatggaggctgcagggccatcagccgactcctacgcaggctcagtcagcagccccctggccagccccacccctgactgccggcctcagaactgggagctgcttcctggcagggcccgcctctgctgggagaccggacggtgagtcagccttaagcccggcaccagacccctctgaggatggagcaggagctggctgccctgaggctgcaaaacttcttccctcgtggagacagggaggcacctcagacactcaccccggactcccttgaacagggacagggaggaaccccaggcagctagaccccagcagcagccacacgagcacactgtggggcagggaggggcatctcttgagaacaaaagatccatttctcgactttccaaactggagagcttcttgagagaaaagagagagacaggtacaggtccacgccacccacacacagccctgtgcacacagaccggacacaggcgtccacaggcaagttcgcagctgctcattttgtgaagtgaatgctgatttgggggccgggtggggttcgtctgtacatcgtgcactgtcagacccttcctgaaggatttttgttactgaagtatcagaaggcccttgttctaaggtggtggcactgtaatatctggcccaggaggaggtcagtgccgtgccggcgagtcctttgctcccttccttctctgaccagtaaacgcatctccagtcgctcccccgaggcccccctgcacgcagtctccgacctcagagagtgagtcagatagaagccgctgcccaccctcccccaccctggccgggttcttgcctggcttgtgcgtccttgtgacaattcctgacacggatgcgcaccgggcagtggcacgtccaggtgctgtgcgcgcccgggcccacaaagctcctttggacgctcatggcagccccttggtggaggaggtcgggtgcccaccccctccccgcccactgcggaagccggcgacccacggagctcgctctcggccgccgccacccctctgtgttcgcgcccttccgagctctgatccgacgctttgtttcttctcagtgggttcagggcctgggccagcctttacctacctcccccacccaaaaccggcaaaagctcagagcaccttgtctgccaaaagacagggagctgggatggtgcgggttggtctctaaaccggcgtggggaaaaaagaccctccgtacaaagccgcagggtggggctgtcgcaagggcggaaccgagagggtagctgggggcggggttcccagggccaagaggggccattgtcctccctggagcccggcgcccccacagccagctcctctgggagacagcccctcctttcgaatgcgcggggccctcagaccgcgcccggcccagcgctgggggatccttggctgcgggaggggcgccgcattgcgcgcggcgggcggggacgcgcggtgcggagcctgcgggccgggcggggctctgcggcggcgcctcccgattggccacccgcggtgacatcagccgatgcgaagggcggggccgcggctataagagcgcgcggccgcggtccccgaccctcagcagccagcccggcccgcccgcgcccgtccgcagccgcccgccagacgcgcccagtatgagggagatcgtgcacatccaggccggccagtgcggcaaccagatcggggccaaggtgaggctgcgcgccccggcctgtcccgggccccggggcgggaggagggaggcgccgtgccccgcgggccgcacctccagctgcccccgcccctgcgaacctgcaacaaagggatgcgcccagcgccgcgccgggcggccgggacgcggggcccccgccctgggactctcgcctgcacctctctgcccctgcccaggtgacctcgggctgtcgaggcgcagctcacgtcagtcgcgaagcctcagccccctccacacctgcgccccctccacacctgcaccccctccaccgggcctccgcaggtgcagctgggagccctgtctgggcgtggccctcttttttggggccgcggcatagccttgagtgagacgggtggggtaggcaggtttgggtggggtggggggttctcctcacagccgtgatttcctcggcccgaaccccccactggagtagccgaacgtcccccgagaggctagagccgccccgatttccccagcctgctccgacacccctcggcgtcctagctccaccctgtccctttgttggaggggttgggcctggactcgagatgaccttggtccaggaccaggctctccatcggcgcagccgctcctgggcaacccccgcggggcttgaccgcgcccacccagggtctaccagtctggggattggatgtgggaacaaagccgggctgtggggtgtggaggctgcaccgtggcgcgcccctccctccattgttagcccacctcgcagatgttggggccacgcagaaaggggcgttggtgcagctgtgcagggacccctgcctaaatcattaaggggacgtcgtgtcccctggtcctgggaggctgtccctggcccaaggtcacacagcaggtgcgagagagctgggctggcccttggttctcatcccctgcaggagccaacctggggctcgggcggggcgggttgggggcgctgcttgccaaaggatctgccctccgaacagtgttggggaacaggggatcggggggggaggctggctttgtcaggaccaaggccagggacccagctcagggctggtgcagcgctgattctgggaaggagggggtgcaggagacggtcctggaggggaaggggccagagaaaggcagcctccggaggctgttgccatggaaaccaggcaggaacaaaaagctaattacaacagggccagccacgtggctgacatgtaaattgcaactttggctccgggtggaggcgcctctgagggtgggaggcccagtagtggggagactctaatcacccaaggagacagctgtgcctgccaaggagagcctgggggaggggagacctgggggacagtggcctcaaatcaaaccaggactcccggagcagcctctgacagctgccttggcctgatgggaggggctgagggctcattaatgtggtcactggggccaagcctcccctgagcatctgctcctgggagggtcaggggtcgctggggggagggagggcaggcagccctggggctcctgggagggtcaggggtctctggggagagggagggcaggcagccctggggcccacctggggtttctccttctatggctgggatgggcccagagctgtggtcccacaaggcacttgtcaggcaagagctgggatctagaagtcaggtgcacatgcagacatcccctgaggctccacgggtagcagagggagcccttgtcccctggaccgtgtccttggctgccttgtgctctgcttctgaacactggagctcttagtttgcccgctactttttattccttttgagttgtttgttttttcttaatatatttctttttaaaaattaatacctggccgggcacggtggatgaggaatctcatgtaatcccagcactttgggagactgaaactggaggatcactttagcgaaggagttcaagaccagccgggataacatggtgaaactccgtttcttaaaaaaaaaaaaaaaaaaattagcctggcgtggtgggccgcgcctgtagtcccagctacctgggaggctgagatgggagcattgcttcagcgtgggaggtcgaggctgcaatgaactatgaccgcaccactgtactccagactaggcgatagagtgagatcctgtctcacagtaataatagtatctgattctttttaacaatgaaagcaacagagaaggaaattttctcgggggcgggggcggcaagagcgtgttcctttgctctgctgcccttgtggaatcaatgggaagttccttggccgttctcggcctccactcccgcagctgatagggggtgcaacgcggctgcttccctgtctggggtcctcgggcggtgcctggctgggcaggaaggcccgtgcactctgggcagagggaagtcggggtgactcgaggccgggagcaaagccgggtcccgggcggtcacgcggcagcgcggacgactcaccgcggtcacccctgcgctgggagccgagcccccggcagctcgcggggatgcagtaagccgggcgcagcccgccgggaggatgagaaaacccgaagcccggaaagccgagcggccgcctgcagtcaccccggggggggcaggggcgggccgggctatgcagaaacaccggggcccgcgggacacaggacgctgccccactgccgcagagctgaatctggacccccgggctttgctttcctggggcctgtgctcctccctccccggggcggggttcgcctgcagcggcggaggggggagcctttgtcctccgcgcgggctgcggcaccgcctcctcgcggctgcggggcggggctgggggcggggcctggccgtctcagccaatgggaggcggagtccctggctcgccccgccctctcgcctgaaagacctgcggagccgcgggccgggcgggaaccgcattcgggtcctggaggggcttggaggccccagtctcgcagccccttcatcggggacccccgctcccacctgccttggccactgccctcaaagcccggccccgctttccccaggaccccaagcgctgcgcgaggtcagcaccaaggacagcgcccgggccgagcgcctggcctcgaacgccgggttctgctttgtgtttccaggtttttgtttttggttatgagaggaggcctggctctgtcgcccgggctggcgtccagaggcgcgatctcggctcactgcagcctcggcctcccgagtagctgggaccgcaggcgctcaccaccacgcctggccacaattttccttttttcttattttcttttagatggagtttggctcttgttgcccaggctggagtgcagtggcgcgatctcggctcattgcaacctccacttcctgggttcaagctattctcctgcctcagcctcctgagtagctgggattacaggcgcccgccaccacacctggcttattttgtacttttactagagatggggtttctccatcttggtcaggctggtctcaaactcctgacctcaggtgattcacctgcctcag

SEQ ID NO: 17672 - DNA, 14879 bp, Homo sapiens
agactatgagattgaagaagtctatacataaacaaagctggggttaaattcatttaaatgagttcgaagacacttgtccagtaagatgaaaacatatacagagtattatgaataccaccacattagatacaagattgaatattcatatgattaagtaacaggcgtctttagcatttgtttgaaggtgagggagaagtgtcctcacattggatagctagtcatctgagatgatttgcaaagccatctgtctctacactgccattcatctcagctttctctacatttcacagtacttaaagactatgccaatgattttggtacttaattatatcttgccctgaaatgtcatttgacagttttggttacccatgtgtaatatttttatctagaatgtatcagcacctagcacaatgctaaatatatatttggtactatatgaattcaatttccttagattatgaccaatgttgctttgacattattaggataccattgttttattcttacattggattaaaaaaatccaaacacctagcacctatttaccattttcactgtgggtttcaatggataaaaccagatatcaacttggatacatccaagattagacagctccctgtgtaactatagatataagaaagaaaaataagcctcagtgtcttttgaatcttgctctcagttaaggttcaacataagccctgacatctttatttatttttgtttttatgtttaattttatatatgcatgtatgtatgttgagacaggttcttgctctgtcaccgaggctggagtgtggtgacatgatcactgatcactgcagcttcccaggctccagctatcctcccacctcagcctcctgagtagctgggaccacaggtgcatgccactatgcccggctaatttttgtgtttttggtagagatgaggttttgccatgtttcctgggctggtcttgaacccctgaactcaagcaatccatccgccttggcctcccaaaccaaagtgttggggttacaggtgtgagccactgtgcccagccagccctggcatctttttttttttttttttttttttttttgagatggagtttcgctctgtcgcccaggctggagtgcagtggcgtgatctcggctcactgcaagctccgcctcctgggttcaagccattctgctgcctcagcctcccgagtagttgggactacaggtgcctgccaccacatccggctaattttttgtattttgtttgtttgtttgtttgtttgtagagacggggcttcattgtgttagccaggatggtctcgatctcctgacctcatgatctgcccaccttggcctcccaaagtgctgggattacaggcgtgagccatcgcacccggccccagccctggcatctttaagtagctttgctaaccattcctgtgtccttagtggtctttcaactgctgggaataaatagcctttactgtcagtgtgaatggttctgaaaactaactgcatgatagaaccacctacagagttcattaaaaacatagatgcctgttagcccaacgtggtggtgggcgcctatagttccagctcctagggaggctgaggcagaagaattgcttgaacctgggagcagaggttgcagtgagctgagattgcgccattgcactccagcctgggcaacagagtgagactccatctcaaaaaacaaaaaaacgaaaacaaaaaacaaaaaacgcagatgtctgagcacatccccaaaaataattaattaaatctttattgatgagacctggatatctgcattttaaaataaattctacaaaggatgctaaccagattttagaattgctggtatatgtcgcttctttataacttatatgttttggattaatgatgatctttttcgtcacgtgaagactatcttcacaattagactataagatttctctaggtaagagacagtatatttatatttcctgtggttactcgaatatgattttgcttaattaatatgtcttgcttttgtgaaacacatttaacttgtctactgatgatggatcaaattgtgaatattatttccttttttcatccgagaagctaggattaaattcctttaaatgaatttgaagaattttgtatttataaccagagtcatgggttgtattccaagtaaagctttttttattttttatttttttatgagataggatctcactatgttgcccacactggttttgaattcctgggcttcatatgatcctcccatctcaatctcctgagtagctgccagataaagtttttgaaaagtgttgttgaattgggaatcttttttctcttagaaaaatagaattaatttttttttaatagagatggggccttgctatgttttccagatgtttgccaggttggtcttgcactcctggcctcaagcaatcttcctaccttggcctcccaaagtgctaggattacaggtgtcagccaccgcacctggccattgtgcctggccaaaaaatataattttaaaaagaccagaaagacttttctttagaggtaaagatgaatgagcctatgttaaagtgtcattgaaagaaattattaatggtcagtcgtggtgactcacccctgtaattccagcactttgagaggcttaagtagaaggatctcttgagcccaggagtttgagaccagcctgggcagcatagcgagaccctatctctacaaaaaataaataaataagatgaaaaagaagttatttattcttcgatcatgatggcaggcaatcaaagaatcttggaggcatactagttagagcttttaaccccacaggtcttcattgtccacatcggtgatgaccatttttttagtagacaaggcaagaacttaatgaagagaattactttacgtttcttgaatttactactgaagagttataggtagctaatagctaatattttcgtagctagtgttgggacacggaaaccaaccccccaaaatatggtgctttgatgggctgaactgtatagtatatctgatatatttatatagtgtataaaaaatcacctgacacaatagatggataatatatctgatatatttatatatcgtataagaaatcacctgacacaatagatatgtaatatatctgatatatttatatattgtataaaaaatcacctgacacaatagatggataatatatctgatatatttatatattgtataaaaaatcacctgacacaatagatggataatgtatctgatatatttatatattgtataaaaaatcacctgacacaatagatggataatatatctgatatatttatatattgtataaagaatcacctgacacaatagatggataatatatctgatatgtttatatcagatatattatacatttatatattatacatatacatttatatatatacataataaatacattgtattatacatatatgtatatattatacatatacatttatatgtataatatagttgacatatttatatatttatatcggatatattgtacatttataatatatttattatattttatattatagtatattatcatttataatatattgttatatgttatatgatatatatttatagcagacatagtaaatatctattgtgttaggtgattttttatacaatatataaatatatcagatatattatacatttaaacagttaaacacctaaacagcccaattttatgtggatcagtactactaacggcttagggtaaaatgacagctacagcataactagaatgttaaagtggcatgtctcagacaacgtggatggacataaagtatttgagagaatattgcataatagaaaaaaacattgtaaagactaaaatactaaataagacctttttttcccgagcaataatttgcccaggctggtctcaaactcttggcctcaaatgatcctcctgccttggcctcctaaagcattgggattataggcatgaaccactgctcctggccagaattcttgattaaacaatagggtctaaataaatttaaaccccttttattctttttattcttacagggtagactcaaatattctatttctttccaactttatattcttgtcataacaacccagtattctctgaggcaaatggatgcttatgaccaactggcctgaaatgggggaatatagggttagtggtgagtcacatataagaaaatgcaagagaatagcagtgtatcatatttcaaaataaaatacaaactatacataaaactgaccccaacaagtatccatttcatttcctgtcgtgtatctatatgctttcctggaaagaataaacttcagttcacaaaatcagatgtagaagatacatcacttttaaaaattctacgtaattttaattccaagattcccatgccaccaggctggtgggaaatccagttttagttgtaattaggccttttctccagtattacatatgaatttgagtgtaataccccaaaacttgagaaggccattgtatctccagtccactggggcaatgaatagcttgagcacctgatcattataatgacccagatgtgtatctttttcttttactctgcggtgagtttttctaagggaggaatcctattttgtttaattttgtattatagcatgggatattgtgcctggcagatagtaggcaatcagttagtatttcaggaataaacactcttggtcagtgatacagctaatgatttgcaacaagcatatccttaaagtaccttttcagtaacgatttccatatgaacaaagaaaaaaactagaaccaagaggtaaaattataatcctgttgtcttgttcccatagccatactctgatttcttttatgttctgtgccctggcttgatacttaatttgacagctaattataatgtttattaagctctgaaatatactttctcctggcctttttgtctgaagttgtttgaggtgtcaccatggttggaagttaagagcatggaagctagacttcttggtcttgaattctagctttgtcactaacttagtaactttgggcaaattacatgtctctgcttcaatttcatttgttaaggtagtacctatttcacaaggctgatggtggcagcagtggggcgtccagagctgccgctgccatcacgccagctgcagcagggaggggcgggcagcggcggcggagcagctgcgggagccgcagtggctgctgtgggacatctgtgcctcgcgtcccctgtgccttgagaccccaaagcagccgactgcgccgccaccatcctcgcgttgccgggtggggcgacgtgctccccggccaggagcctccaccgctccggaccctggccctatgtcgccgctctcgcccgccgccgccgcggagtgggagtggggaggaggggaacagtccttggagccggccccgggagtactcccggagcctgccgccctggaagccgccacgatggaccgggctgagtcgcccgccggaggggaagcagtgtagtcgggcacggaggggcaggcagagaggggccccaaggcggagctgggtccggggcggagcggtgttcgcacacaaagcgctggggctggacccagggttcggggccaaggcgagaagtgggagcggggcccgctttggggacccggacagcggtgtggccaccgcgcacacctccgacagcgccgcattcctgggccttgggaggaggctctgagtagggccgcctggggcgcgtcttcagggtcctcccggcactggggtgaccgccgagctagacgcgcctgagggctgagccccagggctcgtgatctgctcccggaggcgccccccaggcagggccgtgagccgggcgagggagagtcctgggctgcccctgagccccggggccacgggaagaacttgcagcgacgtcatccctgccccggacacagtcccgggcccagggaggacctggaacattcccttcctcccccscccccccgcccccgcccatcagcccagcctgcaaggaggcgccaccggacctgcacactcaggagcaggtgagccagggacaagcaggagccccgccccttccgaactggtggagcaggagctcccagggtgcagctgcagccaccttgccgcggctgtggacattttctgtgctctcagaggcccagcaaagtcccctgcccactgcaggctccagggtgcctactccggctgcctggcttctctccactgttagcacccactctgaactcagagcaaggtcgggccgagcctgggtactgtcacagcctggccgagcgtgcacacgctcaggacagtgctgatacgccagccccctgccgtctcggccccctttggaacttgggcaccaacaagcgtgggagggaggctgagaggggtctgaagacagctggacactgacttkcaggcgctccttggcatgaacagcctgggagcaggaggcagacaggttcctgggtggaaggggatgggtccccagtgaagtcccaccctgaagctggtgagggcttgaagcctgcagaccagagaggtaacttgtggtgctgctccctgggcccactcatggctgcccatggaccaatcagcatgcatttcctccctctgaggctcataaaatcccccagactcagctagattggaagagaggatgggaagacaatggatgacctacctgtggagagaaactacccattccagaacctcctctctgctgaaagctgaacactcaatgggaagacctgtttgcagagaggagccagccactccagggtctcckttctgctagaagctgaacactcgttgggacacmcttgctgtggaaaggacatccttactgtggaaatgagctactaactgcaggtctccttcctcttcatcttccttatccttctgttccattgctcagtaatgctcctcttcatctgtctcattctccacttgtctgcttgatgcaggagctgaggagctgcacagcaaggttaaaagagctgtaacacaaacagggctgcaacatgccccttgctccccacagggagagaagagctctggccctcggagaagcccagacctgggagctccttgagcccgggctgtgactccctctttggggccctggttggcgtcactgcattcgccagtgccactgttggaagctgcttgtgatgcgcctggtccagggggaagctgtttgttgtgtgcctggtccagccacctcatggagagcctgtgctggcacctggagctgcccaacctgggcagcagcttgtgtgtgtgactgcacagtggccacgcttgctcacacacccctagcacacccctctgctccacccgtctcaatctcccttggatccgggatccaggttggtagcaagtgcgagtgggcagaagcagcccagtgggcccagagcaaaactcaggcaaaggtgccactagactggccaggaaagcgacaccctaaagatcccataatgctgatatgttaattctattctataagcaccacacagaagtgatagcttttatttcttattttgtctagcctggagacagagctaaggattccttgaactgcaaagtcttttccagttcttagtttatacaatccatactcaccttctgcctaactaagcattgtcatttttgtgccaaatgaagagtaggactcctacgattgtcctcagactctcttggctcaatcctcctgctttaacctttcctacttcaaaaactcctgaagttttgcttccccttctatagaatggaaatatatgtcgcaatacttactgcaaagaaaattatatattttaaaaatagactaaagagatgttgtgagacatcagacatcaatcagatgttgtgagaactgatttctgcatcagaatatctccttgactttacagctatcctttaatcctggctcaaagttccagaagaaagatgatccaatataatactcctatttggactttgagtcatacacattccttcttctgagaaaacgtgcttctgcatgaatcctcccttcattattttcagctcatctattattgaatctgaaaccccaggttaactgactgatcactctcatcagtggcagattttgktgtaacataggacacatcactcccaattcaggtcaagtcccaattatcttgcctctcaatatgacmtgttcaatgttgtatttcattctacttcattttaatgtaaaaagtcttttctggtgaagtcagtcttttattttctcataaaaattcaccctttgggtttttcatagggtattcccataaccaaacacactttacactttcctagtacataacccaatactttcttctttccccacagtccttacatgaagcctactcagaccgacatcactgtatcatttttttgtattctgaagtccttcagcacttgattcctttaagtttaatcttggtattctattgggaatcatatggaaatgtacaatgatatttattgaatgaacaggaaacagggaaagacattgaccagaaaaagtgtttattcatcaagtctttaaagatacaaaaacacgtgtcttctgkggagctcwgaraacaggactccagcaaagcacttttcagccttgtggtcttcaagcatttccaagatctgtgacattggaaagaaaaaaaattaagacagatttgggtctccatgagcagagagtattctttsccttagttctgggtagcatagtgcccaaggaaacctaatcagtacagwgggaaaccaaatctattccaaatcattacccataagcaatcctatggactctctgaggtttgacagagtcagcggccctctccaataaatgtgtttttctataataatgtgcagtgtgagtaatttgatgtttttgacaaatatttacccagcgttttatgaaggagaaggtttgggggacaagctgaaggagctctgactgccttttggaggagtgtgagtggcttacctttgctgcaaggagcattgtactcagcaattgcaaactcatctgaaaaaaaaaaaaccaacaaaaaaccagaaatcattacatgaagtgagaaagaaagcaaacatctgtgggatacaggccaaggaaggagtttgttgtgggaagaacagtattgtaccagaaacataagcatcattcatctgatgtgttgcttgctaccttatattctcctttcaaatatagtgttttatatattcttttatcccaaactcctgaaggactcttcagatgttctacttacttaaatctcatattgtcatacagtccatttatctgatgaaaagggaactaaatatcccacaggtgttttgtattagtagttgataaatttataatgtaggttgtttctataatgtatgtataagagacaaaaagaggggcatcagacttgatggagacaaaatgaagtgataatgtaattacttaatgtaataaataaccccaacacatctcctaaacctgaatttctgtgatcaggaattaaatatttctacgtgaaaatcactctcactcacccgtctcgtagtaatcatagactttcactatggctggtttcagatctcttactgggacatcttgcagaaccgtgargaacaagctcagtgtctgatttgacacctggaaagcaaaagtcaattaaatgacctttcaggaagctttcttctctctttgaattagtttaagtattcacctgttttttgggggaaaagctttattatcctacagcacactatagggtccttaattaaattgtgcagaaatctctcagaggggatgataaattctccagattatttcttaaataactaacataacgcatatacctctgtcaatgccaatacatagctctgttcatgggggtaaatgatatatactttttattggatgactaactgtgttcattttttaatatccagagatttggtatagtttgacttctctgtcttgcaggaatacttgcgtagactcaaagaggctctaaaaggttgatcttcccaggcttaagtttcataaaatttgtaaactataattcccatcaacttatgcatgaacaaactctcctaccacacatatctataaaatcagattggtttactggtgaactggtcttattattttatggttcaagtccttgtggagactgacagttttttttccctttcatattgttgttgagtatgttgataattaactaataattgactaatcacaagggctacttccttatattactgggtatccaaaaaacttgtcaacataataaacacattttgtcaagatttcttgcttatgggattttaggaatattcatatcccaagatcataataagccatttctacctgtaatccctggtgaaatataaataaaggagagaagaacattcttttagagttaacattagaattctcaaatttctagcatggaagtgatgtttctaaaatgcatttaccttcccagatgttyccttagaggattattatctacgtttttttgcaaatagactggaagttctcttaccttatcaaggtaaatcaagacatggttgctgctgacttctgtccggctcacatggttagatctttcaagctgaagaaaattgaaataccacaaatgttaataaatagatgaaacccctgggggatccagagaaaaaatctttgtattgccaaaataaccctgagggtagaattcttcaaatgctttttgtaaggaaatatataatgtaatacaattaaaaatgaaaggcataaagggtttactattagtataacacacgactaatgtgtaaagttatttatctgaagaaaagacagctaagtatcctaaacttggtagttactcatatttcaaagttcaattcagtttctatttcttcataaggagtttttttcctgttttgcttgctctatttttcttttaacttctgtaatacttatagtttatgccaatcagtcattttcatatttttcactggttcgtgttcatatcttttatcttcttagcaaaattctaagctaagaagaaattgaaaagcaggaacctgctgacaatctttttcttgtagtcatgggtcctagcgcagtgctctgcacatggtcagcattcatacaaacacatgtgattatatttctgagctggaaaaaggataaggctttgatagagattgactttaatagtattttgatattagtattgtcttatgctggggatacatacatcattaaataaaatagggcagtctggggttatgataaacctaccattttcactgttggcttcaggggaatgaagccagagaccatcttcacatcaacgatcgccatgttggaggcagagcggctccctgtgtaactgaggatccaggggaggaaaggattagggttttctgtgtttttaaatattttcttcttctatgtccatgttaagcattccacagctctaaaaggtacacgtaagtcttcccaaatatcttatcccagtggtttgtaaaagtggtgtgcgtagaatttttaggaagcctgttaaagccacagagaccaggccctactctagacctgatgaatcagaatgtctagtgtatgggggctgaggatctgcattttttttttttgatggagtttttcgctcttcttgcccaggctggagtgcaatggcatgatttcggctcaccgcaacctccgcctcctgggttcaagtgattctcctgcctcagcctcccgagtagctgggattacaggcatgcaccaccacktccgactaattttgtatttttagtacagacggggtttctccatgttggtcaggctggtcttgaactcccgacctaaggtaatctgcccgccttggcctcccaaagtgctgagattacaggcgtgagccaccacgcccggctgaggatctgcattttaagaaagctctacaagtgatgcacaggctgtttgtgacctctaatctatgccagttattttatttatttgtttacttttattttctttcagctgacaaaatgatgtatattatgaataataaatttcagtctacattatttacaaaaacaacaataatttataatgtttacttaaacactggctttcaacaaaacacttagaaacacctagcgtcttgtccccgagagtttgcatccgaaatttggactgcttaatttattttttggcatatatatacaccaaattaaatgaaaaaaatatatatatatatacttaacttttaggttcaggcgtacacatgcaggtttgttatataggtaaactcgtgtcatgggggtttggtgtacagattactttatcacttgggtactaaattttgcactgaattgttgtttttttctgatcttctccctcctcccatccttaaccctcaagtaggctctggtgtctgttgttctcctttttgtgtccatatgttctcatcatttagctcccacttacaaatgagaacatgcagtgtttggttttccattcctgtgctagtttgccaaggataatgacctccatctccatccatgttcctgcaaaggtcatgatctcattctttttgatgtgtgccagttatttgttacatgtattttgtcctaacttttttcctgaatagtatctccaaccaagtaataatatgtttgtggagagagagttttttatcagatctgcagctatttaaatattgatgcatataagtgtatcttccccccaaattaattatatcatatataacctgagatttattattgccagtaggaattctaactaaggagtcactacttccttctattcaaacttttcaataattcttcatctctatcttcaataaagcaagaataatataggatttcattacataacaaggaattcaggtcagaggcaatgggtaatatttacttagttgttattgagggaaattattaccctttaaacaatgaggttgcacaatagtagatcctggatggacaatgtaaaccccatcattgagaaattatatcaacttaagagaatacattgcattttttgtgaatagtgcaaatatctactgttgcactgctttacttaaagaggagttcccgaaagaagactggtggttattcttaggattaggtgatagagtcagaaggtcttacctgacacttagggagatttggaagctggtgtgggctttgggttcatcacaagtttgaggcagagtctgcactcctaaagcaaaggggaactcttccttttctgggagaatattgtatttcaaggatgtctatagaacatcaaagacaaaatcagttttttgccctttcccagaattcctgtccacgtccctaaccctttctctgatctgtcccattgttttctgagttaggacttctcagagagaacagctgctgtcctcatctgtcctgtcctcacctgcccaagagtctcacctggaggtagacacatccttctcctgtcacyttcatgctgtattccccaggcagctctggcaatgagacctgctgcagtaacaggcggttgttgttgtccacttggaatttgctggaaaatgtccctgaagactggatagtcacctgtgcagccttcccagtcctggtaaatgtggctgctccatatttggacagagcatggagagccaccactgtgtcctgttagagacagatgagtgagagaacccattgggcattataaggctttgagggctgagatatttttcaaagacccatgtgagggactttgatttcctacttccctcactacttaaatataggagctgtaatttcaagattgattataatctttagatagttgaagaaccataacattcacatatctaccttggactgtatgccctacatgtttattttatttatcagaaaattgatccttttctctctgtaagtatatgtgggacatggaatgtggaaaacatgtgaatggcaatcagttattggcatcagctatttgctaacatgtctttcttgacaactatgctcatatctgccaccactcaagcaaagttcagtctggctctctcccatattaaactttgctcagttgctgaggtcagtgtcctggagagaacccaaggttctttgcagccatgagcagagtcatgcttcagtttctccaaaagaaataaaagatgagtattataattatcttctggatttaatgacatttttatttggctttccctttttattggatgatttcctgttcccagtgaatgtctgctggtatgtatcctcaacaacattaaacctgcttggcctccttcaaataatatgtttctaataaatgaatgataacctttaacaaaattacttagtttttttcattcatatgataaaagattaatacaatggaaataggatggaatgccattttgtcacattttttccgttttagggtatataagcaaacatccraattctctgaagataaaactttctgctgtgtacatatcaatgaattgttcagatacatggttatatagctagatttaggaggttggatgaataaagacagttctttatgctcctgatgaataaatgtttgtgtattaagaggtgaatagggggctggacgcagtggctcacacctataatcctagcactttgtgaggccaaggcggatggattgcctgagctcaggacttcgagatcagcctgggcaacatggcaaaacctcgtctctactaaaaatacaaaaattagccaggcatgattgcacatgactgtaatcctagatacttgggaggctgaggcactagaatcgcttgaacctgggagatggaggttgcagtgagccgagattgcaccactgcatt

SEQ ID NO: 17673 - DNA, 13502 bp, Homo sapiens
  misc_feature (1)...(13502): n = A,T,C or G, or insertion/deletion polymorphism (see Tables 1-2)
gagccactgctcctggcctgagtctagcattctttatctttaagcttagaaagttgggactagatttcttgtattcatttacatgtgaagctctgagtctgtcattcttttcttcaaaaaaaaaattatcttcttcctagatcaacaccaaccagatattattcccgctatttttttttttttttttttttttttgagacagagtttcgctcttgttgcccaggctggagttcaatagtgcaattttggctcactgcaacctcccctcccgggttaaagcgattctcctgccttagnnnnnnnnnnnnnnnnnnnnnnnnnnnnnnnnnnnnnnnnnnnnnnnnnnnncttgaactcccgacctcaagtgatccatccacctcagcctcccaaagtgctgggattacaggtgtgagccactgtgcccagcccagctttttgtatttttattacagatgggggtttctccatgttgggcaggctggtctcgaactcctgacctagggtgatccgccagcctctgcctcccaaagtgctgggattacaggcatgagccaccgcgccggccaataactgtacattttaaactaaagagtgtagcctgggcacggtggctcatgcctataatcctagcactttgggaggcttacatgggtggatcacctgaggtcaggagttcgagaccagcctggccaacatggtgaaaccctgtctctaccagaaatataaaaaattagccagatgtggtggcaagtgcctgtaatcccagctacttgggagcctgaggcaggagaatgcgcttgaacccggggggctgaggttgcagtgagccgagatggtgccacttcattgcagcctaggtgacagagcgagactttgtctccaaataaataaataaaatagtataattggtttgtttgagggaatggataccccattcttcatgatgtgcttatttcacattgcatgtcagtatcaaaacatttcatgtaccccataaatgtatacacttatgtacccacaaaaataaaaactaatcaatagaaaaaagaatgcaggatgaagtcaagggacaaagaaatgaagatgtattcttatgctgatcacatttctctgtgggggtcttcaaactacttgctggaagtcagggtgtgaaaaacatctgaagttatttatttattttgtagacagagtttcactctgtcactcaggctggagttcagtggcacaatcttggctcactgcaaccttcacctcctggattcaagggattctggtgcctcagcctgccgagtagctgtgattacaggcatgtgccaccacgcctggctaatttttgtatttttagtagagaccaggatttcaccattttggctaggctggtcttgaactcctgacctcaggtgatctgccccgcctgggcctcccaaagtgctgggcttatgggagtgagccattgcttaaggtgttaagtgattctttttttagatggagttttgctcttgttgcccaggctgtagtgcaatggcgccatctaggctcactgaaacctcagcctcccaattagtcgggattacaggcacctgccaccatgcccggctaattttgtatttttagtagagagggggggtttcgtcatgttggtcaggctggtctcgaactcctgacctcaggtgatccacccgcctcggcctcccaaagtgctgggataacaggcgtgagccgctgcgcctagcaagtgacttgttgttgtttttgagatggagtttcactcttgttgcccagactgaagtatagtggcacaatctcggttcactacaacttctgcctcctgggttcaagtgattctcctgcctcagcctcccaagtagctgggattacacaggcatgtgccaccacaccttgctaaatgttcgtatttagtagagatggggtttcaccatgttggtcagggtggtctcaatctcctgacctcgtgatccgcttgcctcagcttctcaaagtgctggaattacaggcatgagccactgtgcccagcctacaagtgattcttaaacaaaagtcttatgattccaatgtcagagaacgtgcctataggaacaaaggggatgcaaatcaattcttttatttatttctttttttctttgaatttccttcctcatgttaaagcaaatcaattcttaaacagtcttacaaccctaacttcagaaatcctatctataggaataatgggaatgcaaatggtcagtacctggtgctacctgacttttagcaacaaggaagtgggccaaagtacagcctgattaatacttagttatgactacatatcagtccagaaccctacatgcaattcttgtcaatcctgtgggggtggtttcatatatatatgtgtgtgtgtatatatatgtgtatatatatatttatatatataatcctttaatatgttgttggattaaatttactaatattttgtaaataatttttgagtatgagggatattagcatattatataatttatgagggatattggcatattattttatttatttaattttgtaatatatttgtctagtttgtggttattatggccacataaaacaaattgagtagccaggtgcagtggctcacgtgtgtaatcctagccctttggaagaccgaggtgagcccaggagttttagactcctgcttgagcccaggagttttagaccagcctgggcaacatggcaagacctagtctctacaaaaaaatttaaaaaattagccaggcctggtggtgcacgtctgtggtcccagcttctcaggaggttgaggcaggatgatggcttgagcccaggaggtcaaggctccagtgagctgtgttcacactactgcaccctaccttgggcaagataatgagattctgtttcaagaaaagaaaaaacagctgggtgcggtggctcatgcctgtaatcccagcactttggaaggccgaggcaggtggatcacctgaggtcaggagttcaagaccagcctggccaacatggtgaaaccccatttctattaaaaatacaaaaaaattagccggtcgtggtggcaggcacctgtaatcccagctacttgggaggctgagtcaggagaatcgcttgaacccgggaggcagaggttgcggtgagcctagattgcgccattgcactccagcctgggcaacaagagcaaaactccatctaaaaaaaacaaaacaaaaaagaaagaaagaacaaaaaacaaattggggttgagctcagtggctcactcttgtaatcccagcactttgggaggtcaagacaggaggatcacttgagcttaggagtttgagaccagtctgggcaacagacggagaccccatctctaaaaatgaggagttgttcttttctcctctttttttgaaagagtttatatatgattgatgttatttatttcctgaatatttaaaaattttcagcactgaaactggggtttcttcatggaaatatttttttcttttttgagacagggttttgttttgttttgtttgttttgagacagagtttcactcttgtcactcaggctggagggcaatggcacaatctcagctcactacaacctctacctcccaggctcaatctattctactgccttagccccccaagtagctaagtaccaaggaccacaggtacccactgccacgcccggttaatttttgtattttctgtagagatggggtgtcaccatgttgcccaggctggtcttgaacccctgggctcaagccattgacccactttggccacccaaagtgctgggattacaggcgtgagcctctgtgcctggcctctttatttatttttaataatgtcaatactcttaaaatataaaagctgccctctccctctccctctccctctccctctccctcctctccctctccccacggtctccctctccctctctttccacggtctccctctgatgccgagctgaagctggactgtactgctgccatcttggctcactgcaacctccctgcctgattctcctgcctcagcctgccgagtgcctgcaattgcaggcgcgtgccgccacgcctgactggttttcgtatttttttggtggagacggggtttcgctgtgttggccgggctggcctccagctcctaaccgctagtgatccgccagcctcggcctccggaggtgccaggattgcagacggtgtctggttcactcagtgctcaatggtgcccaggctggagtgcagtggcgtgatctcggctcgctacaacctccacctcccagccgcctgccttggcctcccaaagtgcccagagtgcagcctctgcccggccgccaccccatctaggaagtgaggagcgtctctgcctggccgcccatcgtctgggatgttaggagcccctctgcctggctgcccagtctggaaagtgaggagcgtctctgctcggctgccatcccatctaggaagtgaggagcgcctcttcccggccgccatcccatctaggaagtgaggagcgtctctgcccggccggccatcgtctgagatgtggggagtgcctttgccccgccgccccgtctgggatgtgaggagcgcctctgcccagccgccccatctgagaagggaggagaccctccgcctggcaaccgccccatctgagaagtgaggagaccctccacccggcagccgccccgtctgagaagtgaggagcccctctgcccggcagccaccccgtctgggaagtgaggagcgtctctgcccggcagctgccccgtccgggagggaggtgggggtcagcccccgcccggccagccgccccgtccgggagggaggtgggggrgtcagccccccgcccggccagccgcctcgtccgggaggttaggggcgcctctgcccggccgcccctactgggaagtgaggagcccctctgcccggccaccaccccatctgggaggtgtgcccaacagctcattgagaacgggccatgatgacaatggtggttttgtggaatagaaagctgggaaaggtggggaaaagattgagaaatcagatggttgccgtgtctgtgtggaaagaagtagacatgggagacttttcattttgttctgtactaagaaaaattcttctgccttgggatcctgttgatctgtgaccttacccccgaaccctgtgctctctgaaacatgtgctgtgtccactcagggttaaatggattaagggcagtgcaagatgtgttttgttaaacagatgcttgaaggcagcatgctcattaagagtcatcaccactccctaatctcaagtacccagggacacaaacactgtggaaggcctcagggtcctctgcctaggaaaaccagagacctttgttcacttgtttatctgctgaccttccctccgctattgtcctatgaccctgccaaatccctctctgtgagaaacacccaagaatgatyaataaaaataaaaattaaaaaaatatatatataaaagctgaatttagatagaagttatgctatcacatgaaatgacaggagctagggttctttttttttttttttgaaacagggtctcgctctgccacccagcctgcagtgcagtggcacaatcacagcttattgcagcctaaacttcccaggctcaagtgatcctcccaccttatccaccttaccctcccaagtagctggaactacacaggcaccaccatacccagctaatttttcttctttctttcttttttttcttttcttttcttttttttttttttttgagacacagggtctccttatgttgtgtggcctggtctcaaacctctgggttcaagcactcctcccacctcagcctcccatcgtgctggaattacaggcatgagtcatcacactcggcctagggttcttatttttgggtaaaatgccttcacagcacttcctattatcagttttaaagatcagactcttcctccatgcctcgccgctcttcggttctactctgtccactgccatggcccaagctgacatcgtgctratcggattggcagtcatgggccagaacttaattctgaccrtgaaagaccatggctttgtggtctgtgcttttaataggactgtctccgaagtggatgatttcttggccaatgaggcaaagggaaccaaagtggtgggtgcccagtccctgaaagagatggtctccaagctgaagaagccccagcggatcatcctcctggtgaaggctgggcaagctgtggattatttcatcaaaaaactgataccattgttggacattggtgacatcatcattgatggaggaaattctgaatatagggacaccacaagacggtgccaagacctcaaggccaagggaattttatttgtggggagcggagtcagtgrtggagaggaaggggcctggtatggctcattgctcacgccaggagggaacaaagaagcatggccccacatcaagaccatcttccaaggtgttgctgcaaaagtaggaaccctrctgtgactgagtgggagatgagggagcaggccrctttgtgaagatggygcacaacaggatagagtrtggggacatgcagctgatctgtgaggcataccacctgatgaaagacgtgctgggcatggcacaggacaagatggcccaggcctttgaggattggaataagacagagctagactcattcctgattgaaatcasagccaatattctcaagttccaaggtgctgatggcaaacacttgctgccaaagatcagggacagtgcagggcagaagggcatggggaagtggaccaccatctctgccctggagtacggcataccygtcaccctcattggagaagccgtctttgcttggtgcctgtcatctctgaaggatgggagaattcaagctagcaaaaagctgaagggtccccaaaagttccagtttgatggtgataagaaatcattcctggaggatattcagaatgtccctstatgcttccaagatcatctcttatgctcaaggctttatgctgctaaggcagggagccaccgagtttggctggaccctcaattatggtgayattgccctgatgtggagagggggctgcattattagaagtgtattcctaggaaagataaaggatgcrtttgatcgaaacccagaacctcagaacctcctactggacgacttcttaagtcagctgttgaaaaccgctaggactcttggtggtgggcagtcagcactggggtccaggctggcattcccatgccctgttttgtcactgccctctccttctatgacaagtacagacacgagatgcttccagccaacctcatccaggctcagcgggattcctytggggctcacacctatgaactcttggccaaaccagggcagtttatccacaccaactggacaggccacggtggcagtgtatcatcctcgtcatacaatgcctgatgatgatgatgctgctcctgtcaccctccacgattccacagaccaggacattccatgagcctcatggcactgccagctggccctttttttttttgagacggagtctcactctgtcgcccaggctggagtacagtggcgcgatcttggctcactgcaagctccgcctcccgggttcatgccattctcctgcctcagcctcccgagtagctgggagtacaggcgcccgccaccacacccagctaattttttgtatttttagtagagacggggtttcaccatgttagccaggatggtctcgatctcctgacatcatgatcctcccgcctcggtctcccaaagttctgggattacaggcatgagccacccctggcccagatctttttaaaaagtgttgtaagagactccagaggaaggcacacagtttatttgtaaagtagctctgtaagagctgctgtgccctctgcccttgcctcttgggactgaccaggagctgttcatgtgtgtgagagtgggaaccacctccttgcagcagtggcttccgcatgccccatgtgctggtgtggttcccatcacgcagacgggaagggtctttgtgcactctgatcaattggaacctctgtatcatgcggctgaattccctttttcctttactcaataaaagctacatcagactgataataaagaaagaaagaaagatcaacagtgattctccctgggtagccaattgaggtagtttggataatttagttctttctttatccacttttattgctgatcctctagtttcaaaaataagtaaatttaaaaataaaacaaaaaaggccaggtgtggtggctcacacctgtartcccagcactttgggagaccaaggtgggcggatcacttgaggtcaggagtttcagaccagcctggccaacatggtgaaaccctgtctctactaaaaaacacaaaaattagcctggacgtggtggctcacgcctgtaatcccggcactttgggaggccaacatggacagaacacaaggtcaggagttcgagaccagcctggccaatatggtgaaaccccatgtctactaaaaatacaaaaattagctggacgtgtggcgggcacctgtagtcccagctacttgggaggctgaggcaggagaatcacttgaacctgggatgcggaggttgcaagtgagccgagattgcaccactgcactccaggctgggcaacagattgagtctccgtctcaaaaaaataaggccaggcgtggtggttcacacctgtaatcccagcactttaggaggccaaggcggggggatcacccgagattgggagtttgagaccagcctgaccaacatggagaaaccccatctactgaaaatacaaaattagccaggagtggtggcacatgcctgtaatcccagctacttgggaggctgaggcaggagaattgcttgaacccaggaggcagaggttgcagtgagctgagattgcacgattgcactccagcctgggcaacaagagcaaaactctgtctcaaaaaaaaaaaaaaaaattaaccaggcatggtggcacatgcctgtaatcccagcttactctcaggaggctgaggcaggagaattgcttgaacccaggaggcagaggttgcagtgagctgagatggcaccactgcactgcagcctgggggacagcgagacttccactcaaaaacaaacaaacaaacaaacaaacaaaaaaccaatttagtcatagttattggacagttcaggccaaaacaggtcatttggcttgaattacatggtttccttttcccagtttaattattctaccttgcctgggtgtggatcctatcttaaagttgctggcacggaaaagcaaatgagaggtaaaatgactcaattcactaagataaattcaccttggactttaactcactgtattagtccgttctcacgctgctaataaagacataccctagactgggtaatctataaaggaaagaagtttaattgactcacagttccacagggctggggaggcctcaggaaacttaaaatcgtggtggaaggggaagcaaacatttccttctgtacatggcagcagaaaggagaagaagaagaaggaagccacttataaaaccatcagatctcacgagaactgactatcatgagaacaggatgggggaaaccatccccatgggtcatttatctccaccttgtccctcccacacatgtggcaatgatgcaaactctaattcaagatgatatttgggttggaacacatccaaaccatatcaatcactttccatttaaaactatgtttataaagacaccaaagggaacaaaagtattaataatatatgtaacccaaaataagctctgggtatttatttacttttgcttgaagattatggtttacctgtgtaagcaatgctctagagataatcagactatcagaagacggaatccctatgccagtcttcctcattcattccctgggcaagtcccttaatctacatatatctaaattctctatttttttaaaaaaagatgatacatatctaaatattatatttacttttgtctattaattaaaattctgaaaacagaggcagacgtggcggccgcggctccgttggctctggtagctcccacctccccagcgctggcagcatacccacgccagcccggaggagcagaggatattgcaaaggatacagatgaagagatgcatagaccaggtatgggaggagtgcagagcttccatgccatacctaggcgccacccttcaagaaccttcatgtgttcagccatccagaagcttcctgaacctgtccttttatgtttgtctggaggattcattatggagacacgattgactaaatgattggccattggtgataaacttaacctttagtcccctcccgggactgatcctgcctttgcctttctggtgaccaaccccatcctgaagctgcctaggggctgccagccctcagtcaatcattcacaggcaaaaggcatcactgtggagattccaaggattttagtcttcatttctgtgtcgggcacagtgctaagtgctaggtgttcaatggtgatgaagcagatggaggttaccaaacttgtggaccagagcctcatgtaacaaacgtggacctcactgtagcctagtcatggcttccagctttttggatctgagcctccaaaggaggaaatgaccgttcagggttcttgctccagcttgattatggaaactgaaccttcactgggtgtgcacttaccaaggacaggaaagtttctctctttgaagggctttaaatttgtaacaaagaaaagtgatgactttatctatcagatagcagatgaaaaacattgtgaaaaattactcagaggcagaaatcaaagtccaggaggccacctccaatgacccatggggcccatccagctctctgatgaccgagattgcagacctgacctacaacatggtggccttctcggggatcatgagcatgatgtggaagcggctcaatgaccatagcaagaactggcagcatgtgtacaaggagctgctgctgctggactaccccatcaagacaggctccgagtgcatggcccagcagtgccgtgagatcatctttgccatccagaccctgaaggacttccagtacattgaccaagatggcaaggaccagggcatcaacgtgcatgagaagtcaaagcaactggtggccctcctcaaagatgaggaatgactgaaagctgagggggcccaggctctcaaaaccaaagagcacatggcccaggttgccactggcatgggcagcaaccagatcaccttgggcgaggctccagccagcccaacctctccaccagccactcggagcaggagtatggtaaggccaggtgtccccgggctcctaccatggctgtgagtaatggaagtgcttctcaccctttgccagagcagcagcaatgggtgacaggtgggatgggtgtccccaggcttagggagcggtggctcccgcagagcttgaatctatcctcggtactgagcctttggcagcccaggcaaattgtccttggtctggattgagtttggttataaagggacttttagccccttggctgctctggttcaggggtctctaaggccctttgctgctctgtgggtctcattctgtacatctgggcagaaggtgggcagaggcaggtcttgtctgcttcctcctcagagcgggtctggcagcaaagggttgtcctgctgcatatccaatgcggagttgactctggtagccaggaggaaacaaatgctttttcttgataatcttgtttcttttttttctgagacagagtctcaccctgttgcccaggctggagtgcaatggcacaatctcggctcactgcaaactctccctcccgggtttaaatgattctcctgcctcagccatccgagtagctgggattacaggcacccaccaccacgcccagctcttcttcgtatttttagtaaagacagggtttcaccatgttggctagggtggtcttgaactcctgacctcgtgatccacctgccttggcctcccaaagtgctgggattatagatgtgagccactgcacctggctgataatcttgtttgtttaatctcatattaaatgtctttccactgactgaaaaaagtaataaataaaaataaaataaaatactgaaaacagtaagaagcatactttctataaaggtctaaggttctaaaattctttttctgttcttcaaactctgtggtaagttaagaaaactggtgaggtgtggtggcttacacctgtaatcctagcactttgggaggccgaggcaggtggatcacctgaggcctggagttcgagaccagcctggccaacgtggtgaaacctcgtttctactaaaaatacaaaaattagctgggtgtggtggcatgcgcctataatcccagctacttgggaggctgaggcaggagaattgcttaacccaggaagcagagggtgcagtggagattgcaccattgcactccagcctgggcaacagggcaaaaactctgtctcaaaaaaaaaaagaagacttttgcttaattcttagaactccaagtagacatccttgaataatgatagctaccatttacagagtgtttacctaaatccaaccaatatcaaagtgttctacatgtattgattcattgaaacttcacaacaattctcagaggtaggtcttattattcacaaccgaggaaacaaaggcacaaaattaattgacttccctcagaaatcccctgtagtaagtggcagacttagaatttaaacagtatggcttgactccctactgttacttttttttttttagatagggtctcaccctgtctcccaggctggagtaccgtggcataattttagctcactgcagcctcgacattctgggctcacatgatgctcccacctcagccttccaagtagctgggaatacaggcacacaccaccacacccagctattgtattttttagtagagacagggttttgccatgttgcccaggctggtctcaaactcagggactcaagcaacctgcccacctcagcctttcagagtattgggattacaagtgtgagccacagcacctggccaactccatactcttatccattatatactatatcccttccgttgccacaatgcttcataatgtcataactggtattttggctgtatcctcaataaatacttgttaagtgggtctgaatataattcttaatatgtatttgagaaataatagagttgggattttcagagaaagaccttaagttgtaagactgttaatttgtggccattaatatatattcattgtgatatataatgagaatgctgtttctttggatatagttgaagagagctggccagcttttgcatgccctgataatctgaccttctcttgtccaaaaatacacaccttctttagcacattcctttatgtatgattttaaactccctctccattttcccactcttctatatgaatatttttgggccgggcgcagaggctcacgcctg

SEQ ID NO: 17674 - DNA, 12704 bp, Homo sapiens
attgatggcattcttctcacaacctgtgatatcgtgatatattaggaaatacatatttggtctttgacaccagttcctgacacggagctcctaactcccttgacatttctagatgataggcacatcttttgttctaatgaggtggctcttggtggtggctggataggctcaggatgggggctgtcatcagaatgaccagaccatgatacaaagcttggaactttcaccccacatcctccaggaagggaagaggggctggagattgaatttattatccatcatgcctatatgatgaagtctccatcaaaatccctaaaagacaggattgggagagcttccgagttggtgaacgcagggaggtgctgagctggtggtgcccccagagacagcaccgaagctccaggcccctgccccacgtgtgggtctgtgcctctcttccacctggctgtggctgagtggtgtcttttattataagtcagtaatgtaagtaaatgtttccctgatgctgtgagccatcctagcaaattactgaacccgtggagggggttgtgggaaccctgccttacagctggttggtcagaagtgcaggccacttgagacttgcgatgggttctgaagtggcggcagtcttgtgggactgagctcttatcctgtgctgcctccgggcagataatgtcagaactgaacggaattgtaagacaatttctgaggaaataaacccacacatttaatcacagtggcatcgaaaggattgagtgggaaactgttttccctacacagagccctcaacccctatgacccactcaatcgtccttaatccttcctctctctcctctccagtgaccttggccccttctttctagagtcaggctttctgtctgtcccaatgtcctttgtccttacccagcctcttccttgctgctctaaacaccaggacgctctggttccccacaagcccccttgcaccaaccactcaagcacctctagcaaatcttcctcctccaggaagcctttccagacagctgactctccccggcaacccctcccaaataaactcagaactctgtcctccgggtgtctactcaaccacactggttccaaggtcccagtgtaaatactgtgaatgtctgttgacgtctcctgagtcctcgcataccctacttgagcgaggggctaggactgtgcccacattggtggtctacagccagcagggctccagacaggacacccaccatgaatagcatcaggacaatgctgatgacgacaacgaagctgatgagcttgcaccagcatttacagagcatttccctgtttacattgcattcattcaacaaatttatgagtgcttagtctgggccagcaaccagggaataataatagcttcagtttttggaggcttactatgaatgccaagcaatgttctaagcactttccatgaaataattcatgtaatccacacctattttagatgcaggcactggtactatcccaattttataaaaattggaggaatagagcagtgaggtgacttgtccagagtcacacagaggtggcttgtccagagtcacacagctggtgatgggtggagttgggatttgaaccccggcacctcactgcattatctctctttatagggggatatagtggtgaaggacagatggtgcctgccctcaggggtctcccaggtggtgggaagtgtgcccaagatggggacaggaggtgtgggaggcttcgtgggggagatgatgacctgaggccatggctgtgtccacgcactccaggtagcctcagttgcatccctctcatatacgctctcaagtatagatctcatcttggcttttgagccaggatgcctggacatggtcaaaggtggggggcagttggcaaaatctggaagcaggaagcgagggggctgaggcaccagaccagaggcacaacggaggcctcagccaggtctggggagatggaggaaaagggatggattccagagagggccttaaagggggtggggagggaggggcagaggaggtggccctcggagtctcatgttggtacctccagatctgcaggatctcagccaatgaccccaactccttagaaaacggacaaaaagaccttgatgatctcatttgttcccaagcctccacttctcccaaagtaaagatctgtcagcttccttgtatttttgctttttgtaattgatttaaaacacttcagggtctatgtgtcatggtgtggataagctcgtgcctaggaaacctcctccagctcctcctgagctgcttgagggacaaactcatgcctctttcacctttgagacccctggcataatgtagagtcctgatagacactttttaaaataaatacccccggcatttcctctgacttgcccaggaccacacaactctcaggggaggggtgggggctgggacctggtacttgggctcctgttgctctgccctatgcccttggggacttctggacaagggtgcgcttccctgggctgacagaggagacagaggtagtggggtgctggtaaatggttaacaacgggctttctggaaaaaaatgccctaaccgtagcatttgcaaatttctatggtataaatactctcgcagtgaccagtttcaagtccaatgtcacaatggctcactgcaattggctctagggttggtcggccagaaaggtccctggaccacctccctctcctgctccacaaagggcaggagctcttccaactccttccaactcctactcatccttcagaacctgcttgatgtcaccttctctaggagaccctcccaggcaccgtagagacaccccagccccagtgctcctatatggctgtcagcacactttatggaaacagcacacttaactttctgtcttccctccactgtgtccccacctcttagcactgggcctggcctacgacaggggctcaggaaatatttgttgaaaggacaagtaatgatgctgatgctgatagtgacagcaaatgcctatatcatctgcaatgtgccagttctagtctcttttttttttttgctacagttagggcatttttttccagagagccagttgttaaccatttaccagcacaccattgcctctgtctcctctgtcagcccagagaagcccacccttgtccagaagtccccaagggcatagggcagagcagcaggagccaagtgccaggtcccggtccccacccctcccctgtgagctgtgcagccctgggcaagtcagaggaaacaccggggatatttatttttctcataagagaaaaccccatttctcttaaggggtttttggttcttgttttttgaggcagagtctcgctctgtcacctaggctggagtgcaatggcgcaatcttggctcactgcatcttccgcctcctgggttcaagcgattctcctgcctcagccttctgagtagctgggattacagcagcatgctaccacgccctgctaatttttgtatttttagtagagacagggtcttgccatgttggtcaggctggtcttgaactcctaggctcaagtgatccctgccttggcctcccaaagcgctgtgattataggcgtgagccaccgtgcccggccgtgccagctctgttcaaagcacttcacagatattaactcatttaatccccacaacactctagatgggtttttatttgttttggttcgtttgtttgttttttttgaaatggggtctcgctctgtcacccagactggagtgcagtggcgtgatcttggctcactgcaacctccgtcccctgggttcaagcaattatcctgcctcagccttcctagtagctgggattacaggcatgagctaccacacctggctaatattttgtatttttagtagagatggggtttcaccatgttggccaggctggtctcgaactcttgacctcaagtgatctgcctgccctggactcccaaagtgctgggattacaggcatgagccaccatgcccagctctagatgggtttttatgtccttattttgcagatggggaaacccagcctcagcgagtcagtggcagagcagggcctgggatgcagctcagaaagctctcatgtccttgggcttcccttgtcctgtaagatgggtggggccagtagcattgccctcactttaaaaaagcaaaacaggctcaaattccagcgaggggcttatggaagtttaggtgaagagccttggctaaggtcatcccactatgaagtggatggggatgtggtagaattagcacttaggggtctcaagtgcaaaagcgctttgtaaaccatcaaggaccacagacatgctagagccaaagaagttggaaaaatctcaccatttagatatttttagtccaagcttaacaagtaaggaaactaaacctctgagagggaggtgacctgtccaaagtcatgcacgagcatctcaaccctgcccctctgcactttccacaatcccagagtggcactcattccttagtggcagcgggcactgcactcgacagctcatgccatggtgggtttgcacgacagtcctttccctgagcctcacgattgtcctggaggaacttgttatgcccatttacaggtgaaggaactgaggctcagcaaagggaagtgatttatcccatctcacaggctcgtaagtggggacctgggtgactctgcatacaaaaccaccagagagatgaaaagaaccgagaaagagccgggttgattgtggtcaaaagcgtaaggcagacctggttggaggagcctggagcctggggctcagaagggacttagggatcgctgcctgatttttggtcatccagcagttatagggccgcctccttagagcctgggggcttcctggatgcatagcctgtccctgcctcggggctcccaagacaggtgctctggctggcgctactgggagagtgaggaggtgacaacaaggtctgggatagacccccagccccccacttcacctctctgaacttgggcttcctcatctgcaagatgggggacccagttgttatggcagtgaaatgaggtagtgccaccagacgcctagcccaggggctggcatggagccagcgtccatctgggacagctgccctcagtgttgctattgctatggttatttttattattagactcaacaatatgcctttgagcaggtggctttcactctttgggcctcagtttccccatctctagggcaaaggaggatgataagatagattattttgtaaaatccttccagctgtgaccgtctgcggtgactagctttcttaaatctgttcattctggtgccaggtgggcctcaccattgtagtgacttcctctgaatacatactgcagtgtcagtgtttgcacatgcatgcacagagacacacatatgctgtcctttttcttcacactatctcgattgtcacacaccatcagtcccttgagcacagaacagggtgtttgcttatctgaatctctggtcctggggaagcgcagctatcactgaatgtttgctgagctgagttagttgcctttggtagtagttagttccctgtcactaaaggtattcaagtaaagtctaggcaatgtttctggtgaatttggaccaggattacttaaattctatagatttaagccctagggctatgtatagctaccccactcaatgccacagcccctcactccttgggctttctggttcaagacacacattttacatttgtaggatgtgccgattgtatatcagatgtgtgggcctaattttcccataatcctccaaacagtgctgtaggatctcctcctcctcctcctccttcttcttctcctacttcctcctcctcctcctcctcctccttcctcctcctcctcctccttcctcctcctcctccttcctcctcctccttcctcttcctcctccttcctcctccttcctcctcctcctccttcttcttcctcttctcctccttctttcttcctcttctctcttctttttcttttgttgaaacaggatcttgctctgttgcccaggctggagtgcagtggtacaattataactcaccatagcctctacccaccgggttcaagcgatcctcccacctcatcctcccaagcagctgggaccacagctcctgccaccacagctcactaatttttaaatttttttttaaagatgggatcttgcccaggcttgtctcgaactcctggcctcaagtgaccctcctaccttggtctaccaaaatgcttcatttacaggcatgagctaccatgcctggcctacttcttgcggggargtgsgaggtacagaagagttctgttccctgttatataaaggcccaccctccaggaactgtgatttgtagctcagttggtaggaggggtcttgcaacctggcccgaggcagtgactaaggyacaggctatatgtggggccctggggtttgtcatctctgctgctaacaaaggtggaaaattcctacttcctgagctgagattgaggattctgacatgcatgagcttgcctactttccttggtatttcatttttggagccagaaacaaaatcctcccagatgctctgcttggcycctgtgagtctgacctgcaggcctrtgtctggcagagggcacgcaacagtggctcacctcccactcrcactgcgcaggggctgacacagggagaacgggagtcatagctctgtgtctgcgcttactgcagtgcccttaacctctctgagtctcagtttccttatctgtaagatgggatagattattgctactcagtttccttatctgtaagaagggattgattattagtagatgccgaatcaatgttagggatgactattaataagaaattgcatctgatgagatgccagctcctctgtctccaaggacctgccttttcttcctgtttctgattcctgcagaaactcctgtagccaagacaacataaaaataatctagtttgcaagtatttaatgagccacttacagactgtgagaggaaagcagatggcagcttccaatgtcttctctgaatagggtcagacaggaggagagggtttagtggctcccaaacctgtctctagatcatttaatatttggataattcagtgaagaaaacccagaaccttcaaccccctccctttttttttttgtttggcatttttgaaaataatcaaaaggacaggaaaagctttatgcacagagatgttcctcatcatgcagaagaagggtcacaggaaacaacctaaatgtttaggaccaggcagttggttaaatacatgatcttatatccattcaacaaatgtcaagcagacatgaaaaaaggatgcttctaagagttcaccaaaaatgagagaatgtttctgataacatgttaggggaacaaaaagctgggtaaccaaattgtacatacaacaaagttcaaaagttgagaaggcaaaataccaaattattactggcgctggttgtctttgagcatgggatcataggttgcttttgggttttctttactgtttgtcatggtatccaagttttctgtgaagaacatatattcctttggcaataaaaatatttaaataagccaagtgtttggaatgaattatgggtttatttacgtaaaaaagataatcagccaatttgtgcttaaaggaactctcttaggtctacagctgcccccctggcagctctgatgcattcgctgctgcagaaaagcctgaacccagcctgatttttcttgctttatggattgcctgtccccgcccccaccaactccccaacctccagtcaatctggatgcttatagtattttctttttctcttttccattcaaaagtgctgtcagatgtatttaggggacactgtctcgtctcaccccttttcataacctgtgagccgggcaaggcaccattgcataggtgagggcttggaggctggagagatgagggactgggactcaaaccacatttcgggatttggggacatctcctggctgtgccctgaggccaccccgactctggcatgtgaggcaaacctgctgtacaacgaaggggtctggacaagggagtctcaccaggggtgttcaaatcccagctctgccggtcactaagggagggactgtaagtgtgtggcctcctgtcagagcccaggtccccgcttgtgggataaggagcattgtccccggcaggagggctgttgtgaggatccagtgtggtcatccctggcactcaggaatccttcctgttggttcccgtcctctctcaggaatgacagtcgcctcctctttcccccaaatccacagattgttctgtcaagtgatgggcctgggtgccctcacctccaccccctcagccacagacaccacagtccaaacagactcccggaagatacggcccagaccacttgcagggaaagtccctgcggctgtactcatcctcatggaaaacatgaggactggcggggactggagggcagggagtgaggggacatgcagggtgcccccgtcacagggcagagggctctgactggggcttttggatcaccgcccaccatggggaggcccaggcaagggactcatgctcctacccatctctccagccccagctcctccttcccctcctgtcccctccctgccccactggtctcccctggccctgcctgagcatctttgggagttcccacctctcgacctttgcttatgtagggaggcaggatgcgatgggaagacccaggccaggctccagggccagcccagtctctagctagctctgtctcccctctagggaccatttcctcaactgtcaagtggagacacaatgcctacttggcaggtttgtcgggggggatacttgtgattgttttggggggccaagggtgccctggggctcaggcatatgtcaatggcactgggcagtctcccctaccctttctctccactgtgcaccctcccttacttagggagaccctctactttacctaggtctaggtcctccaacttgaaacctgcccacaatgacacatcaaacattgtaggtgtgtcataagctggtgtgaggacatgcaggcagcaaagaagcaacttgtgtgtgtacacatgtgtgtgtgtgtgtgtgtgtgtgtgtttgggtcggtccagacagaggcccaggaagaagaagagtggagatcctgccacatggctcctgatgctggaggcttagggacaaaccatcagtgtgactgtcccagtgtcctctggggatgggacttggggttacagattcagagagctgtgttagaaccacttgggtctctgcctgtctctcccaccaggctctcagctccttgtggggaaagatctctgagctgaggggagccctgagcagtctctcagtaagtggttaggggaggaaggaataaaccagcttcctgagtctaggcacagtctgggtactttcatacacagtcctattgtgttggcacagcagtagtctttatcacacaggtgagaaaggagaggttcggagaggtcagtgacctgtcctgggttactcagcaagtaattggcctagtaacctaacccaggactgttgaacaatcgggccagttggtgccaatttctaaatattgactattaaaaaaatactggtggcgaaatagctagcacatctgtgagcctgtttgggttgtgggctcagaccgaactcctataaagcatatgaagcagagatggtagaatcccaggcaggggccatggaatgggggagggggcattaactcctgctatcctacctttctataggtgaggcgcctgctgttcagagacacaggagcatcagcaaaacccatcaaagaactgggggccagggtagaaaggagacctttctgggggtgctgatggaaactcctacccaggcaaatcttgcttcccaggcattcccccagtgaagactgcactgctgtgcccaactttggctgcaggctactctttaccacccaagcgagccgccacccactgatctctgccatcaacttattctaattctctgcatagcacatagcacttcctgggattgcccttctcctgtctgctcttcaaagagccatccttagatggcctactgacattaatgctttttacctttctaacttgtcattttgtttttgtaattcttttctttcttctacttttttggatcattattatctagtttattgaattgaacagttttttttgcaatctttttggtttaataatttaaaaatttaaaggcatgactcatcccctgactatggctttggctgcatcccataagtttggtaagcagtgttcttatagttagttgtttctcaaatatctataatttcagttttgatgatctgtctctttgatgtaacagtgttttctaaaattttcaagtagtttatttctattcaagtttgttttgctttttatatttaaatttttgcaaagagatatgcatcctcatggtaacatttcagagtgggaaaaagaatacagtgaggggtaggtctccctccagattctgtccctgcctgttgcctcaagagacagccaggctcactggtgtctcctgttgctttccagacatcttctgagctttcaggagcagatgtgcacatatccatgtataaggacgcctgcagaagcaccctaaatgcaccgccggctgtgtcctcacctctttgcatttaacaatctgtcgacccaccttgcttttcaatagcctcacagtatttcagagtaggactgccctgtaatgcaccggccttcgcagggagttcccagttttcgtaggtagtttgcaattctactactatttatagctgaaggaaccgaaggatcccagagaccacatcccttgccctaggtcacacagcaggggaggaatggggtgggattcaatccctgtgcctggcttccgaaaaaggaggagcgggaggaggagggagaagggaagtgggtggagagaggaatcatcttcacagagtccatctccccaatgtgctacagttcatttgaggagtccccccaggttttcactacttttggctatcacaaatgatcagcacagatccctcatctgcaggccctggcccacgtgtgagcacacctgtagcaggtgtgcagaccctctcctgcctcccctgacctgttcttgtgttctagccattgctttctggatctttctgttcaaagaagaccaagaggtccttctctcacctctcactttgctaaccggccagtgggctccagagtgggggtgatgtaccccaggtgcagcagcgcatgcacaaggtgcaatctccgaggctccgggagaaccccagagagcctccctctgtggtcagggagtgacccctgcactcttagagcacagcaggtgccaagcatgagtgggtgctaggggctgagggaaaggcccagtcttttccctcgagaggattcctgtttggtagggatggcggggcacagcctgatgcttcccgaaatgtttgggcccaaatctaccttgaaaggagctggctgtgagctgtgtgcatttaacaatctgtccatttaaatttttgtggagatgggcagtttgctaataacttggatcggggagggtttctgtcctttcctgaggcagcaggcacatgagcacaggtgccagagagtgaagaacaggtttggggtccccaagttttttggctggtgggactaggaggaagggcctgaggagagtggcttttgggtccaggacagaccatttgctaaggtagcttgtttcaaagtgtggctgaaatcccctgagatattagcaagtccttgagtactgtaaaggaaaacagaaatcttgggacccccaaactctttatgccaaagggaaagttaagcctggagactgagtcagccaacattgtcatccttattcctaatgacagctgttactccacaaccttagacattagccagacccccacagaaaggaaaaggcctcggatatctccccatgactgcccccacaaattgttctttgctgggtgaaacctttcaagatgtggatcttaccacaaaacaaggacacatcaattgtaacttgaggtctgcaatccaagcctagctcctcacactcaagtctgttagagtcacgctgatggtgctgatctccccaggtacagcacaaaagcaagacaaaggcaagatgagatcaggcctccttctgcctaacctcctcttcctacatgctttctccacttcaaggacatgtgtaaatactgtgaaagaaaaataaaattaaaatccccagaccccaaacgcactaagccaaagggaaaagtctagctgggagctgggtcatgcaacccgcctcccgttttgtgtctaaatggataactatttacttccctcacattttgctcacagtgaaattccttgtgggccccaggatctttgccttcaagcagctctgttgtatttcaccctcatgatataaattaacagcttagcttcacaggtatggaacaaaggatagaacccaaagtcatccctctgctcacctgagacgagtgcatagctgacagcttcctatatgctatgatgatgatgatgattattattattattattattattattattttgagatagagtcttgctctgtcacccagcctggagtgcagtggtgtgatctcagctccctgcaacctctgcctcc

SEQ ID NO: 17675 - DNA, 13449 bp, Homo sapiens
attcaagtttaaagtcccccaacaactttaaaaataggggagtgtttggcaaagcattccaaataaatgaccctcagctctggaatttgctccttctagcaggctgctctccttagtagtcagccaaaccccaaatctggcagcttttaaaatagggtgcaaaaaagattctttttaaacctgagagtcactaaagatttattttactggaaagacatgatcgcaaaaataacaagcaattattgttactgcaccaagtagaatcagatatctgcaagagagattatgaagtcaagagccacccttctttgctcattctgcagatgaagaaaccaactctcaaaaagatgaaattatttcctcaagtcacacaacctagtggcagggcctggtgtcatgagtcatgggccagttcttacaccatatcctctgagaatgacatggatgatttcttccttgtatcatacttggttattcacaaatgcaatgttcttgcaaatgttaatattataatctttggtaactgtagcaaataatcgttgaattattttgtaatttttggtgtgcaacatcctttgcaaagtcctaaatttcatacaaatgtgaaagctggttgcgctactttattgatcctcacaattaaaatttctaattcatccagaagaacatatgtgaatctgtatgaaatacatatctaagaattttaaatttacaatgaaccattataaaaaggccttgaccttctccacatttcctacctacttgcccgtttcccattatattttactctgacctagggaaagtacaggatcagagataaaggtgaaaatgattcccagaaagacaggaaaaatttgaacacttattaagctctattaagttttagataaggagttaggcccagagtgagaaatttactgtggtgataacagactcattctcttgaaaacctactagtgtatttaatgaggcagatagtgaattttgcatcagtcttcgcactttcccacattccacatgctatcccattttcttccagttcaggctgagaacacactgacacacaaagggtcagagaactattcccagagttcattcctcctcataaaatagattgtggtttttttctcccttctgcagaaaatgttctttccttctaccatatccaatccatgttggccatttagtaaaatgaacaacttaagagagaagttatttttgtttgttaaaggtgttttcctgagttttacaacgaaagataaaatgttgaatataaaaatagaaaagaccccggtgggtctttctagtgtccagccccagggccttccccaggccccagctagctccttgtcacttctttattcctgacttcagtccccaggggtcagtttccctttccctgaggtggctgtgccaccaaccagttaatcctggacattctttcttccaggaatggctatggaaagggacagaatgtctcaaactcccctgtcaccatccccatctttgctgtcctaaaaacgaaagaagctaagcttccttttctggtttaaccagtcagtgcttagtcatgtaagaaatgcagaggagacaacaaaaacatggatactattatacaaaggttccacaatctttcagagtcctttcagtcatggtccctggtctgtatttgattttcattttcttatgagggtaggaggtaatggaatctccttctccatgatgtctcctctcaggtttgttgactccacagtaaatatttaacatttagagagatcagggattacagagaccactctgtagaagaaaaatattaccaaagtgaagttgaggccaggtgcagtgactcacgcctgtaatcccacttggggaggacaagatgggcagatcacttgaggtcaggagtttgagaccaacctggccaacatggtgaaaccccgtctctactaaaaatatgacaattagctgggtgtggtggcacgcacctgtaatccccagctactggggagggtgaggcacgagaattgcttgaacccaggaggcagaggggcagtgagccaagatcaggccactgcactccagcctggggtatagagcaagactcttgtctccaaaaaaaaaaaaaaaaaaagtaaagttgagaggccttaaaagaggaatgctctcaggtcccttcacctgatctctctagaaactaatggaagatcagtgtgggcttctggaacttgccagtttaaactctgggaatacctcctcactaaagccaggctgagttagccctctgagctcccatgttcctgtgccagattgcactgctattactactgctttaccattcgttccccattgtagactgtgtttttttgcaaggaagagactgtgatctttctttacttctgatcactgggggctattagagtccctgtcacatagtaggtacttagtacatgattttcagaaaaatgaaatggttctcagaagaagaaaggcaggaagagttccctatagggaaatataaatactcctccaaggaatgaacaagacttcaaaactgagtttgagtctcagcaatgctgctcagagaaaaactgccttgccacaagatgataatttgataaataaggagggtttaaggcatttttgaatcctgcattgttccttgttcctctaccccaaatgactcaatatgaataggtgacaaaaagtaggtgacattggaatcagatatatcaaacaggaatgtggaccctgtgaaaaactcctattgtgtttgagcaagttaccaaccctctctgggctggcttaaatctgtaacatgaaggaactaggtccgatgatatataaagttccttacagctttaacctcttatgattttaagtgattcagagccatgtactgaaatgtattttaagcttcctcttcaaactcatcaaacaaaaaaaaaaaaaaaaaaaaaaagaaagaaagaaagaaaaagaaaaaaagaattataccatagtcaacaacacacttggggaggaaaaataaactataaattatggtcatcagatcaaatgagctgaaacacaagattaaaatgttttctatccacagagcaatttttcacaatggtgtcaaacaaaaagttctagtcaatgtttacactaggacttgatgaaaaattccagacataaaacttctggaacgtagacttgaactcagaaggacctcctatctctgaataaattgtacaactaaaatctattgggatttttttccttaacaaaaattcatccttcaacaattatttgagttttattactgagactattaaggcatagtaaaactctggttatctggaacagtcattctaggtatgacagctaaagattttttaaagtaccactatttttggatgaaaatcattgaaagacattacatttatttgacttctttaacagaatacactgaatgtaatttaatcttttcctcagtgtgaataccaggtactggtattgtcctcagtaacatcctcaagtcccagtgaaatactctataatactctaggctttttttcttttgacagtgtttcagaatccactcccactatcagctgtcacttttaactgctgtcaattctgtcaacttggccacttgtggtcatctcctgctgatatctaatttctagattaaaggcagggaaaactgtcttaattcatccttgcatacccaggggtagcatagttctagctacttaaggtgagtcattaaaaaaaagtttattgtaatagtgcatgacttaattgtaggtttaaaattaagcaacaaaaaaagcttgctgaaactaggtgtgaaataacaataaatgaatgctggatagtgcttgaggggattgctttaatacatagatttgccacattttctctgctttctaattctccactatgatccaggtagattagaggaccacagaattgagttcctgatttttcataagatgacaaaataatagaataaaaacattaaaaatgattgcataaactttggctgattatataaaatttagtgtcatcaaataatttatttttatttttagatacatgtttgcctactccaaactgaaagctgagaagaactggcattcttagattttttagggtgatagctgagggagcacctcatcacacccactaactgttattttggataaattatttaatcttctttaatttcattttttttgcatcagaaaatagtaatgacaaaacccttctgactgggttcttgaaagactaatgcattttaaagcacttaccataagacctgacacttaataagcacacagttacttttgttataacaggttgtccattcctggagtggggacagtggtaccaaccctgggcaaagccaggcaatatgactgccaaaacattttgctcttgtatttgctacttggcaaatactgctcttgcctcagtattgggtgttttgaaaacaaatgtggcacccaaatagaaataagctttaaattccttaaatctctgacattatagaaaacaggcacttccattgaactaacattctaaagaatggggttttaatgtaggcaattttaggaaataaagaaaggaaatttaaaagaagactgatatccaagtctccacaatttatcataaatgttatcatccttagcactgaaatctgaaaatttaagaccttcccatatcaatgtcaattattatagagttaaaatattcattgtaaaaagcaaacactgtagcctcaaatttgtatgcaactataatactacacacaaaggtgtttgtccttacagaaactcattcatttctcaatttaaattaaaacattcataatattccaatttattaatcagtgttatttatctcaacacaatataataacatgttactgaaaatagagatattaaatactgcaaaatagttattttacagattattcttggaaatttagaaataatagtgtaacatgtggatgagaatacagatggtgatatatatcacacacttcctaaaaaggactaattcttactatataaagaaaaacaatgaatgagactttatcatcgccactgaagaaggtatctccattaataaataccttctcccaatgtttttgaatggtatttttaacctaaataaatatctctttactgaacttggtcaatttttttatttctacgtgaagtttactacttgatgaccatatttagcaactcctgattgttctccttgttaaatccaagactactaatacaggttttattttctaacagcttcattagctgcatttttaacttctaaatcttttcctaaaaaggcataattgattcacaaaaatattataattgcatcctagatcctttataaatcatgttggctgtgtgtaacacttttacactaaatttctaaatcaattcaattcatgagagatacatataatacattaggaaaatcttgaagagcacttttctaaaatactgaatctcttagagtatataaactgaatcacaccacaaagtttaaatatgctgacatccattggaagaaaattattttactgagcattttaccaactttattggaattaattgttctttcttaagttgctcttcagctcttcactttagttgtgcttcactgctggagaattcatttacttaaacatgatataccagcaaaattgtgtgctggtcaaaatcaatttttgaaacaaattattttcaaatcattaagaaagatgtaaatccaactgcaaaattgatgccacagttcagactcttgtggttcctcacggaataaaaggggaagtgtatctctgatttgtctggtgagacaaatcagagatactatgttaagatggggagcacaaggccatggggtccgctagcagtaactgattggcctgaatgagatatagcttgctaattcctgcactatgggaatcctgaaaaaatcttttagtaaatttaaccaccactgcataaaacatttttttttaattaccatttttaaagttacattttgtgtcatcatctctcccaccactcaagaaatctgagatttacctttggattctacttttttccataactctaaacagcaatctgcagtcatgtccttttgatcccatctcttaatatttcctgttgacttctgttcattcctattgcaaggaacattattgytgcctttgataaggccattatcatttttctctcrtatcttcctaatatgcatttttttaaccagtcttcctgcctccagtcttgcctcctcmaatcgatccttgatgctgccaaagtggtatttgtgaaatgcagtttagcatgctgcttcagctttgtaattgtttctcctaatggtcaaacccaaactccttcttgtagcacggaggttcttaggtgattagcacacttcccctccccatcttcccacttaatttctccatatttcttcttccccttttaggtaaacttactggtccttgctctatraagtttctcctaaaagtcacccctttcaccactgtgtccttttacacactttgtacaagttacttctaacagtgatttgcttacatgtttgtcctccccacatctagcccagtgaytggttcaaaaaaggcactaaaaaaatggataaaattaaatatattactcttaatgattagtgtaatataaatatttacaccccatatctaagttctggctctaagcaaaagggttcatctctcctcaagcccttaaaatcactttagaaactcttcaacttctaattcaacatattctgacactaaacacaaatagccagtcttaacttgcttggaaaaccacatggtttaaatgtactataaccctttcccaaataagagctgctattatgaggcattaatgtacagaccgtttcatatgtatacttggttgcttaggaacamagataattccagttccagaatayatgaattgcagaattagtaacttctgttaaagataattggaggttaagasaattagtcagggaagctgaaaaaggaaactaaagttagagacagaaactaagtaaagataagaaaaatgagctttacaaagctactctagtggcatctgggagcagaaaaatccaatttgtttctaagacggtaatgaaagtgaaatccaagatcaacaatcttgtcataaaattaacaaggaatttaacatacaaatgagggaccaggagtagctgtcatttgatatgtatcgtagctatagcaaaatgaaataatgtgcaagcttctcacttattgagtttagtggcataggaaatctttgtttgcaagcacatgataggaaatggaaatttacagtacattagagaaggtacattggagttatcgatagagtttttatcacatatccaatacttaatgagtagcagttggaattagactactgtatatgctttccagagataattatgtcttctagaaaagtcaaaaataattatctgaatttttaatttgctcctatcattattgacattttcacctatgatctagtaagaattgtattcttgataacagaaaatgtaatttcttaaaaatgagttaaattttatttaataattcatagacataaaaacagaaatttatagaggttttatagacagttgagtatggccagttaacttttttgaaagaccttaatactcaaatctttttcctgactggggacccctgccagagatttaccagcacaggaagaataacctattgcctttgtttatcagattttattatgcacaggaatcatctagagatgttggtacaggtagcgcctgtctcagtaggtctacaaaagatccctgaattctagtttccaacaagctctcagggatgctgctggtttacggaccatacttttgaatagcaaggcctgaatcagtggctattagccttgacgcctattggaatcatctgggtagctttaaaaaaaacatttctagggataaaacgttatttaactagtctgggctgcaacctggacactgagggttttaagagctctcaagttgaggtgaacaggtagctaaatttaagaacctatggcctaacatgtattggttatatttattagacctcatttcagtactgcatagattatgagagtaaaaatgtccaaaaatctccaaatccttactgaaaatataataacaatcaggtttcaactttaaggatctcagtggcttcatttctatattcttattaaattatttagtaacatatttgatagtaatttaaagatactcacggaattataatgaaatgacaatctcaattacttttgaattaggagatagatgtacaaaaatataaatatgtgagttttaaagtatagggaagtgtcagttcccaataagaaataaaaaggttcagactagttaggaagtttacaagaaatccccaagtctgtcacaccaggaggaaggcccacagacacaggaaagaccggcgaaagtttagttagtatcactacttgaaataggcgtcgctgatccagcagttaaaaactgtatcatcactattagatcgttcctaattattttgctaaattgaagtttgcaaaaggtcaagaagcaattccattactgaggctccttccttaacttttaggaatgtgcaccaaaaataataaaaataatattttaaactcggaggtatttgcacaattccataattatagtaaagagtatcagagtttaagtcaatgatagtaaagagtattggagtttaagtcaactgccacatactagtcatgtgacttaaactttagaacaggcttcttcacaactaaaatagtccaataaaaatgtgcaaacccaaattaatgccacatacaaatataaaacagaattaagtataactttgacaagcaaaaaaataaataaataatatagcatgttttggcgcaaagaactaaagtccagactgggaatgacttccagctttgccactaattagccacataacaagcaaatcacatactttaatctcattttaaaaataaagatgcctcaaggagattattttgacaatccctagcagatcaaagttctaaaaagctaaaaataactgatttaagttaccctctaaatcaaatatgactaatgctaacaacaacaaaccaaaaccaagaatttccttttaacatgattggtttaacaagcctttgaagaaaaatatttaaaacttgtcttcaagtctactaattgtacggcaatcatttaaaatagtaaaactatttaaatctaaaaaaaatgtagtgtgtggaggtggggagaaaagggatcattaaatgcaatgcaagaacaccaagcagaattaaaataaagaaataatgtaaacaggataagatagcaaaagctttttctaaggaaaactgtttcaaagcatgcagtgtgaaattttgcaatctatcccaaacaatatactgcataggcatcgtctttaaatacacacattttctgtttccaagtactacagataactcataattcctataaaaaattacacaatttaatcaagatggtagtacgtggagattatttccttttagtttattgtttaaatacatgtcttgccaatcacaaaatatctagtgtagccaaagacataagaaatccctgtatgaatcaaaaagtgccattcttgcagctttctgtcacaaggatgctgagaaatgtactgtaacagtttaggaaacacaagattgtctcaattttaagtttcaatcattaatcctcttcagaactggaatcaccctcttggtcagaaagttcgggaacagggaagcggagaatggcagctaccccagtcaactggctgagctgttccccagaaacgtgaagactagagaatatcctaacggtgcctgcattctctttcacactgtccaccagcctcacataccggctccgtgtggctacatcctgatgcctgaagagctcatcgctgatgagcaatgtgtcaattgccatggcttcattggccttctccacctgcttgagtccatagaaagctcgatccggttcatgctgtaacattttatagaagtcatccaaggctttgacttccccagcagctttagtgtctgaaaggcggctagccacagtagggtcacaaagggcctctttcagggagtacttgtgtccggaggaggcatgtacctagaatcacaattacaaaagttaggcaaaataatctcctagaacacccattaatcagcccacaaaggcttaaagccaaaagcgctagtaaggcttcatatgtttcagcgaagtttactccataaatttgctagacatttaacattctctttttatttcattatctcatgaaaatcccagctaagtaaagactttctcttcttatttttcccagttctaaaactttaggagtagtttataccaatccctctgcccattcttaattatccctgggtaagattgttttacctgaagaaatttggaccggttttccaggagcagtttgttgtcggtcttcactgcttgttgaaacatgtagtcgcagaactgctccctcacaaatcctgggctggccaccaggatgcactttacaacatcaaagtgtatgtggcgctggatagcctggaccacctgttcatagaaccgctccaaggcccggtcatgctgagagcaattgcctttccttttcctagggatgttcacctccaccttggcccgagtgagggtcatgctgggagtgactaagcagatatgggcgaggccttcctgcatgaccacagccgccacatcagcgctccaggctgggtcacaggcctgctcgatgcgctccagtaccacactatcccactgcttcttggccagggtgaactggcggttgggctccagctcgatggtgtggtaagcccccatcttgacatactcattctcttggatgttggtccccttaacccgcagctggcaggcttgagagtcgaagtcgatggcctccacgcagagagtgagggtagtgcggacccggttgctgcccacgctgcccgtggaggactctgtctgtaccttgcggatggtggaggcgcgcaggctgtcgcccacctgcacgaggttgtaagtgtgccacatgtcctcaggctcctcggggaccagggtcacctggcccgcattgtccttctcgatgttcttcctcacgagcttcatggccaaggaaggggctcactgacagaaccaaaggaaccaaggaggtcctcacctccgccccgggagaggggatgggaatgcaggccaggaagggggcggggcccggtttctaagggcacttgcctggcgggaaggaaacacgcttgcttcgactcatgcagcctagggcagcacttcctctatcctttcctctctcagtctcccggcgcgctgcgtctaacaggctcggggaacactgcagcgaaaatctacccctacacagttcccgctggcagcacgcaacagcgggctgacgaaatgaaggcgcatgcgcagcccccgtcccgcgacccgacgcacgtctcccgtccccaaaggagaggcggggccgcagttcgcgcgtgcgcaggcgcactaagctgtgaggcgctccggacgaatgaactccctcaagaaggtgcacagagtggtggcgagtcctttattttaatgccaaacttcaacttcctaagttttctcttccatccctgtctgtgaagaatccggggagtgtgtgagtgcaaatactagttttacctgcctgcggctgccactgcaacgcttccctctgggtaaatccaatttcaaagcttagcagtaaaagtagctctcagaagtgcagatttggccccaacggcccaaactatgctcgtttttgctcttgccttatccgcactcggacgctacaagcctgttggagctggtatttagaagcggtttctgagaactactggtcacgttctgtctgggctcccagcaacgtgtccagctgttttctgcgcctagttaccgtgtctgcacgatctgattcacccagatgttaaagcgctggtcccaagagagaagaaactatgtgtggaatttacccctgggtggacctctcagttgcttgacctgatgtcctgggaatcctaggctccaaagttggcagcctcagctttccgcagcccagtagcctgtgaaatgtttaggttgggggttgggtcgcaagagcttagggccagatcttcactgccaaagctaagctaaaagccgaggctatgggaagtggggaaaaactattaactaggactgaccctgattgaatagctacataatttaaagaaaatccttaagttacttagcattctttattaggaagtggaaatggagaagtgggattgcctctttaagagaccgatgaatagaaaaaacaaaagaatctaaaagtttcttgagagcttagatggagtggagggcagagaagtcctgcacacatagcttctcactgtcttttctgtctttctctgtgtggattggaaaggggaactaaccagcctgaacagatgaaacagggatgaaaggaaggaatctgagtttggcataggcgtgtggaaggaaaataaatctcggatccccaaactcattaagccaaagggaaaagttaagctgggaactgggtcacgcaaaactgccttgcctcttggtttttaaatgagatggctaccagatgaaaagctacacacctcgctcatattttgcccacaaggaaattctcagtgagcgccaagatctttaccataaagtgtttctattaaaatttaccatggcaatgtaaatagatagcttctgttttcaggtacagtcacccctctgccctcctgacacaaatgcatatctgattgttcccctgccccatttgtctatgttatcttacgtaaaaatgcagattcagattgactaagccagacagaggcatgaatgactattttccccctgctaccctctcacatgaaaactgtatttctcagtatcccaccctttcccctttaaatttggagccctcaaaatcatcttcccagaaaggcatagacctgtcttccccgcgcacgtccttaattttggcaaataaacgtcctaaaatgattgagacttgtctcaacatttttctcaactgacaggcttcacaatttaaacttaagtgtcaattatcttcctaagagattatcaggggacggaaaggtcccctccaaggggaaagtccaaataagaaccactacttattaatatttgtggcctcttttctctttgtttctcgctctctatgtctccccttacttcctccttcttcccaccttcctatcatactgagtaccctcaagaagttcctaattcacattgccttcttccaattccaggagaacccagcaa
